United States Patent 7,745,391 (HUMAN THROMBOSPONDIN POLYPEPTIDE) - sequence listing, part 215

SEQ ID NO: 538172 - DNA, 222 bp, Homo sapiens
accgacatacatctcgacgaaggatgagccggtagtgatgaacattgaggcgtcggcctcacctgctagagcgcgcgccaggagggtcttgccggtgcccggagggccgacgaggagaatgccgtgaggcagcttggcgtcgtgccggttgaagacgtcgggttcgcgcagccattcgcagatctcgcgcaggcggtttatggccgtcggctgaccggcaac

SEQ ID NO: 538173 - DNA, 1068 bp, Homo sapiens
  misc_feature (319)..(319): n is a, c, g, or t
  misc_feature (323)..(323): n is a, c, g, or t
  misc_feature (337)..(337): n is a, c, g, or t
  misc_feature (340)..(340): n is a, c, g, or t
  misc_feature (357)..(357): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (402)..(402): n is a, c, g, or t
  misc_feature (416)..(416): n is a, c, g, or t
  misc_feature (470)..(470): n is a, c, g, or t
  misc_feature (480)..(480): n is a, c, g, or t
  misc_feature (488)..(488): n is a, c, g, or t
  misc_feature (496)..(496): n is a, c, g, or t
  misc_feature (509)..(509): n is a, c, g, or t
  misc_feature (515)..(515): n is a, c, g, or t
  misc_feature (521)..(521): n is a, c, g, or t
  misc_feature (524)..(526): n is a, c, g, or t
  misc_feature (537)..(537): n is a, c, g, or t
  misc_feature (546)..(547): n is a, c, g, or t
  misc_feature (549)..(549): n is a, c, g, or t
  misc_feature (553)..(553): n is a, c, g, or t
  misc_feature (561)..(561): n is a, c, g, or t
  misc_feature (564)..(564): n is a, c, g, or t
  misc_feature (566)..(566): n is a, c, g, or t
  misc_feature (577)..(577): n is a, c, g, or t
  misc_feature (581)..(581): n is a, c, g, or t
  misc_feature (595)..(595): n is a, c, g, or t
  misc_feature (603)..(603): n is a, c, g, or t
  misc_feature (609)..(609): n is a, c, g, or t
  misc_feature (614)..(615): n is a, c, g, or t
  misc_feature (633)..(633): n is a, c, g, or t
  misc_feature (636)..(636): n is a, c, g, or t
  misc_feature (648)..(648): n is a, c, g, or t
  misc_feature (652)..(652): n is a, c, g, or t
  misc_feature (656)..(656): n is a, c, g, or t
  misc_feature (659)..(659): n is a, c, g, or t
  misc_feature (662)..(662): n is a, c, g, or t
  misc_feature (680)..(680): n is a, c, g, or t
  misc_feature (682)..(682): n is a, c, g, or t
  misc_feature (688)..(689): n is a, c, g, or t
  misc_feature (697)..(699): n is a, c, g, or t
  misc_feature (712)..(712): n is a, c, g, or t
  misc_feature (722)..(722): n is a, c, g, or t
  misc_feature (730)..(730): n is a, c, g, or t
  misc_feature (734)..(734): n is a, c, g, or t
  misc_feature (742)..(742): n is a, c, g, or t
  misc_feature (744)..(744): n is a, c, g, or t
  misc_feature (750)..(750): n is a, c, g, or t
  misc_feature (753)..(753): n is a, c, g, or t
  misc_feature (759)..(760): n is a, c, g, or t
  misc_feature (769)..(769): n is a, c, g, or t
  misc_feature (771)..(771): n is a, c, g, or t
  misc_feature (778)..(778): n is a, c, g, or t
  misc_feature (801)..(801): n is a, c, g, or t
  misc_feature (820)..(820): n is a, c, g, or t
  misc_feature (827)..(827): n is a, c, g, or t
  misc_feature (830)..(830): n is a, c, g, or t
  misc_feature (832)..(832): n is a, c, g, or t
  misc_feature (841)..(841): n is a, c, g, or t
  misc_feature (844)..(845): n is a, c, g, or t
  misc_feature (847)..(847): n is a, c, g, or t
  misc_feature (850)..(851): n is a, c, g, or t
  misc_feature (865)..(865): n is a, c, g, or t
  misc_feature (869)..(869): n is a, c, g, or t
  misc_feature (884)..(884): n is a, c, g, or t
  misc_feature (886)..(886): n is a, c, g, or t
  misc_feature (891)..(892): n is a, c, g, or t
  misc_feature (901)..(901): n is a, c, g, or t
  misc_feature (920)..(920): n is a, c, g, or t
  misc_feature (922)..(922): n is a, c, g, or t
  misc_feature (926)..(926): n is a, c, g, or t
  misc_feature (946)..(946): n is a, c, g, or t
  misc_feature (959)..(959): n is a, c, g, or t
  misc_feature (979)..(979): n is a, c, g, or t
  misc_feature (984)..(984): n is a, c, g, or t
  misc_feature (996)..(996): n is a, c, g, or t
  misc_feature (1000)..(1000): n is a, c, g, or t
  misc_feature (1008)..(1008): n is a, c, g, or t
  misc_feature (1068)..(1068): n is a, c, g, or t
ttacattcagtaacactgaatgtcagtgcagtccaatttacaggctggagcagcagctgcatcctgcatttccccgaagtattacatgattttcactccttgcaaactttgccatctttgttgcagagaatcggaaatcaatatgcatagcaaagtcacaatcatatgcatcagatttctcttttggtttcttttgctctgcatgcttattgggaagtcacatactgaagatgacatcaaaattgcaacaaagaatggaaaagtcagagggaggaacttgacagtttttgggggcacgggaacagcctttcctggaatncccnaagcacagccaccnccnggaagacaacgaaccanaaagccacagncncngaccaagaggcccgaaaaccggaatgccanaaaaaatgcaaaancatgcggtcagaacatagatcaaaggtgtccaggattaaatggataagagttgngggaaaaaanaaatgtantaagtgtngaatgtttatatntaaatntatggnttnnngaaaataaaanaaaaaatgnnantgtnttgttatngantnatggtgggggntttnaaaatggaaaatantatttaantgtttntgatnnaatgttaatggaaagggntgnaagagttattgnagtntaantgnaanaaagggtgggtgaaaaangnttattnnatttgaannnttataatgggganaaaggggaantgggtttntttnttaaaaantnggaaanaangggggnnaaaaaaatntngaagaantgggggggtttaatttatgtgtnatatatttggtgtttgtgnggggganganantgtgtgaanganntngannaaaaaggggggaanttangtggaaaaagggaantnaaganngggggaaantaatgaaaatggggggggnanaaanttttgtgagagggacgtagnggaaaagagtaangaaggggaaaagggggtggnagganaaaagggaaagnaaangaaaaagnaaaaaagttgggattgggaaaaagggaaaaggaggaaagggagaggggggggggaaaagn

SEQ ID NO: 538174 - DNA, 417 bp, Homo sapiens
  misc_feature (348)..(348): n is a, c, g, or t
  misc_feature (353)..(353): n is a, c, g, or t
  misc_feature (410)..(410): n is a, c, g, or t
aaccaacaacccaattgaaaaataaacaaaagatctgaataaatactaagatacacagatgggaaataagcataagaaaggatgcaaaacactttaagtcatgaaggaaatgtaaattaaaataagataccagtacatacatattagagtggtcaaaatccagaacactaacaccaccaaatgctggtggggtgtggagcaaaagggactctcattcattgctgatgggaatgcaaaatggtgcagtgactttagaattccgcttgaccgtttcttaagaaaatgaaacatacccttactacatgatccagcagtcatactacttgggtatttacccaaaggaagttngaaancgtatttttcacacattaatctggtacatgggtgttccttggcagctttattccttntttgccc

SEQ ID NO: 538175 - DNA, 81 bp, Homo sapiens
gggtagaggccagttatgttgttgaacatcccttaatttgggcttctctggagctccctcatacatatttggtggaaacag

SEQ ID NO: 538176 - DNA, 127 bp, Homo sapiens
cggagtcgataagtgctcctcttcgaatccgtgaaacctgcgaacttccggcatgcgtgtgtagcacaagcctttcttacttcggcattatgagccatagatggtatggtatttctgcagtacgatt

SEQ ID NO: 538177 - DNA, 1813 bp, Homo sapiens
agcacgaggaaagagcccccgagtgttatgcacagcttgggtcaggttcttgcctttcttaattttagggacagctacctggaaggaggggaacaaggatgttctcttccgcagcccgctttccccacgcccacacccacagtcatccagggacccatatgcctgccatccataggctggaagccactggtcccgaagatgtaggagcaagggatgccatcagtgaccatttatggatcttcagaccatccacatcagacccccaggactctggagttaggatggccgacatccatcaccatgatccatcagtggagaagactgctctcaagagccatacacacagacactcccccatccacacagccccaaatgccaagatgggacatagagaagacatagcacaaagatcagacaggagaccacataaagtcatcacaaagaccatggaagatgcaggagtgcaatggaagccaatggtagtgatactggcaagagattgatacatggaacaacctgccacaagatagatattagaaagatgatagaggatggctagacggacggaattgagagagacagagaggaagataagattgtaccatgtaaagcaggatgatcatcatgggagacacatagttagatgttagaggtggagcgcaggttctcatggattgacgcggggttatttgtagcaggcaggccgtggcatcgttagtcgccgcagcagagacactgacaggagtatagaccacatacaacagaagcagcacaccaacagaacggagggcaacggacaggtggggggacagaggagccatcacccgtgacgcgaggccaaagcaagagcaacaagatagacccaccatatcacaagcggaacacgacgacaatccatcaggacgacaagtggaaacaacatagcaaccagtcaccagtagtacacaccacgccacccaaaatacagtacctatgacagcactggggcagcggaaaagtgagacccaacgcacaagaaagtcgtaggcccccagtaaagagaccaagagcggataggccgagtgggcatgggcaacagagggacaaccacaaagagcaacagtgaggcaggaatgggaagagctagagcgcagacatagaacccaatacggcgaaggtaccagcagaagaccaccggaacgacgcaggaggacataaaaggccagaaacgacaccatgacacgagcacaccaggaccaacatatccacgcaccacagagccaatacacaccccaaacacagcatggacagcgggaggaaataacagcaaaacaaacacgagggaaggcaccgaaaagatagaagaaacccagggagagcacagcaacaactacgaactagaggagaaaataccaccaaagaaacacgacgcacaaacacaacacataaaaacacccggaaacaacagcaaaagaaacgtgaccaggccaacgaagacatgaagcaacacagagcaagaacaacgggaagacgaaaagaagcgaactgacaccagaaatgaacacaacccacagagagtcgagcgaacgcacagacgactataaatgtcttcgacgtaccatcaacgaccatgaagcagaaccgatagcacagtgcacaagcgcgcaacacaccaagtcagaatatactaacacgcgacgacaagcatggattgccgacgactgagtcaaaacataaagaatcacgcgcagatcatgatcgtctgctactcagtctggccgcgtcgatcgatcaaacacgacccagccacagcaaacaacagcgcaaccaaaat

SEQ ID NO: 538178 - DNA, 121 bp, Homo sapiens
tcgtgcactttcggacgtatgctacgattcatcatcaagactcctcacgatcatcatcgtcgtcccaagtctagcattggcatggccaaaggggtcaatgatgctgggacacctgggagcc

SEQ ID NO: 538179 - DNA, 735 bp, Homo sapiens
cgtggtggctcacgcctgtcatcccagcacttgggaggctgaggcgggtggatcacaaggtcaggagatcgagaccatcctggctaacatgatgaaaccccgtctctactaaaagtacaaaaaaaattagctgggtgtggtggcgggcgcctgtagtcccagctactcaggaggctgaggcaggagaatggcgtgaacgcgggaggcggagcttgcagtgagccaagatcgtgccactgcactccagcctgggcgacagagcaagaccccatatcaaaacaaacaaaacgtgtgatgataaaaagcgccataaacataatatcaaaccatgctactctgtcttaaattttcaaatagcttgggcacctgaaatacaaaattaagtgtggaaaacacagtttttaactgtgtgtgctcacaagctaattaatgtataagttctgccatgtgacacggttaccacatacagttcattttcgaaaaaagaaaaaacgccagacaaagcgacacaaccttggggccgcggctggggcccaaagaaggctctgaaccccatcgtgtggggcgcggagggcccaaggcggcagtggactgtggcacaacgggggccccaggagacgggccaacaccgcggggggtcccacacgataaaaaccggggaggacccgggggcgagaacccagggcgcgggcccaccggcctcacacggcgccaggccgatatcccccctgtggg

SEQ ID NO: 538180 - DNA, 314 bp, Homo sapiens
tgaagtctgggcttactactctaacacactatctaatctatctccccctccctaccctctctttacccccacggatccacccatattaagcacacatttgaaacatcagccaggccgggcgcggcggctcacgcctgtaatctcaacattttgggaggccagggcaggtggatcacctgagatcaggagtttgagaccagcctggccaacacggtgaaaccccatctctactaaaaatacaaaaattagccagccatggtggtgtgtgcctgtaatccctggaccaaaggcggaaagggcgacaagacgccgaa

SEQ ID NO: 538181 - DNA, 225 bp, Homo sapiens
  misc_feature (51)..(51): n is a, c, g, or t
gtaggatcccctttctttcgcccggctggatcagagtggagagctcagtangccgtctgagcactgcttgctggctggtagccatcgcggctgcatgttgccctctgttttgcggtattcgtccttctggtctcccttagtggcccccgtaggtgccctgcttgtggtcaaacacccgttcgttgttctccaccaggctgcccagcttctcggccagctgcgagc

SEQ ID NO: 538182 - DNA, 850 bp, Homo sapiens
cttagaacaggtactaagtgaactggagcgcctatgtctggcaggaacaggactacagtaagctaaatgtttcaaactacagtcaacatcaaaggtatgcctggaactgatggctgaatgcagaggacctggactggaggaagcattatcatggcaagcataattgtggcgacaccacgtgcctgtttgcatctgaaaaagatatgagtccgccaagagtgatggatctaaagatatttcgctgcagtgagccagagctgaacaatctaattgcattaggagacgaaacatgatagctttaagctctctttgatatgttagtcaatatgagttcagtcatggtgtggactggagcaaaatgtggaccctgcttcgttgtcctaagatactacattggggaaactgtctagggtgactggtcagaaggaagcttggagcacacagtggcatttaggtaacgcatacagtaacgggcaacattggtacagaacggtaacatgagtctcatacacacacacggagttaaaacgtgggatagtatctttccaagttggattgcctgagacttggtgagaggaagtatgcctggagctttgccagcaaagtcagatcgttcaagaatagatggcattggacgcgggttcggttggcgatgaaccatggcgcactagcaacggccataacaacacgaacatcgttaattccgggatgggaagttatactatgtagttacaaagtggtgggaccaaaaatgttaggcaaacggcatggaaaagggccgaaaagaagaaaccccccgaagggtgcactggtagggtttacttgatggggaaaatagggatccaaccag

SEQ ID NO: 538183 - DNA, 237 bp, Homo sapiens
ggccgccctggccgcccgcctgttaatgaaaaccgcccctgccctgggccggggtggggtcacctgcctccccaaccaaccggtgaccttttgggttttacttgggcaaagggagccatttgggggggccggttgttttttttggttttgggaggggggagggaagggggtcctggacccaacccccccctagtttttttttccagccaaaaggaaaaaagttttggttcccttcca

SEQ ID NO: 538184 - DNA, 318 bp, Homo sapiens
tgactctgcaggatctcggggcagcaatatgcaagtaaaccacattttctgaagtaacggtaaacaaaggagaaggtcaaatactacataccaaatgatcaaaatgtctcttggacctaaaattcttgaaactagtaaaaatggtaataaaagaaatttcatgccattaatctgtatagatcattaaatataaaaacaatttataaaacacatcagattttattgcttgaagaatacagcatatgaaatcacaaggatgtcaaaatgaaaagtcactagaattcaaacatataatacattatcagatgcagtaaaata

SEQ ID NO: 538185 - DNA, 346 bp, Homo sapiens
cggtgtgctgggcctcgctgaatcacttggattcccacattctgctatgcctcatgggactcgcagagactccaggctgtgcaccctgctcccagcatcactgttcgtcaatagtcacccagtggctcatgcctgtaatctcaacactttgggaggccaaggcaggataatcgtttgagcccaggagttcaagaccagcctgagcaacatagcaagactccaatctctacaaaaaataaataattagccatgtgtggtggctcacacctgtgatcccagctacttgggaggctgagatgggaggattccttgagcctgggaggttgaggatgcattgagccatgat

SEQ ID NO: 538186 - DNA, 107 bp, Homo sapiens
ctagaggaccctacgtaatatgtaaccatcatatccctgacaaatgatttgattctgggaaattattctaaggataaaaactaagaaaaaaattaaataacaaaaac

SEQ ID NO: 538187 - DNA, 232 bp, Homo sapiens
aaaagtttaatgagtgaagaagtgcccaaaatcccctgtatttttagtatatctaggctccgccaatgtcttatggtatgtaacccgtttctccccacccccaaccacaaaaaaaggctactcagggggttgaggcaggaggattgcttgagccccggggttcccggctgcagtgagctatgatcatccccctcccgtttagggtgggagccagagccagcccctgttttta

SEQ ID NO: 538188 - DNA, 318 bp, Homo sapiens
  misc_feature (92)..(92): n is a, c, g, or t
tatgttctgctatacgtcctaggcctggtcagaatgggcggagaagcttccatgcctaagctgtgctcttacccaggccccctcctgctcangcccatcaccctcagagagctctgtttgtgtgtgtgcgtgcgtgtgcgcgctgcaggtgcaggcatgttggggtgtgtctcagagcctgaacttcccttccagtcagtgctggaaggaggtgggcaggcgaatgatagaaaggaaggagtggattggctccacccactgtgcattctcctgttagtcttttcctcctgacccaggagtgggtggggataccagggg

SEQ ID NO: 538189 - DNA, 752 bp, Homo sapiens
gtagggatccctgaagctgacagcatgcgcgtccgagatgtctcgctccgctggcttagctgtgttcgcgctactctctctttctggcctggaggctatccagcgtactccaaagattcaggttactcacgtcatccagcagagaatggaaagtcaaatttcctgaattgctatgtgtctgggtttcatccatccgacattgaagttgagcttactgagagacatgtgggagagaatagagaaagtggggcagtactgcacgagttgtttcagcagggaggggtggtcctaccatctgtgtacatatgacttgacattcaccccccattggaaacagatgagtatgcctgccgtgtgaacccattgtgactttgtccaacagccccaaggatagttaaagttgggatcgagacatgtaatgcagcatcatggaggttttgacagattgccgcattgggatctggatgaattccaaattctgcttgcttgcttttttactatcgatatgctttatacacttaacaactttatgcacaacatgtagggttcataataattgttgaccatgggacatgcatcttactttataatcctacttttgagtgctgtcctccatgttgggatgtattctgtagcgggttgctcccacaggtagctctagcagggttggcaacctaaaaggtgggagcgagaatctcttatccaacatcaacaatctggtcaagaatttgacctcttcaaccttgaaccag

SEQ ID NO: 538190 - DNA, 272 bp, Homo sapiens
ccggcgtcgtgtggcatagttctaagggcttacgttatcaggcatactgaaagatgaaaaagtggacatacctttttttttaaatagcttttaaaagacaaaataggccaggcacggtggctcacacctgtaatcccagcaatttgggaggccgagacgggaagatcacctgaagtcaggagttcgagaccagcctggctaacatggtgaaaccccgtttctactaaaaatacaaaaaactagccaggcgtggtggcatgtgcctgtaatcc

SEQ ID NO: 538191 - DNA, 231 bp, Homo sapiens
tcctgcccttctgtcactgggtctccagcctcccggccttttcctcctcccccaggagatgagacgtatcttgacatcttcgcgacttctccctcatggctcagacgacccggagaagctgagccgtcgcagtcatgaccttccaacgctgttgaccgagccacggcccgcgcctgcctcccatgtgccccatccggccctctgccattaaagcctacctgtcgctcttca

SEQ ID NO: 538192 - DNA, 159 bp, Homo sapiens
  misc_feature (1)..(1): n is a, c, g, or t
  misc_feature (126)..(126): n is a, c, g, or t
natcggcaacgaggaaaggaaagaaactaaccaacaaaagagaaaaccaaaaataatcacaacagaaaccagctgccccaaaggaggccagtggtggggacgcagagggtcctcagagcaggagtnacaagggaggaaagaccaaaaaaacaaccaacc

SEQ ID NO: 538193 - DNA, 661 bp, Homo sapiens
tgcgactgtggtgcatgcgccatattttcacaagtgtggtctcccttgtccgggactatggacaccgactcgtgggccctggcggtggacgagcaggaatgcggctgtcaagtcgatgaccaatttgcagatcactggaagagaaagtcaaatgcagataccaatggtattatcaaaaccagtaccacatgccgatgaaaacatgatgaagagtgagaaagatgtgacagatgctgaccagctccttactcaacaagctgatcagaagcaaccttgttgataaccacgaaaccaagtgtgaagtcctgcaactgggatccaaagctcccctcatgtactcggtgaagtcgtttgacacgagctatcggctgaaaccacatgcttctccagggaagtctatgccatgggacttcaatcgaacctccaagatacgagagaacgcattacccatgattgcttgctgaacccccacagaatctgatagcccagtactcagtcttggcactggctaaaacagctgccttgatcttagccatgctcatgccgcgtggcgccatcagacagataaccccagtgtctgtgcatactcaccaaatatgagctggcgcattcaacaaggagagtgctcgcccaactgggcgacttaacccagaactgatct

SEQ ID NO: 538194 - DNA, 320 bp, Homo sapiens
atgccaaagtcaccgaagaaaaacgcagggacgcaaggaacatcacgtaagaagcgtcaagcatacagggaagaccagaccactgtggaaaacaccctatgtccacaatctgggcaacgtgtgacaagtttacccacttggtactcatcaacctgccctagtacaaattgaattacatcatcttactgaacactactgactttactgagtctattcgctgatttgatgtcacctttcatacgaatcacagtagaaaagcgtatgaagtttattcaatacagccaagatgctggctgctcaccggcgcaatatagttttca

SEQ ID NO: 538195 - DNA, 814 bp, Homo sapiens
gcaggagagcaagatcggaattcttgcagcctccataattcatgtgcttaagctgtaaagatactcctctttgtgttatccttagaggactcactggtttcttttcataagcaacaagtacctcttcttaaagtgcacttggcaagacgtcttcactcctatgtatccaatatagtttgatgttcatggacgctgttctcaccttgttaggcagatgctagtagttaaacacctaggttggttcaccatgggtaaaagcatgagtaggctgacctgtggggtcgtcaccactgctggatgctgggtcacgacgtgaagtgctgtgagagatgtttatgtaatatgctgaggtaggcgtacgtcgatgtggcagtagaatggtaaagacgtgaattggaattgtaatgctacatgtgaaatcagagaatagtggtaataagtagaatgtcttcatgagtaattccataaatatgacttacacagcaattatcctcatgagtactcatgaactgtaatcaaatgagagacgaggagtacgggctgttgtgaccaatgtggagtcctggggaaggggagaaggggtcgcatcatcccatgggtaacctcgttcgtggagagcccttgcatggatccaaagaagaggttcttgtaacaacgggggtagcctcctggaaatcctcttacactatgagcctacggaccttcttgggtcctaaggaaagtgaaacgaattgaaacaagggtaatctctggttaaaccgtataatctgggtcgtcattttgagccaagttgtcattcgacatcccttgaaaa

SEQ ID NO: 538196 - DNA, 210 bp, Homo sapiens
cagagtatccccgtcagccacctggtgatgcgagtcggtggcgcgaggacacttttctgactccctggcccctgactcggctgtccactttccattcccgtcgcgttggtcggccgctactccggtcccaggatgctagaactgtgacttcgtactgctgaggggaacacggcactgggaaggtgggtgatgtacctgtacccgcggatc

SEQ ID NO: 538197 - DNA, 951 bp, Homo sapiens
gataaatgacactcacattgtttccgtgtggttcagctagagctcttccgagagctgtttggggacccccttggtgtgacacatgagtgcttacaacagttttgtatgggcagcgcgtgtttgaccacttgtggccgcgtgtgtggcggccccccgcccgatttggttcgcccccgcctctgtgttgggggtgccctgcaggtgagacagtgccttgtgtcgcaccgaaaacccgccgtgtgtctggcacaataagagagcgggcaactttcttgaaaactcgacaaggggaattaatgttcggtgacactcgtcgcccaggtttgtgcttagtaaagtgtgggccacgcccaaatggcccaaaatgggaaggggcccccactgttggttaacggggcctgtttatacagaaacgcgacccacctttcagggctggcccaagcagttacactcgggtgtgtcccccaacaagcccccgtgcctaaaaacattagccccttggggaccagccgcgagtggacaataatgaaaataaaggtcccactttattagagacccctacagcaggggtgcgcaccagggaggaaccacaacttttctacgggggccacaagggaatgttacctccttttcttagaaagctaggtgaggaagatgccctcgttatacgacgaaagagtttcgattactacaacagccaatggaatgtccccacgagtaggttacgggtgagagccacaccacgtaatttatggggatgcgcacgagggaataggtataatgaatattcggtggaagcaccatttgtctatatgaggaccatcttcatgctatggaagactaggtctcacgaggcgcccatattcttctccgccaccatcagacgattaaataacaaattcgggttatgattaacagggaaaaaaggggccattttcaaaccccatgaca

SEQ ID NO: 538198 - DNA, 185 bp, Homo sapiens
gattgagctggtaccaacttggctgtgctttggaagctgaggcaggagacatctgagcccaggagctgagacagcctgggcaaatagagaatcgtctcaacaaaaaaaaattttatgccaggtgtgctgtgagctgtagtcccagctacaacggtgggacggattggcttaggcctggtgtgatt

SEQ ID NO: 538199 - DNA, 622 bp, Homo sapiens
cgaaaaagtttcttaaaccttcggttggggcgcgccgggcccggtattagggttaagtgtgaccatgtggtctcattagctgtgttccctatagagagatctcctgtggttctcatgttagatatagtgtgcttggagattcctctaccacacattataataaaacaggccgcggggcggccaaaccgagaacggcgtgctgtgaacgcaactctcacgagatgtgagagttccggtagagggctcatctacacttgggagtctctattctcaaaccagggagattgtccaaagcgcgagacgtctcgagatattctcaaaatttatcaggcgccccggcccccttggaagtaaaaagaaaaaaaaaaaaaaaaaaaaaaaaaaaaaaaagaagaaaaaaaagagagagaagaggacagaggagcagcaacaggaaaaacacgggcaacagaaagagacaagacccgaagagacaaaagagaggagagacgaaccgaggaaaaagaccagaaagcaagaacccaagagagacaaaaaaaaaagacgcacagaagagaagaaaaaagagaaaacaaaaaagaaagagagaaaggaaaaaaaaacacaagagaaaaaccaacgg

SEQ ID NO: 538200 - DNA, 216 bp, Homo sapiens
gacactggataatgccaatctggtatggggataaggggtgtaggtgtgcctcgtcggtaagaagtgggctaggtgcattgttaagtcttagcagcgaaagcctataatcactgcgcccgttcataatgtgatcggtcatggcataggtttatatgataggttgagtgtggttggtagtaaatagagtacggtaggcaatccgaggcaggttagttg

SEQ ID NO: 538201 - DNA, 260 bp, Homo sapiens
ttttttttttggttcccaagaccctgaaaaggtaaagcatgggaaaattttaagccaccataggtaaactttttgggttgaccccggattttttccccatgatttactgggtgaagaaaaattttataacccaacgggtttcattcgggggggaattgtaaaagcaaggacttgtgtggtttggggaattatttaagggccattatgtataaaaaaatgggttcccctggtttttaaaataaaacctttataaaagggga

SEQ ID NO: 538202 - DNA, 374 bp, Homo sapiens
  misc_feature (334)..(334): n is a, c, g, or t
tgtggtgctttcctctttctctcaggttgtctattcagggatgttaagcaaagggggtcatacaacaaaattattttaaaacaaacatacttcagaaaagtttatggaaaaattaaacttgaatatattaactttacaggatccatttacttcaccctaacactgagttaaaattataacaagagaaagtagggctgggcgcggtggctcacgcctgtaattaatcccagcactttgggaggccaaggtgggcagatcacccgaggtcaggaatttgagaccagcctggccaacatggcgaaaccctgtctctactaaaaattaaaaaattagncgggcatgtaatcccagctactggaaagggcaccgcaaaa

SEQ ID NO: 538203 - DNA, 356 bp, Homo sapiens
ccatgggatgtattataactaactattacagaaacacagctaagaatatcaagtattgctctggctctagacagaaaaaaatcagttgacttatccctttgctgtcaaaagagttggcgtgtccggttcggggtgctactgccaaacgttatggtacttagagtcgggatcacaacttcaagcaccgacttatcaatgcagccggctgtgtattggcgaatgggccgttaccttaagcacggagccagccgggtttagtccagccattacaagaatgtatatgtaagcggtcggtagttctggctttattaaacatgcagcatgaggtactcttctgtcctcatgtacagtgccag

SEQ ID NO: 538204 - DNA, 519 bp, Homo sapiens
ccttggcccactagctttcttcaacctcccaccagaagataactatagaaaggcacggtgcaattaaatctacgtctctacactgtcaggagagggagaatgtggtgaggtgctgtagttctgagattggattatattttccctgaaaaaagtctgctggtatcaactcactgcaatgtgtcactccaatggtacagacaagcattcactatcctgcagggacaagccacttttcgagctaatcgggcacatacagctcttacttcaactctcccacatctaaacactaacactgctgacgtggcagcaaattcacaaacaacaacttcctatgctaaaactaaatgccaataaagaactgaaaaggccgggcacctgtggcttacccctgtaatcccagcactatgggaggctgcggccaggcggatcatgaggtcaggcgctcgagaccatcctggctgacacggtgacagcccgtctccattaaaaataaacactaaaactactattccaatggtc

SEQ ID NO: 538205 - DNA, 235 bp, Homo sapiens
aaattttttccgggctttttttatttttttaaagggatccccccgttggggtttggttttttttttggggctcccccccttggcaaagggttttttaaataaaagtttttttacccttaaagccaaaccaattggcccaaatttggggtggaatttttttttttcccggcccggggtccttggggaaaaattttcggaacccacttttttaaaccctgggttggaatttctccca

SEQ ID NO: 538206 - DNA, 675 bp, Homo sapiens
  misc_feature (671)..(671): n is a, c, g, or t
cggggagccaacaactaagtatgactagtttacacaatagctgctataggaaagataccgtagttacggactacacttatgactggataaaggccaagttgaaagccgcattgctgggtcaatagaccttgccgcagccctcttaaaactaggcgagtgtggattaagacgcctgagactcatggttaaccccttgaccacatagcctacccgttccttgagctatccctatggggcattactatgacatgctggatctgcctacgacagacagacctaagaacgatcattgcatactctcgaatgagccacatagccctcgaagtaacagccattctgatccaaaccccctgaaggttcaccgaggccaacattgtcataatcgagcacggacttacatgctgagtactatgctgcctagcagactgaaactacgaacgcactcacagtcgcatcataagcctctctcaaggacttgaaactctactcccactaagagctatgtgatgacttctagcaagcctcgcatacctggacttaccccccactattaacctactgcgagaactctctgagctagtaaccacgttttcctggtctatgactcgtctgactacaggactcaacatactagtcactagccctatactccgtgtacatatttacgacancctg

SEQ ID NO: 538207 - DNA, 108 bp, Homo sapiens
ccctggggccgagtcagatacaccatttaatagatctgaattgaattttaaattaaactaaaaaaaaatttcttcttatttcccccctcctctcccgacagggtctct

SEQ ID NO: 538208 - DNA, 328 bp, Homo sapiens
tatgcccttgtaagtattcaggagggacatgttaggcttatatatttggggacgttgggaaatgtgcgtctgctggagagatgaggttctgtgtttctacaggggcgtgggcgacgtgcatatctatggtgtgagaaatatgtgctgtggttatgtgttacgagtattgtgatggatgagctgggttctaggatcataggatatgtggaagtcctttcctctgtggtttgctggcgctagagtccacgtgtcctacctgtgtatacctcgtccgtgtgtctatacaccaggtggcctgaatgaccaggtagtgttcctaatggtatgc

SEQ ID NO: 538209 - DNA, 122 bp, Homo sapiens
gtgtgatctgcctcgaggctatgatctgagcacgcaggagataacattttcttctagcatcacgtgaggcaaatgtacttttggcatgtctcacaacaggaccacttcagttcccaaagagc

SEQ ID NO: 538210 - DNA, 752 bp, Homo sapiens
catgctcaaggcagcactgacatgccagccttccaccttcttggcccactctgaactttgggcactgatgagcataagagggaagctgatggggggctgagggcagcttgcactgacctgcaggtgttccttgatatatacatcctgggtgccatgaaaggcagcaggaggcagacatgttcctgagtgcaagggggtgggccccatggtgaggccccaccttcaggccagggaggacctgaagggtgggaactggcctgccagtcctgcaaaccccaatctgaacttgtggtgccttttccaggcctccccatggccacccatggaccagtcggcattcacttcctcccttctgcggcccataaaagccctgggttcaggcagagctgagcagacatcaggtgaccagctgcagaaaggagctacccactccagggcctcatctctgctgagagctgcagagatgaccagaagacctgcatccagagaggagcttccgtgatccagggctattctgtcactcaagtaaagcttctctttgtcttgttctcaaaaaaaaaaaaaaaaaaagaaaagaacaagcaggggggcaccgctgaatgaagttaccccacgggggggccacaagatttccgggtaaccagggttgatgtgggtaccaagggggcgtccctattacggagggcgccgatatgaaaaggacgagcgacacgggaccgtggtgaagacaaggaggacaaccgcggaaaacg

SEQ ID NO: 538211 - DNA, 86 bp, Homo sapiens
cactatgaatatgaaaaaatattctaatccctaatcatcggagaaatgcaaataaaatccacagtgagactccatcttaaacaaac

SEQ ID NO: 538212 - DNA, 142 bp, Homo sapiens
tataaacactgaactgcacattaacagcccaatatctacaatcaaccaacaaaccatttacccaaataaagtataggcgatagaaatgaaacctggcgcaagtagatatagtaccgcaaggggagaagatgaaataattata

SEQ ID NO: 538213 - DNA, 291 bp, Homo sapiens
  misc_feature (34)..(34): n is a, c, g, or t
  misc_feature (37)..(37): n is a, c, g, or t
ttagcccctgtagcacctccggcaagtaaaccangcntgactaaacgtctgaagacttctcaccaggaggtagcggacaggtctggcacccagggatgcccaccacttttactgtgtcctacttcctacaggacacgtaaggtttaatgtaaccaccatatctggcactgagatagactcaacagccccatctttcttggaggcatctacacttccagagccccactcctcctcttcctccagctccctgcaaggggtctcctccatctcctgctctggtgtctcctcatc

SEQ ID NO: 538214 - DNA, 496 bp, Homo sapiens
atatacccctttaaagatgggccgcgcttttggatttattaccccaccctgggggggttcacagggggtttaagaggccccttttgtccccccccgggagttttttttcttcccccccaggtttttggaggaaagggggggacaacccttttttaacaaaacccccgggggggggcccttttttccacattttagggggggttggccccttaaattaatgggccacccaggccctttccccccccccagggttttttaggggcaaggccccccccccccttttggggggggaaattgggggttaagggggggggttccaacccccctttaaaggcccccccaatttttggggcctttttcagggttgggagaaccattgggggcccccaagggttcttccctgggaaagtttttgggggggggcccccggggggtgggcccaaaaaccccttaaaaaagggggttttttaatggggttaaaaaaaagggggtttcc

SEQ ID NO: 538215 - DNA, 2118 bp, Homo sapiens
ggtgagggcctgcggcgctccagcaggagcatgagcgagtggagggagggcctgtcactctccagcactgcacaccgagtgagtggagggagagcctgtcagctctccagcagaagcaccaaggattggagggagggcctgtcgcatctccagcaggagcacgaggagtggactgccaggaccgtacacatctccagcacgtgcaccacggagtggagagagagcctgtcactccagaaggagcaccaggagtggactgcggacccgtcactatccagcacgtgcaccaaggagtggagggagggccccttgctctccagcaaaagcaccaaggatcggaagtagggcctgtcgctctccagcacgtccccccccggcagtggagggagggcccgtcgctctccagcatgagcacccagagatggaggaagggtcagccatttgtcaggctctgcgtgtgaaaagctgtgatttcatttcttatcagttattactgtcactatcactcaggatgaaattggcctcacccgctcaggagcaatgctgccttctccctgtcctcctcctggattgttgaggaaaaagccagactaacctgttccacaccttggcatcagttgcataaatgctatctcagcatgttctagaacacagtactgtttaaacaacgttctgggggtaaccaagtttataacttgcagacccgatggccgtaaagcatggggtgggggggtgcctgcctgcattgcagctgtcagagctgcacagagcctgcgacacccagccatggcttctgcccaccaggccacgtccctccgctcctctgaatccttccagttcttcttaggccacttaaacgccaccgtctccacgaagtcctgtcggatcaccctcataggaagtgacaaaccacgttttgaacccctctccccacccagcaagcccctagcccgcgagcataggatttcctttctagaacacgtgttctgtgaagggccagaggcaatatttgaggcctcgtgggccacatgctgtccctgttgcatatccttttttttgtttggtttggtaaactgcttaagctggcagaacaacagaacccgcacattctccacgcagcccagcgcccttggccatgcagggctgtgccttctgccagctctggaggcccaggggctggcatgggcctcccgtcctgagccccccatgtacattgcacccatactgggaacgcccccaggatctgctgcgagacccccaaggaccagcttctgcagtcctggaagggctctcctgacccccaagtccgccatcttctgatggtggcaggtgggcacagtcactggctgagcgaccaagggtcagtgagattactaggccggcgctgcacccaactgaaatgaactcacgtgtcctcacaactcctagcagcagatgctgtcagcctcgcatcctacaggaaaggaaccatcgccaaaagacgctgaggaacatcccgagggtcacagggacagtgcagagccaggaccagcccggcccatggtcccccagcgtgcaccacctggcccggcactgtgtgctcagccatgaggactgggaagagtcctgcccacagctcaagtgtctacaccgcactgccatccaggctgtgagccgctgctgagcatggggaatgtggctgctgcagagacgttatgaaacacttctaaaagaatgtaaaagatctcattaataattttgagtacctgttaaaatgatagtaattttggatctagtagattaaataaaacatattattaaaattaaaaaaaaaaaacaagaggaagacgcagcgacagacagcgagacgaaggaagaaagacaacaacaaaacgggggcggcccgcacaaagagaattccccaagggagggcccaccacgtataggggacacccaccgacgttgttggagaccacgagcggccccccacaaggcgggcggcgtgcagacaacaagacgagcccggcccgcgcggagataaaagcagcggtgaggcgggaaacagcgtgccaacggcggaaccgtgtggaacaaccgcctcacgtgcggcgcggaacacaggggcgccacaccacacga

SEQ ID NO: 538216 - DNA, 186 bp, Homo sapiens
tgcagtacgtgatgtgccatggcagccaaatacaccttgaactgacaacctgcctgctcagagaggatgtggagtacctgtccccgtgaccttgaatgcactattggctgtgggtgcctggggcagtgagaggcccagggctgtgccctgtgaatgtgtcctatgacttgtgacacctatctccca

SEQ ID NO: 538217 - DNA, 446 bp, Homo sapiens
gggctaggatcatatcagagtatgtactctacatcgaacacaatatatagcaggtaggtaacgtatgggcccataaagatgtatgagaaaactgagactcagaactgtcccagctcatccaaagcaatagacatcagagctggggtttccatgcgggtctgtgtgtctaaagattggagtacctgctaccattcttgtctctcctcatctttaagatggaacaatgacccttactctcctagctaccatgtacggctgttgtgagagttggataagatgctggatgcaaaagcactttgcagactgcaaagtcctgtacagatgcaaggcttgtaggccgtccctggcatccagccagatactgtacccagctgccacataagtgagcaatatggtataaaattgggtctcattgagacatggagcctgagaaggtctttgcagag

SEQ ID NO: 538218 - DNA, 857 bp, Homo sapiens
ctcctgtcaacagcgggcaggctcccaattacgaaatgctcaaggaggagcgaggaagtggctatgctgggggcgccccagaaacctgctccctcgacgtccaccgagatccacagccgcatgcgagacctccgtggcctgaccatgtcagtcctggggtcactgtacagaccaccctcttcatgaacacctgctgcctgggctgcatagcggtacgcctactccggtgaagtctagggacaggaaagatggttaggctgacgtgaccggggaccgagcgctatgcctccaggcgacaagtgcgctgaacactctgggccctgataggggcatctacatgaccatgctgatcatcatcatcaccagtgttggtcagtccgggccaagggatagatcaggaggcatccattgaggcacacggagctctgccgtgaatttgttaccaggtgactctatctacccattcctcggccatgccccagaggaaaggagctctgcccttgactggaatcccattacacgagcttccattcctcgaccatggtcccaaaggccgaggtactggacatgcaggcacctttatcatgcacacgcagcttctaacaagtgggccttgcaactcaaagtgttatgtgctgggggctgcgtgtgaaactcaatgacaagaacaaacaccacaataaagacaaccatcacaccaccacaacccaaacgggaacgcgcggcacacaacaaaacaacacaacaagaacgacggcaccagaacgcacacgaacctaccccacaggccaataccgggcgcacaacaaaacacacgggaccgcaccaaaaagaaaagccagcacaaggcgaagaca

SEQ ID NO: 538219 - DNA, 308 bp, Homo sapiens
ccgcgtggtagtctacttccttagccgcgaatatggtaagatcgagcaatgggttcaggagatgggttctcttctccggtgatcattcaagtgctcagtgcatgaagattggcttgtctcagtgtttcaacctcaccagggctgtctcttggtccacacctcgctccctgttagagccgtatgacagcccccatcaaatgaccttggccaagtcacggtttctctgtggtcaaggttggttggctgattggtggaaagtagggtggaccaaaggaggccacgtgagcagtcagcaccagttctgcaac

SEQ ID NO: 538220 - DNA, 241 bp, Homo sapiens
cacccgggtcaaacaataaccaaaaaaagaacaaaaaaaacaagaaacataaacatacaagacaataccaaacaagaacagcgaagagtatatatgcagcacggcgaaaacaaagagaaaagacaacaagcaacgaaaccagaagtgaggagaacaagagttgaagcaaaagtaggaaagtacgaggcacaacaaaggagcggaggaaaaagaaaaaaggaaaagcaataagaagagcaca

SEQ ID NO: 538221 - DNA, 951 bp, Homo sapiens
cgtgggttctcgtgaatgccacatctgtccgtccagaagggcgaatccctgtgctgactcctgtgcatgaccatgatgcttgctatgcctgactgtctgtctgttgcatcctgtgcagcccctagccgtggatgcatgttgtgatgcttgtgcctgccaatgcacttgcctgtgatggccagtgatcaattgcttggggattggggtcggacgagcaccccacccaggccctgcttggacatcttcaccatcctgtgatggatgcttggtgcaacttgtacaaattgtgcattgactgatcacgatggtgggtgaccatgaaagcactggactgcacagtacattccctggagcatgcctgctcacccatgtatctgttgtcatgccttgcgactacgggtggcaaccatcccatgaccatgcgcattgccagcccaacattgtgcaggtgccttcgttgtgccttaccctgtcgggcacccaatggcctgtgacgtgacacttcgacagaagccatttgactggacggctgcttgacttgaccactcgattgttgctctacattgaactctgaactcgcagaacaggcacactgatttagtggcctcattaccacagatacgataccggacaggcttttgctattgtgggatcaaggattcgatcccttcacattccccacagacactcaaatggagccgcgtgtgcctcagtgaccggacaggactgtgatgggcggcatgccaccgctgagttggccccccgggtggtttcgaaacagatggaattacacgctgttgggagacgtagcgacctctcggggacatcccacctgtggcagcacttaacttttcattgaccaccgtgctggaagaaaccgtgcagttggtacactacctgcaatggggcaccctggtaacgcacaccggtgactgtgtagcggtatacctc

SEQ ID NO: 538222 - DNA, 83 bp, Homo sapiens
gacagcagcttctacatctgcagtgctagaggaggggggggggacaccatatattttggagagggaagttggctcactgttgt

SEQ ID NO: 538223 - DNA, 298 bp, Homo sapiens
ccgggtcgatctccaggatcccagatgtgtgggaatgcagttccagacctgtagttaatctaggagagatgatcgcactgtatatacaacaaggcttcccatgctcatgacatcataagaactcttacaggattaatgagttttaacttaaatgcagaatttttaaagctatgtgtaattgctgggaccatttcaaagtgtttgtccatgaacaaatgggctgatgaaaggaaccatcccaagatctctgggtccattgaagatttgcggtggtttggcgtaccgaagcctcgaattc

SEQ ID NO: 538224 - DNA, 782 bp, Homo sapiens
ttgtttgtccgttctttctctgtgttcctattgcctttgttttgtgggtcctccagttcttcctgttcgtctgttcttgacccgttggggttcatcccacccctgttgtgctgtctcataggcatcgggggcccacacccctcttcatgctatcgggcttcttctggtcatctggtgtctgtatgccttattccagtagcagtcctgtggcctgtaatagcatatatttcctaatgatcgtgttagactggttgggtatcataggagccttctgaatgaccaggactgctctctttggagctgatgtcaatgtactctcttcagcgtgttagaaatcacttgttttattctgtttctcttggccaagctgggtctacgtgtttcttttgtccgggtaatatgatctttcaaaagttgtacttctatcagagattacatatactgcccttgcagaatatttcaggtcttttgttaatgcctgtaattggtccttaaggtgcagtatttttgaaattattatttatagaaagtatctatataattcttggggaaagtgtgttataagctttaataattacattgagatgcacatcagtggtgtgtcattaacaatgacagtggggttaatatctgaggcctatagatgaaattgtgccttatggaataaagggtaaaataaaatatccctagagtaagagactgtaatcagatgaaattgtaagtaataattattgagggggacattatgtgcattttattgatatggttaacgttcaggtttt

SEQ ID NO: 538225 - DNA, 200 bp, Homo sapiens
cagtcagccgcatcttcttttgcgtcgccagccgagccacatcgctcagacaccatggccaaggtgaaggtcggaatcaaccgattttgtcctatttggcgccttgtcaccaagctttcttttaactcttgtaaaattgatattttttccatcaattaccccttcatttacctcaactacaaagtttacaattccatata

SEQ ID NO: 538226 - DNA, 104 bp, Homo sapiens
atctcttgctggtcttgaactcccacctgcactgacattttgttcctgtgcgtttccgtagggcaccagcgtgaccattgaggatctccatgtagcaacagcca

SEQ ID NO: 538227 - DNA, 887 bp, Homo sapiens
  misc_feature (562)..(562): n is a, c, g, or t
  misc_feature (731)..(731): n is a, c, g, or t
agcgggagaaggaaaaggatgttgtacatgggcagaaaggtgaaaattgtggccagaggcagattgtgctatcaggtaaataagcccaggctattgtgctggatgatgagaggtcactggaacactgatgagccataacagctgaggccattctagaataggcagctttagccaaccaggcagctgactgcagatacaggcctgcatccagatgagtccagaaaagcaacctagacactactggcaaagacattgaaaagaatcacactgctaaaccagtagcagcttttatcttcttctcagattgtatacatgcaggataaaagtgtttctaacacatagacttctatattccagcataaagatgtattaggcgcatttatacttttacatcgaagcctgtttcaacatgaacggagcccagatatttatgtaggccagtaattggagtgtatttccctgttcaatttcacattgtctataaaagggtttctcatgatcgatgactttctagttaaattcagaagaaaacatcttgcagctactgccctattgccatggncacacatcactgccttctagacatgggaagttggtgacttaatcctcgttataccctgattttggacaaattttacaagaagaataggacttctattctctatgtctacatgcacctggaacagtgctaggtctatgcttacaaattgattggttccaggtcacccggncatgaaggcctcaggacagcaaaattggcggatattgagagagagagagaaaattgactgggtaagaaagaactgaaccgaatttacgatgcacatgggaccttgggccttgaaacttccatgtccaaaaagggaaggtccctgtaacagaggccc

SEQ ID NO: 538228 - DNA, 312 bp, Homo sapiens
  misc_feature (87)..(87): n is a, c, g, or t
  misc_feature (120)..(120): n is a, c, g, or t
  misc_feature (142)..(142): n is a, c, g, or t
  misc_feature (156)..(156): n is a, c, g, or t
  misc_feature (300)..(301): n is a, c, g, or t
agttttaaatgtagtgaaattgtccccacagcaagctggccccaagtgcctcacattttataccccgctctgtcttagtgcgttgcnagagaggagtatatacagtagttcccccttatnccacaggggtacattctaagancccccagtgggtgnctgaaaccacagatagtaccgaatcttatacatactatgttttttttctaaacataaatccctacaataaagtttaatttttaaattaggcaccataattaataataaaacagaacagttataacaatatactataataaaatnntgttatttgtg

SEQ ID NO: 538229 - DNA, 141 bp, Homo sapiens
tcaaaaaccagattgctgagccactgcccccgtgatcccagctgtgtcctctgatggtggagctgcaagacctgagtgaagtgagctggagagagtggcagtgagagctccagtgctcagtgtggaaaacaatcctgtgca

SEQ ID NO: 538230 - DNA, 342 bp, Homo sapiens
acctcagacaaccaaaattgtgtcttactcattcttttagtttaacagagaacaaggagcaaatccaaatgattgctgttagaatgggttttgtttttgggaggccaaggtgggaggatctcttgagcccaggagtttgagaccagcctaggcaacatggagagactcctgtttctaccagaaaattaaaaacaattagccaggcatggtggcatgcacctgtggtgctagttgcttggaaggctaaggcaagaggattgtttgagcccaagaagttgaggctgcagtgagctatgttcatgccactgggagactgacagagtgacattcaacctgcctccg

SEQ ID NO: 538231 - DNA, 108 bp, Homo sapiens
tcctatgaagcgtttgtgaggcatatcctgtcgggtgacgggcccatggggcaggagcatcgtccgcatggtgctgaatggctggaggaccttcccagtctccccagc

SEQ ID NO: 538232 - DNA, 542 bp, Homo sapiens
  misc_feature (274)..(274): n is a, c, g, or t
  misc_feature (300)..(300): n is a, c, g, or t
  misc_feature (330)..(330): n is a, c, g, or t
  misc_feature (346)..(346): n is a, c, g, or t
  misc_feature (348)..(348): n is a, c, g, or t
  misc_feature (387)..(387): n is a, c, g, or t
  misc_feature (424)..(424): n is a, c, g, or t
  misc_feature (494)..(494): n is a, c, g, or t
  misc_feature (539)..(539): n is a, c, g, or t
ggggctcaatctaatcagctgccagcgaatataaagcaggaagaaaaacgtgaaaaggagagacgggcctagcctcccagcctacatctttctcctgtgctggatgctccttgccctcgaacatcgaactccaagttcttcagttctgggactctgactggctctccctgtcagcttgcagacagcctattgtgggaccttgtgatcataacacatcgtgcttgcagagagagcaaaccatgcctgtccctgtggagcccacagtgctatgtgntagtgtggcattgggccaggaatganaacaactacaccatagtaacaatccgtcantctgtccatctgctancncagaggatctaaaatagtttcattcaccttaaaatccangctctatgaagggctgtttggcggcttggaagctgcngagaaacaggatgctaatcggatatggtgtccactgtaacctccttgggggaacagcatccatcattggngtgtgaatttccttcccaacagcctccagccaaggagccggaggnggc

SEQ ID NO: 538233 - DNA, 959 bp, Homo sapiens
  misc_feature (184)..(185): n is a, c, g, or t
  misc_feature (276)..(276): n is a, c, g, or t
  misc_feature (304)..(304): n is a, c, g, or t
  misc_feature (484)..(484): n is a, c, g, or t
  misc_feature (491)..(491): n is a, c, g, or t
  misc_feature (596)..(596): n is a, c, g, or t
  misc_feature (724)..(724): n is a, c, g, or t
  misc_feature (730)..(730): n is a, c, g, or t
  misc_feature (779)..(779): n is a, c, g, or t
  misc_feature (935)..(935): n is a, c, g, or t
atcagtttggctatgaaagacccagctaagccacttaggcaaaagtctatctttgatgtcatagtttccaagaagtatcataagagtcaaacagttaaacatttctctgtgcttttttttctattttctagaaatgttgtagagagaagctcatcaacttacttatacaaatcagatatactgnngaggggagataaactgacatttccatattttataatataatgtggaaagattcagaaatgactgagaagatacagtgatatgatatttaangcaaatattggcatatcttatacaaganaggcatcttacaataatatttctgttggtacattacaattttccagctagtaattctaaaatgccagaggtcctatgatgcaatatcaaaaaaaccagggaactgacatacaaagtcaaatataaagatagtaacattcagtcatccacagataaaaggctatctggacataagcctganacaagcnagacgccatccacggcgatttcgccggttttgcccttgccacgttctgcttcaaaaatgatgcttttggtagcatcagttccttgatacaactgaatttccctgncttcacttttcacctcactcgtggtcttctcccatgccagggcattgttactgttttcaaaacactcgagtttcccgactttgtctcggccagccggtaataaagagcaacagaagttgctttggggntgcagncaggtaggagaagtttcaatcggccaatgtctttcttgtgaccgccaangccggaactgccatatagagccaatagcattatctcgatcagcaggattcagtcaaatcatctctctatctgtttccagtcacagatcccatgattgaagctgcagtcaaccgagatatttaaatctttatgttccagtgtggaagttagcgcttncttttggacagtatcaggcggatt

SEQ ID NO: 538234 - DNA, 310 bp, Homo sapiens
cggcggcccccacaggataagcgaggggatttcgttggtctccaggagcgagcgcagcagggtatccgtgccacggccttctctgcccgaagtaatcctgcagcgtgtcaggacgcatcgtgtagtccagcggcttgccctgtagcatctgtcggatctcatcggcagccagcgcccgggggtgcggctccaccaccactggcacagaaggcggtggcggcttcggcaggtccgcgtccaagtgccccgggtagtcctcgccgtgcgtccgcgtccccgtcgcgatcgcgtccccaaggcctcctcctcc

SEQ ID NO: 538235 - DNA, 177 bp, Homo sapiens
gtcatagagtgcaccggttatactgccgaagctgataagacattaaggtttcttttaaaaagtgataacttttgaggtactgatttcacagtatcattaaaatcttaccgttgtacaaaacatttgtttaaagtcattcaacaacacactaatttactaatgataacaggcattgat

SEQ ID NO: 538236 - DNA, 857 bp, Homo sapiens
gaatatgatagtgaaatggattttgggtaggtcggttagggtgtacgtgagaataggggaatagtgaatgaagcctcctatgatggaataagctatgatatggacatagcggaatggatgagctacaatggtagtaccgtgtcgtgtagtacgatgtctacgtgatcgagtttggcgtagttacaatgacagtcattggccacactactggtgaaccaacgaatcgatagaactccgtagggctgcaagacgcgacgtgcaggcaagactccaattgctcatatttggatatgcggagggggatgaacaggtcgtttctggacaggcccgagattaatacaccacgccaacgaacttacaaggacaccaccccgaatcgtcggccctacacaacaagcgctgtccagcaattcaatcagccagcgtcccacaacgcgtgagcgcagcacacaggaaacggaccagggctcgactcagaggcacggaactctggatgaaaaacccaagccgagccctgacagccaacgacagcgagggaacctggctgcacaataagccaccagccctccgcggaccgaccacacaccacgcaccactcgccatcgcgacgagatcctgccacaagacccacgccacgccgaaaaagaaacaacaccagcaggtcggcgacgcagtagaaagcacacgcaaacgccacacgcccaccaagtgcctgcaaccagtgcccaacacgaggtcgcgacacaccccacggcaggcccaaccgccgcacacaccgaccggaggccgccaggcaatgccccccacaacatgcccgccagaccaaaaccgcgaacccccagcgacacaaatcgagg

SEQ ID NO: 538237 - DNA, 312 bp, Homo sapiens
  misc_feature (6)..(6): n is a, c, g, or t
cccttncccccattgggggggtggggggtcggggggggggttttttttacccggctctttttttttaccccccggtttccctgggggcccccccccccttttttttcccccctttaaaggcccgggggccgttcccccccccggtttttttcttgggcccggggggggtttccttttttccccgggggcccctttttccctttgggccttttttggggcccctttttacccgtttttttccaaaaaccgggggggggcggggccgggttttccgggttttttttgccccccgggcccccccccgggccccca

SEQ ID NO: 538238 - DNA, 451 bp, Homo sapiens
  misc_feature (97)..(97): n is a, c, g, or t
  misc_feature (151)..(152): n is a, c, g, or t
  misc_feature (176)..(176): n is a, c, g, or t
  misc_feature (356)..(356): n is a, c, g, or t
  misc_feature (364)..(364): n is a, c, g, or t
cgacacgcgttctgttggtctgtctggaacatcgtgagatgagatctggtcttctgagttgtagtgacacgccagcgaccccactgcggaagtctgnggtggagcctggcgtctactccttcaccacagttggtgaggatccaggagccgnnggttctggaacttgcacctcctgngagaaaatgtgtgagcatgcaggttcctgcactctgcccatttcagctcacatccgaggaaagaactactgcgcctgataaacgctgatgcctctacaccccgagggctggggatcccgcttacaaggctaccagagaagcagggttagagaaagctggtcctggtgcctcctcctcgtncctaccgngccctcggtcttttcctacgggacttctgaaaagctgttctacagtcattggttttctggccgatttccagtctgccacactaggag

SEQ ID NO: 538239 - DNA, 92 bp, Homo sapiens
aagaacggaggcttagggaagaaaaaataagagggtgattcagtagctgggaggagaattgaaaaatcacaccgttcaagtcttcacattat

SEQ ID NO: 538240 - DNA, 196 bp, Homo sapiens
caatgtgttgctgtaccagtgaataaggccgttacggcgcttccctggaccagcgcttcggtatggcgccgaaccaggaaaccaacaccaagctggtcagcgacgtgttgagcgatgccctgacgcgcctgttcaaggacccgagcatcggttcgctactcagctcgcagtaaccgtcaggcgggcgcggagcgcc

SEQ ID NO: 538241 - DNA, 683 bp, Homo sapiens
ctagaggatcccctgatccgggaaggtgctggacaatgttaattttcaaactcctccaggagactatcttcggtgatggcaccatgccatcatccctatatggcatttcaggggattaagtgaacttgtaatgctctgggatagtttattttaaagaaaccaggctgctgggttttaaaaaaaaacaacagggaaaaaatttgatagtaaaagaattctgtgtagtatattttttgttaggtgggcttaaatagaatgtgcttcagaggaagctcaagtggatttctgaaaatctggtgttattaatatggggcaagaagaatgtattaactgagcacactgtttcactagtagatattgagtaactcaattcagttatattttaagataactataatcttattcaatgtgtagcagaggatagagattttggtaatggtgacttcctgttttgtcattagttatcattagctgtatttccatatccttggcagcataaggacaacctataccatatatttaaactttttcatgtcagagacattgaatctctccaacttaaaaaagtcaatatgcaaagtcatctagtatttgaaggcattgtgatgcaaaactgaatctcccgggatacagggtacgagctcaatcgtatcatggctactgttctgtaagattccccaaaa

SEQ ID NO: 538242 - DNA, 113 bp, Homo sapiens
tgctttgcctattctgggtcttttttggctccatggtcattttagaattattttttctattttctgtaaagaatgttacgggtattttgacagggattgaacagcggaccggg

SEQ ID NO: 538243 - DNA, 131 bp, Homo sapiens
cccctcgccctcccgcccctgaaagtttgttatttaaattccccggggggggttttttttttttaaaaaaaatttaaaggggaaccaaaccccaaaaaccccgaacccccgattaagaaggggaatgccca

SEQ ID NO: 538244 - DNA, 1062 bp, Homo sapiens
ctgtgctcgaccagggcggctgttactgacctgggccattagcattggggttccaatcgggtagcacgacttggagctgtcgcagcgtgactactgggcataaactgcccgtgaagaagatcaagtgtgattgtgacagtccaggccttcgtggacacgatcgcccgtcatgacggaagatgctacacgagtacctggtgcgtctcatgggcgtgatcctgcaccagggctgtacattgtcatggagcacgtgagcaagggcaacctggtgaactttcctgcggacccgggctcgagccctcgtgaacactgctcagctcctgcagttttctctgcacgtggccgagggcatggagtacttggagagcaagaagcttgtgcaccgcagacctggccgcccgcaacatcctggtctcagaggacctggtggccataggtcagctgactttggcctggccaaagccgagacggtaaggcgcgtctagactcaagccggctgcccgtcaagtggacggcgcctcgaggctctcaaacacgggaagttcaccagcaacgtcggactgtctggagattcttggggtgactgctctgggaggtcttcatcatatggacgggctccgtaccctaaaatgtcactgaaacgacggtgtcggaggcccgtgcgagaaggcggtaccgcagtggaaccccccgagggctgtaccaggcccacgtgcacgtcctcagtgagcagctgcatgggaggcagagcccgcccgcacggccaacccttcacagcaaactggccgagaagcatggcccgggagcgtacgcaagtgcaaggtgtcacccagcctccgtctcaagggcaggacgccgacaggcgtccaccttcgcccacgaagccaggagcccgtgaccccacccgcgtggggcccttggcccaagaggaccgagagagtggagagtacggcgtggagggcactgaccaggcccaaggagggtccaggagggcaagtatcctccatggtgccaacagcaggggctggcccacgtagggggataacgcccgagccgtgacac

SEQ ID NO: 538245 - DNA, 577 bp, Homo sapiens
atactatttcgatgatactttttcctttgtaccgcgtggcatcaagcatagtcatgataagaaggatttttattaaaaggcagtctgaaaatgggagatggtgtagagaaattcatttgcttcttctcctcaggatgtggaatggaagctttgagggaaggaaaagtaggaaaagagcgggatgggatgggatgggatgggatgggatgggataggaagagaggctggggaatgggcagagaagggggtgctgagtgtgctgtgagatagagcaagatcacaagaaggcctatctgtaagtgcttctaagatacggtgcagaatccgactgcaatgtcgctagtgctgcctatgtagatattcactagaataaaaaattccagctagttcacattatctcgtgcgttctgagggatccactccatgcttgtctgggcttgaccgggggcaaatgtagcacctccacatgtgcttgtatggtccttgaacattagagtgagtagccctgggagatccatggagggctctagaaacacacgtctaccagtgtggctggaggtcctgagctaaaggagaa

SEQ ID NO: 538246 - DNA, 125 bp, Homo sapiens
cccctgccagcagcctgagctcagatgcaggaaggacatcccagaagccatggctcatggggcgctatccaggcattctagccctgcccagacagcagaaccctggtgctggtgggccactagcg

SEQ ID NO: 538247 - DNA, 449 bp, Homo sapiens
  misc_feature (7)..(7): n is a, c, g, or t
  misc_feature (106)..(106): n is a, c, g, or t
  misc_feature (401)..(401): n is a, c, g, or t
  misc_feature (443)..(443): n is a, c, g, or t
aattaanggggaccgtttccaatatggccttggtaaacaacaggcctaattcaaagtctattcaaaaaaggtaaacaaattcattttaactgcccactgatatttnatagacttccctcccaaaatattaaaagctccttaaactgggcagattaagaaatacataaatggcccaggtgtggtgcctgtaatcccggcactttgggaggccaaggtgggaggttcacctgagatcaggagttcaagaccagcctgaccaagattgcaaaaccttgtctccactaaaaatacaaaaattagccggtagtggtgcacatgcctgtacttccagctactcaggaggctaaggctggagaattacttgaatccaggaggcagaggttgcagtgaaccaagaattngccactgcactccagcctaagcaacacagcgagactccatcntaactc

SEQ ID NO: 538248 - DNA, 418 bp, Homo sapiens
tgtgggagtgctcgatgttacccaggacagctccttcaacgagaataaagccttattcgaggatgtgcattgacacgtgtggacactgatcagcgcggcgtgaccaagccctgcagggctctgagcaggcaggcgagtcccaaggagagtcagtgacagcacatggggcaagggagcttggacagaagaccccagagggtgcggcacctgggatgagagccctggactgcacaccacggcagaggggtgcccctgaaggactctgggcatgtgcacatgacaggatctgagggtgtccagactcagatctccactgcctgagggagagtgatcagccagggggagaggccagggactgctacctgcccagaaggcggcagggaggggaagagcagatattgaggtattgggtgtgccc

SEQ ID NO: 538249 - DNA, 1132 bp, Homo sapiens
gcggcagtgcagcccgaagccccgcagtccccgagcacgctgttgccatgcgtcccctgcgcccccgcgcaggctgctgtcgctcctggctgttgctcgtggtgctgcgcggcccggtggaccgccggccgaggccccgaccctggctgcgggtggatggcggtcgcgcgcgcgtgtggcccctcgtgcgtcttctggaggaggcacacggtcgttctgccccctgcttgtcacaccataccaggacttgacctggtctgttgcgttccaggttggggacgctagcacagcctggaccgttcacgcgtattgttgggtccgacccgttcccatcgacctgctgggcgttccagggccagtgttcccgggaagcctgactttgcgcttgtgttggtcaccctatcgttcgagcctacgcaaagggccgttttcccactatgtgagcgtcggcgcacatgaaggcttacaaattcgttcgggacacacgctgtgtgcaccggggggctccccgtgggagaccctcttgttcgcggtgggaggagggcgccacgcctcccattcccccagtgtggctataggcccgccttgaagttgcggtgcttgcgtggccgtccgcggcgccgcgtgtttctgtgcttggaccttttaggggtggcaccgagtgccgaggcggcgtgcttgttttggcatctctgcaatgggaccctctggtgtcgtgccggcgtccctgagttccaggcgaagcgattacaggtacgaggacaaggctttacggagcaacttggtccagcccaattgctcccccgaaggtttggagaaccgttttcgaagagaccgctttacaaaagttgaaagcgccgctgacacggaatcgatcgtgaacattattggagcgagaagcggtcgaatcccagcttgtactgcgaatagccaacagcggtgtattccgcctgggagccttaacttgacggaaatgtccttttccttcaggagagaggggctgttggtgtgccgccccgaaccacagtgcccccctgctcccccgtgcggcgccttccggcaacggaccgccccggtggattcacatatccacttaccatacagtcgccccgaacccgacggtatctgcgcc

SEQ ID NO: 538250 - DNA, 310 bp, Homo sapiens
tctcaaagtgttaggattataggcatgagcactgcgctcggcctggccctgtctttctttcccaaaagtgactgagatctgggatgacagtggaaggaagtttggggttggtcttctgacttccagaggaaaccctcagggtgtaaactcaaaggaaataggagagaatggcttagacccttcaggaggagggagaaaagagaaacaagaagagacagaaggttctaaagctctgataaggaaggaagagggtttccagaataggggccagggtgctactgagaccccatgtcttggtgtccatacatcc

SEQ ID NO: 538251 - DNA, 685 bp, Homo sapiens
agacttgtttacgtgtggcagtgttgtaaaaagaaactaaagatcacattttacctgtatggatggaatatcccttttcttcaagtgcagttgtgatgtgtttgttttttttttttttttggtaattaacatgttctgaaggttaacaatggatatttgaaatggactgtagagcattagttgaagagtaaagcatccagtcccatgtaggtttctcacgattgtgttaagtctccattgtacagcattgaatggcggcagtaacatttccctttctggtgaaggttctaaattcagtatatgacctatttagcaatgccttgtgaaaagggatatggtctccagtggtacacttacattgtctacctaaaacagagatagcctcatcttgtgccatataaggctgtggtaatggacatctagtagactactgcactatgtaaaactggaatctcaaataaaatcatacacactttctaagttctaaatattggtcttctctgaaataatagttgacgcgcaatatttgtacagttttctggcactatcacaatggcttttaagttattactcaagaagcatgttcgtattagagacaaactctgtgtaaccggagggaaaatagcgccagctctgagcaatttatatgaggcaaatgtgctgtctgaagccaatgcttcgtgtg

SEQ ID NO: 538252 - DNA, 397 bp, Homo sapiens
tgggtgctggccttagatgtaggttctgggtagttgatgttgcatagtccagatgaatagaatatataaccttttaacgattggattgtccgcaaacaaaaggggttttcccattgcccacaaacttgtaccatttctctgtgtaattctattcagctacacacagccctccgtcagcgtaattccattcagctacacacagccttccgtcagctacacacagccttccctcagcgtaattccattcagctacacacagccttccctcaggttaattccattcagctacacacagccttccctcaagttaattccattcagctacacccagccttccctcaggttaattccaatcagctacacacagccttccggcaggttaattccatgtagacgc

SEQ ID NO: 538253 - DNA, 854 bp, Homo sapiens
gcccggcgccccgccccagatgctccgatgcccgcccggggagtttcctgcggcggcttcgcgctggaatccagaaggaagctcgcgaaggcctgggcccggcgtgggcgggagcaggcgcctcccctggtgtgcccctgcctgcccacgggctgccacctgtgctgctgctacctgatggctgcctgccccctgtggcccgctgctggcccttccctgccaacctgcctgcctcccgccacctgtgagcctgctgctggtgcctgctgcctgtgagtgatggcctggttttgccccatgtgaagacctgcttgatgtcctgtgggctttcccctgcctgccacggcccctgacggggttgtctgctccttgatgtgtgtgcccgctgacacgcgggcgcgtacctttctcgctggcacggcccccgccggggccacaacctggtgacgagcttgatttgtgcgctccgatttgggtgataattgccctcctgctcgacgccccgagcttgagagtgtgcgacgcgtaacaaggatcccaggacaggtagggggccagccatgaggctggccgtgccatagtgcgcacactacgggacgcggccacacaatgcgcggaagcgatacacatggaggaaaactcgtccagaccgcagatgagataaaaccaacacggaggaggacgaacagaaaggtgaacagttcatcgagaatagctacagatgaatgacgccagtaggcagtggacatgaacaaaaaccgagataaaaaaacgaagaactatacgagcccagggaaaaacatacacctagaacacgcactgcacgaaagactgctaccaccacaaaaccatcg

SEQ ID NO: 538254 - DNA, 390 bp, Homo sapiens
  misc_feature (281)..(281): n is a, c, g, or t
  misc_feature (343)..(343): n is a, c, g, or t
  misc_feature (374)..(374): n is a, c, g, or t
  misc_feature (382)..(382): n is a, c, g, or t
caacctccacctcctgggctcaacctccacttcctgggctcaagtgatcctcctacctcagcctcacgagaagctggtattacaggcacgcaacatcatgcccagttaatttttgtgttttttgtggagatgaggtttcgccatgttgcccaggctggtctcaaactcctgagctcaagcgattcacccgcctcggccttccaaagtgctgggattacagacatgagtcactgcatctggccataatatatacattttttaaggtaccttaaataaaagantaaagggcatcattataaaactttaattttttttaaaccaaaccaaagggggttttaaaggnacatatttttaaatgtgtattttaataggancgttagtnggcaccgt

SEQ ID NO: 538255 - DNA, 876 bp, Homo sapiens
ttataaaagctaggtggtctcttgaatttggaggccctagagatagtcatttggcaagtaaagaccaagggaaccctttctaaaaacgtgggttgaaggacctaaatacctggccataccatagattggggatgatgtagtctgtgctaaatatttgctgaagaagcagtttctcagacacaacatctcagaattttaatttttagaaattcatgggaaatggatttggtaataatcttttgatgttttaaacattgttccctagtcaccatagttaccactgtgtatttctaagtcatttaaacaagccacggtggggcttttttctcctcagtttgaggagacaccatcttgatgtcattactcctgaattattacatttggcgaataacgagggcatttttatttaatcagtttacctaacttcaagctgtgacctatggtatatcttcccaagagtggaaatgctggttcagaatcataccagatggtcagtgaaagctgattgcctaggaaacttttaaaagggatcctttcaaaaggatcacttagcaccacattgttgctttaacttgatgtttgaatttaatactctaaaaatagacagaccgtaatatttacgtcacttaccggcacttcacctaaaggtgctggatttacggatttggctgcagccgtactcccgagatagaggagccgtgcacgctgcttttcaatgcacaaaaggctggccgggcccgtggtgtagtacacaacggtactgggaccgtttacgcacaatgatatagggtgggcccacacaaatcggcgctcgtcagaagaagagagcatctattggcccacgccggggggacctcaaaacaaccgcggcgccgg

SEQ ID NO: 538256 - DNA, 111 bp, Homo sapiens
  misc_feature (56)..(56): n is a, c, g, or t
gaggatcccccgagttatcgccacacacagaaacattccaagcctgtgataaactncttcaccctaaaaccaataaaaactctgagtccataggagcaagcactcctaacc

SEQ ID NO: 538257 - DNA, 1045 bp, Homo sapiens
  misc_feature (108)..(108): n is a, c, g, or t
  misc_feature (131)..(131): n is a, c, g, or t
ttcctgtacatatttagatataagctgctatacgttgaatggacccttttgcttttctgatttgtagttctgacaagtaaatattgcttcagtagagccaccatatgnatctttgctgtaaagtgcaaggnaattttaaattctgggacactgagttagatggtaaatactgacttacgaaagttgaattgggtgaggcgggcaaatcacctgaggtcagcagtttgagactagcctggcaaacatgatgaaaccctgtctctactaaaaatacaaaaaaaaaaaaaaattagccaggcgtgggggtgcacacctgtagtcctagctactggggaggctgaggcaggagaatggcttgaacccaggaggtgggaggtggcagtaagccaagatcacaccacggcactccaaccgggacaacagagcgagactccatctcaaaaaaaaaaaaaattggtgtggcctcatacgaaaggtattgggtttggtgggagagtgtcagactgttccgggaaggtgaaaacacagtttatggtacggggaaagggatttgataatccttagggaatgtcatccaggaggtagagttggatggtgagggttttttaaaaacaacaacaaagagggagagcggatatacttagaaaaggtgtcttttttttttatatccccctttaaaaggtgtgggggctaaatttaaaaaggcggttcatagttcacccctggtgtataaagttaaaacgtggggggaacttgggaagacccggcagcggtttatgcaacaagtgggcgtctcccaggggaccttttttgcacagcgggttccaaaagtaatccggggcagacaaaaaccccgagggccacagaactaccgaattggggaggcggcccatggggcaggtgaacacagcgccccgtttacagcgcagacaagggatgcatgggggcaccgctgggggaaagaccccagaagaccagctgattggtaggacaacgagtacattgtgagtcagacgatacagacaaagtcgacaacgtcatatca

SEQ ID NO: 538258 - DNA, 801 bp, Homo sapiens
  misc_feature (483)..(484): n is a, c, g, or t
  misc_feature (496)..(497): n is a, c, g, or t
  misc_feature (504)..(504): n is a, c, g, or t
  misc_feature (513)..(513): n is a, c, g, or t
  misc_feature (515)..(516): n is a, c, g, or t
  misc_feature (522)..(522): n is a, c, g, or t
  misc_feature (525)..(525): n is a, c, g, or t
  misc_feature (546)..(546): n is a, c, g, or t
  misc_feature (552)..(552): n is a, c, g, or t
  misc_feature (556)..(556): n is a, c, g, or t
  misc_feature (558)..(558): n is a, c, g, or t
  misc_feature (562)..(562): n is a, c, g, or t
  misc_feature (569)..(569): n is a, c, g, or t
  misc_feature (577)..(577): n is a, c, g, or t
  misc_feature (579)..(579): n is a, c, g, or t
  misc_feature (587)..(587): n is a, c, g, or t
  misc_feature (593)..(593): n is a, c, g, or t
  misc_feature (597)..(597): n is a, c, g, or t
  misc_feature (602)..(602): n is a, c, g, or t
  misc_feature (606)..(606): n is a, c, g, or t
  misc_feature (608)..(608): n is a, c, g, or t
  misc_feature (613)..(614): n is a, c, g, or t
  misc_feature (617)..(617): n is a, c, g, or t
  misc_feature (619)..(621): n is a, c, g, or t
  misc_feature (629)..(629): n is a, c, g, or t
ggagacagattcggggtggtcgcttcttctccttggatttgttaaggattccaagtaactcttatttggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctccccaagtagctgggattacaaacataagccaccacgcccagccctcatacctcttttaaaagtcgacctgttttgcagaaagtctgctgtttttgtactaaaggctttggaattgggcatttagctaggaatgcacattctttcacctcattcatactttaagaaccacagaagtgactctgcnnggccagaaggcnnactgggnggtgggtanannaaaagnccntgagattttgcttttcatgancttgcncacngnaacntccgccncccaggtncnggcgattntcctgnctcngcctnccangnagctnngantnnnggcgtgtngcaccacacctggcttaattttggtttttaggaaagaagaagggttaccatattgggcaggctggtttcaactcctgcccccgggatccggccacctaacctcctaggcggggattcaagcttagacccccctgcccgcattcttgaggagttttaggagtttgttaccccc

SEQ ID NO: 538259 - DNA, 458 bp, Homo sapiens
cgagtcaacgtgaactggtgaaagggattgaatcaggactgacaccattattccttttcttactgattggcgctttaattgcgctgtggctggcgactggcgtgattcccacgatgatttgggcgggctttaaaattttaaccccagcatttttcttaccaacagcgtttgtcaccacctcgctggtggtgctttgattggtagtgcctttacaaccttatcgacgattggcgtctcgttgatgggtgttggcacgttgatggggatgaatccagcgattgtggcgggaattgtcttatcaggcgctatttttggtgataagagttcacctttgtcagaatcaacgaatttggccagtgcatttcagggacggatctttttgccacattaaaaatttgatgtggcactgtgccgcttgggcgtgacgtttatcgtagtgtgatttgagtgtgggtacc

SEQ ID NO: 538260 - DNA, 424 bp, Homo sapiens
  misc_feature (10)..(10): n is a, c, g, or t
  misc_feature (23)..(23): n is a, c, g, or t
  misc_feature (38)..(38): n is a, c, g, or t
  misc_feature (48)..(48): n is a, c, g, or t
  misc_feature (64)..(64): n is a, c, g, or t
  misc_feature (68)..(68): n is a, c, g, or t
  misc_feature (70)..(70): n is a, c, g, or t
  misc_feature (87)..(87): n is a, c, g, or t
  misc_feature (104)..(104): n is a, c, g, or t
  misc_feature (121)..(121): n is a, c, g, or t
  misc_feature (125)..(125): n is a, c, g, or t
  misc_feature (131)..(131): n is a, c, g, or t
  misc_feature (137)..(137): n is a, c, g, or t
  misc_feature (139)..(139): n is a, c, g, or t
  misc_feature (143)..(143): n is a, c, g, or t
  misc_feature (174)..(174): n is a, c, g, or t
  misc_feature (177)..(177): n is a, c, g, or t
  misc_feature (179)..(179): n is a, c, g, or t
  misc_feature (183)..(183): n is a, c, g, or t
  misc_feature (200)..(200): n is a, c, g, or t
  misc_feature (208)..(208): n is a, c, g, or t
  misc_feature (216)..(216): n is a, c, g, or t
  misc_feature (218)..(218): n is a, c, g, or t
  misc_feature (233)..(233): n is a, c, g, or t
  misc_feature (236)..(236): n is a, c, g, or t
  misc_feature (242)..(242): n is a, c, g, or t
  misc_feature (253)..(253): n is a, c, g, or t
  misc_feature (288)..(288): n is a, c, g, or t
  misc_feature (290)..(290): n is a, c, g, or t
  misc_feature (320)..(320): n is a, c, g, or t
  misc_feature (340)..(340): n is a, c, g, or t
  misc_feature (353)..(353): n is a, c, g, or t
  misc_feature (363)..(363): n is a, c, g, or t
  misc_feature (365)..(365): n is a, c, g, or t
  misc_feature (370)..(370): n is a, c, g, or t
  misc_feature (379)..(379): n is a, c, g, or t
  misc_feature (383)..(383): n is a, c, g, or t
  misc_feature (412)..(412): n is a, c, g, or t
  misc_feature (421)..(421): n is a, c, g, or t
gccgtatgcncggctctgtggantgcacctagggttanaggcactgtncccccaaccccctgcncctntngactctacttctgtttncagccccatttggcctnctgggggaaaagacccnccangagtcnctagangncatncctaactggcaaggccccctgcagaacctgnatnanatanaagcagtgggcaccaantccacacngcactatntntggagcagcctggangcntctganagatggtaatngtgagccacacaacaccccccacagcacccaggancntacaactggagacctcctagctatcccctnaaaacgataaggggcctaangatgctcactaangacagcattnanttttnttctgcccntatntttaccaggctgcttaaaattgacagaancaacgtgtncga

SEQ ID NO: 538261 - DNA, 925 bp, Homo sapiens
  misc_feature (573)..(573): n is a, c, g, or t
  misc_feature (625)..(625): n is a, c, g, or t
  misc_feature (634)..(634): n is a, c, g, or t
gatgggcaacatccgtggagtggtgcgtttccacggcagactgtggtggggccatcgcatcccagacctactttgtcactgtcagtgacccagcggtgccccctgcgggaggtacccgtgtctgtggcgggataagctggggtgagtggacagcgatagtgagagcggaggccctgggcacgagaggcggatctaaggtagttcggagatgtccccgtgaacgacgatctagtcttccatgcaaagatgaggatgtattggctacctggttctcctctggcgctcttccgccttatccatttggggctggcccaatcagtgcatgaatacctggagtgtgttctagcccgggagcatctgcgtggtagtaccggatcgtgcacagtcctgctctcttctggtgctgtgcccggtgtggctcatgctgggcctgtctgctcacgggcggggtgccctttagaagaggatctagctccagtgccatacgtgcagagagtgacttcgacgcggcggaaggatgagtcaagatctactaggctgatgtcttcgatccccctggacgctcagtcgtantggaagtctccctgcatggtcgctccacaaagcgactcttgcgtgagctagnctatcctgngatcctctagcgagcgatgtgacgagaggttcccataggaagggtcgagacatagcttgaacttctcgaccggggcattccctgaattgtgtgatagccgattgctctccgagtgaggactctatgtgcctacggtgctaccagcggatccgtgagcatctaaccctggattgttgaaccgggaatactccgggttagccgctcatgttctgcgacccagctctggaattgccacaaagttttgcccttcgtggccttgggaaggggttaagggccctcaaccaaccttcc

SEQ ID NO: 538262 - DNA, 244 bp, Homo sapiens
accgtaatatgtacagagtagggcctataaactggatgaccactgtcaaatgaaattaaggctgttgaggcagaaatgatttgataaaagtttattggaagccaaatgtgaggatgaacccaggaaaacacaccaacaaagttgagagtgttctggagtctgttacaagttggaaagttagaagacaggagggggactcttcatacaggagttgtcctttttcactggagggtacaatacaaag

SEQ ID NO: 538263 - DNA, 260 bp, Homo sapiens
  misc_feature (10)..(10): n is a, c, g, or t
  misc_feature (25)..(25): n is a, c, g, or t
  misc_feature (102)..(102): n is a, c, g, or t
  misc_feature (110)..(110): n is a, c, g, or t
  misc_feature (207)..(207): n is a, c, g, or t
  misc_feature (212)..(212): n is a, c, g, or t
atgaacccgnaaacctggctgctgnacgaccacgatgaacggctgcatgagtctgtgttcctccgtggggtggaccatatatacacgcctgctgcctgcccntgccagtntgcctgccctgcccagtgacagctgagccctggaactcctaaaccttttgccctggggcttccatcccaaccagtgccaaggacctcctcttccccnctccnaataataaagtctatggacagggctgtagtagaagtactaacacaaaa

SEQ ID NO: 538264 - DNA, 173 bp, Homo sapiens
  misc_feature (16)..(16): n is a, c, g, or t
  misc_feature (33)..(33): n is a, c, g, or t
  misc_feature (98)..(98): n is a, c, g, or t
  misc_feature (100)..(100): n is a, c, g, or t
  misc_feature (140)..(140): n is a, c, g, or t
ggaccggaaaggtagntgtactgagagcacatncgccgcacaagtaacctctgggaatggggttggagcagccctgccctcgctgtgaacttcctgtngntgctggttcacatgatgctcttatagttggtaagttttangaagtgtttgctgaggaattctgtcatctttaa

SEQ ID NO: 538265 - DNA, 698 bp, Homo sapiens
acgcctgcggggatccccgccagcccacggggggacaccccaccgaaacggggggttggcgcccagcaaacccccgctggtcacggtgcccagcacttttctcagctcttcgtctctggcacctgactaacgccttccctcaccggcgctctttaaaaccccggcaaagggtttcccctcccccagccccgctaacgagtgccctcgggccgaccccctcctggtcaagtctatcacagcaggggtccaggcctagtccggtcaccacaccctgcgcctcattgggcggaatgtttccccccctcggcagcccgaaatccggtgccaactgcaccagtctctataggcccccctcggcctccctccccagggctaatttttccgcccaacaccccttcgcggcgtggcttacaacgacttatgatctctggtgccccacacatggagctccatgtcaggaggggctaagactgagccgcgcccacggtggtgtccctttgtcgtccccccaggaatccgccctcgtgctgccccctgccatctcccccgcttgtggccccctggaggtgagttgcccacggctcctttttcgcgccgctccccctgagagcagtgatatgtgaccccccctgccccaaggcccaccaccgcacccacccccgcccaggggcccccaataatattagggaaacacatac

SEQ ID NO: 538266 - DNA, 555 bp, Homo sapiens
tcagtgagccactgtgccccaccccaacatgttatgtgtgttttttgagactgtcttgctctgtcatccaggctggagtgcagtggtacactcttggcttactgcagcctctgcctcccaggctgaggcagaagaatcgcttgaacctgggaggtggaggttgcagtgagctgatatggcgccattgcactgcgccattgcacttcaccctgggcaacagagcaagactccatctcaaaaaaaaaaagctgtagataatgggggtcccactatggtgctcaagctggtctgaaactcctggggctcaagtgatggtctggcctgggcctccgaacacttctgcctgggcctcccaaagtgtgggaattgacaggcgtgagctgccatgcccagcctcagcatttaatggtagatattagggggtatatgtgcagttaggtactggggttcatggtatgatgctgaggtaggggtaggattatccccatcacccaggtagtgggcatagtacccaatagttattaaaccttggccccaattttccatcttcccaca

SEQ ID NO: 538267 - DNA, 133 bp, Homo sapiens
gcctcacagcatacacgatgttgatatttcaggttgatatcacgctcccgtgccagctcacgaagaatgatgctgtgctgtgtgctggtcccatgcaactactacacgctagggcactgctcagtgactcagc

SEQ ID NO: 538268 - DNA, 1175 bp, Homo sapiens
ggacaggtgaagtgaccagagagcaaaaggcaaaggggtgggggctgggtgcagtggctcacacctgtattcccaacacttttggaggctgaggttggaggattgcttgagcccaggaattcgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaaaattgggcaaaggggagacaaagagcccagcctgcttgttggctagccaaagtggtcctttcccttccaggtttgggcctggctcttaaaaggcaaaggctcctggcagtggtacattcctgggcattggtggtgggctacctggggttttaaacccaaaattcagaaggtcccggatcaaaggggcactggctgaggttcagcctcttctcttctggcgccagggaggcagcagctctgaattgggcccctgagcgctgccagggcccttggtccctgggggcgcatgtttacaaacagtgcagttctgggggcccgaggtaagcaggctgggtctcattggcgaacggccaggatctggggctctaggacttggggaaattgggccgtgtgccagaaggctggcaggcttttcctatgggactctcccgtgcccttgttcctgttgggccgttgttccccagtggcagggataaacttgaacgtctgtgaagaaaaaccctttccaggtgggggggcagtggtgcccaagtgtccccgttgtcaccacaaagctgttatgccgcaaagacccccgttgtaaacgcctgtgacacgatgacgtctctgagcgacccttgggtggcccccccaccggtggacgccgtatatgagtgggcgacaccaacgcaggggggaaaggaaggtcaccactcaccacaaatcacccgagagacgtacgaatcacttagcaggacagcgcgcttagaaaagggaggcagcgagaagagacacgacgaatcagctagatgcgaagacgaaacaatcgatgatcttgcgaagaagacgataaac

SEQ ID NO: 538269 - DNA, 493 bp, Homo sapiens
gttgtgaaccaattttttggaccggtcgcgttttcaaaaagggctctctcttcttgcctatataagacgccatgataggttacagctattgatgtaactgtagctgcaattttttgtgcaggactgagaaacacagtgcattatttattgcggaatcatttgcctttgtcctttaaaattaaactaacttgtctgtttatttaacacaacaattgaattgccttgaaagaaagtttgccagttgcggcttttttctcaatttcaatcaatttggttgcacagttgcattcttgtttctcctcacggaatttgttattacttgctttgcaatttttcttatgtctatcttcaacaattttctaaaaaacgtttgggcaaggggttggttttttcaccttggtggacattgttaaacaatttttaacggccttttttggcctttttaaaaattaaggttaaaacaaattaaagtttggagcccaatcctttgcag

SEQ ID NO: 538270 - DNA, 677 bp, Homo sapiens
gcacgaggtttttctaatacctgcacatacccttgatggttaaaagaaaattaccataaaataaagtggtcattttcaaaaaaaaaaagaaaacactattgccatataacttaaaataaaaaaataaaaactgaataagcaccaaaaacttggagagaaccatctgctgttaagacttctatcctattccttgttaaaggacacaccccatggcatttactacttggtgtgtataactatatccgttgcccatccaagtactgagagcctactttggatgtcagcaacactgagtccaggctcttgtgtgaacaccagagtctctccatagctccttacatagctaaaacatgaacagcaaggactgcacgcaaagtgattgaaggccagctgaggagaagttgctcgtgaatatccttttcttcatatatagcatatgaacaccttgaactatgcttgagcacttaggtgacaagaacttacgcacctgctgaggccctcgatatgttaaatagtaaccacttctagtgccagaaatcctaacgtatcatgaatgaagacctgtttactataactgggacctattgggcctagtgttgactatggaactaaatggacaaccatttaccgtaagtttaaacttgataccaaaatgtggtttaggataaaaaatcact

SEQ ID NO: 538271 - DNA, 282 bp, Homo sapiens
attttgggggacaaggttttgggggttttttttccccttttggaaccgccctattgaaaagtaagggcccttccattccaggccccctcaaattggacttgtttcctgccaaatttgggggatcatttgtattttaactttgtaatctaaggctctggactgttgaaaggctctcaattttgtggggtctccttagtatgtatgtgacttttcatgttgcaaaatcccccgatgggatggccccacttttgcttttaataaaaaatttgaatgagtaagaga

SEQ ID NO: 538272 - DNA, 155 bp, Homo sapiens
tggccccagggattaaagtttccctgttcccccctaagtttagaaggggaaaaaaaccccggttttaaatgggggaaacaattgggttttgtaaaaacttgtaaggggggaaaacctttttgttttttttttaaaaaaaaaaaccccccccggga

SEQ ID NO: 538273 - DNA, 890 bp, Homo sapiens
gagaccgcgtccgccccgcgagcacagagcctcgcctttgccgatccggcgtgccgtccacacccgccgaccagctcaccatggcagtgatgagtatcgccgcgcgtcgtcgctcgagcaacggctccggcactgtgcaaggccggcttcgcgggcgacgatgccccccgggccgtcttcccctccatcgtggtggcgccccaggcaccagggcgtgactggtgggcatgggtcatgaaggattcctatgtgggcgacgatggtcccatgatgtcatacgagtaggcatcctcagccctgaagtaccccagtctgagcacggtcgatcgtcaccaactgggacgacagtggaggaaaatctggcaccataccttctacaatgagctgcgcgtggctcccgaggagcaccccgtgctgctgaaccgaggcccccctgaagccccaaggccaaccggcgaggaagatgactccagagtcatgtttgagagcttctaagatgcccagccatgtactgttgctatccatggctgtgctatcgcctgtacgcctctggccgtaccactggcttcgtgatggactccgtgtgacggggtcaacccgacactgtgcccatctacgaggggtatgccctctccccattgtccatcctgcgtctggacctgtctgtccgggaccttgactgactacctcagtgaagatcctcaccgagcgcggctacggcttcaccaacacggcgatgcgggaaactcgtgggtgaccttaaggagaagctgtgctacagtcgccctggtacttacgatccaggagatggccaccggtgcttccagatcctcactgaagaaagagctacgagctgcctgagggcaggtcatcaccattggcaatgcacg

SEQ ID NO: 538274 - DNA, 840 bp, Homo sapiens
ctttaccagcaactggcctggtctggctcgggccctgctttgcctcctgttcagctgcggcgtgcagctgccatgctgactcactgatgtccacgcagactcgcaggagctggcagcatgggctccccagggctactgacaggctgggggcttctggattataagacggagaatgtatgtgatgaccaggaactaggctgggtgggcgccctgcaagaggcgtgctgctaggtatggggatccgtcggtcatatgtcggtagcggtgggctctccgtcgccgaaaacaaggctacgcaggcagcgggaccgtggaatcgccagttttcctatcatcaccaagacttcaaacggcggtttcgcgtcacgtcagatcaagggacgcgttggaaaccggctgtaggtgatgttggcctgaccttcagtgaatgccaccgtcacgtcacccgtccagtcccacttgtgctaactagcttggggtcgacggatggactgtgccccgaagggggcagggaaggtacacgagcagactcacgtgtgttagaaagcatggccagtcgtgtggttggttcacgtaggggaccctagcaggacctgtgcagatctgggagtatggatgcccaggtggcagagtggacgtatgtgccctctgagggccccttgcttggccccagggcccaggaactttcacaagctgttcatcgaaacaccacagtcaccttcaggcaagtacaggcttcgtctaaggtccgatgccttgtgagcacgctgggagcccaccgtattctgtagatgcaactggcgtgtatgaagccacaaattcagccgcctacgtgtccct

SEQ ID NO: 538275 - DNA, 1120 bp, Homo sapiens
  misc_feature (79)..(80): n is a, c, g, or t
  misc_feature (84)..(84): n is a, c, g, or t
  misc_feature (97)..(97): n is a, c, g, or t
cctgctatctgtttctctccgtgctgttctctcccgatgatgcgcctgccctgctctcactgtcctctctccccctcgnnctcncttcggccccccnctttcacgttcactctgtctctcccactatctctgcccccctctatccttgatacaacagctgacctcatttcccgataccttttcccccccgaagaagtgacaacgatctggcccgccccagtcccgaagacaagcccggatcctacccatggacatattacagacgagtgctccatcttctgggaatcgacgtctcaagaggcttctccatggtggtacaggatggtatacgtgacaggacctgaagtgtagtgaaccagataggcacatgtgccggcatcctgctagactctagagcaacccaaatattcatctacacgagactctagtagtgcgcctgggtccagattacttcactaccacaccctaccctatctcacctgcccagccctgtgctggggcccatgcaaataggaaatgatgggccagattgtctgcaaataaaccactaagctggtcttgcggcccaagtaaaaaaaacaaacaaccagaacaaagaacaaaccacaaaaaaacacaagaaacagcgcgacgcaacacaacacaacaacaaacagacaccgaggaaacaggcgccgcaccacacaccaacaaccacacacacaaaacaaagacaggccaaagaagagggccagccaaccaaagacaagagcaacacataccaaaaccaacgacaaagaggaggcaagcaccacgccacgcggaaccgggcaaacaacgccgccaccccgcccgcctaacgacaacgaccacaaacccggccggacaaataacagccagcacacacaaagaggaagacgaatacaccaaacaggagagaatcagaaaccgcaccacgacgaagcaccacaggaagcccaggaacgacagcacatacgcgcagccaacgcagcggacatacatgaaagacacgaaaaacaaccacggaaggaaccaacaacacacagcccaagaccggagcgagaacacccgacagcactcacgagcagggacacgaaagacgcgaagacaaaaacaacgg

SEQ ID NO: 538276 - DNA, 463 bp, Homo sapiens
tttttttttctttctttccctctcttttttagacagagtctcgctctgtcacccaggccggagtgcagtggcgcaatctcagttcactgcaacctcctccacctgggttgaagtgattctcctgcctcagcctcccaagtagctgggattacaggcacccacaaccacgcctggctaatttttgtatttttagtagagatggggtttcaccatgttggccaggctggtcttgaactcctgacctcaagtgatccacccgccttagcatccccaagttctgagaattaagggacaggagccaccatggcccagcctcttttccttataattttcttaataacattttctttcctctagcttactttattgtaagaatacagtatataatacacgcaacatgaaaaatgtgtgttaattgactgtttatcttattggtaaggctgcagtcaacagtcaaccgata

SEQ ID NO: 538277 - DNA, 1276 bp, Homo sapiens
ccttctatatccagctgcaggctgatgtattccattccattgtctagctggctatgagaagcccgagaaatcagacccatccgagctttcatggccaacagtcacctgaggtcagtgctcatcacgctggcacgtagagtaactggtgtgttaacatgcgcggagcaagcagacgtgatgtggagagccatggcgacatgcgccttgaacctggtggacaatcccagcggatctcccagatgcgatgagagaatatagcttcaaagtccccagctatacgcacgagggagagaacacaaatcctctaagcagttggctgccatccacgtctagccaggcctccagccaacgactctccgcatgactcttgctgaagctacgcaggcgccacacgctgactgaacgacttgcctgacggttctgctccattgaggcgcacggaacgtggcaaccaaacagagtctatggcccgcaaacctctcactcccccctctctggccagactacactccccttacacttccgcagctgccaccacgcactactactcgcaaccacgctggccactcgcattgcaaccccacacacctagtgcccactctagtcacttctctggctcaactgccccgtatcccacaaaggcccatcatcatgccagcacacattcgacctcaaatctactcgactgcctaccacttcggcccgtcaccactacctctctcgcactcaactcctccctcataccatacggcaatccgacacacccacctacaaccacccccctccatcactccacagcattctcttccctacttcatcatccacgtctcacacttcaccacttactaacactcacattattcattcccaacccacatacatatgccttaccttctcaatcgatggaacatcagacacaacactctcaccctatccactcctttacccaacacagacttccccccgcgcataaactacaacgtagccacaagcaccacaccacaccccaaccccatatgagaccaacataccatacctccttgatccctcacccaattcccatcatacctcccacatcgtcccttccaactacatccaagtcgtcactgcataaatataccatcatatccatatcccctattcttccctcttcaacagtacaccaaccacccaccatcctaccacaatacctccacaacaccccatcttcacttccaaactacttcttcacttacactcttccatacacctcttccacacccagcgctcagaccat

SEQ ID NO: 538278 - DNA, 145 bp, Homo sapiens
gattagtctactgcatgcgcttctagtaatctccttttacatttatactgctacaaagccttctcataattattcttagaagactagtcttgcgtggtatagggtgatatagtggtgttatagggtggtataggggtaccgagac

SEQ ID NO: 538279 - DNA, 387 bp, Homo sapiens
  misc_feature (20)..(20): n is a, c, g, or t
  misc_feature (66)..(66): n is a, c, g, or t
  misc_feature (81)..(81): n is a, c, g, or t
  misc_feature (84)..(84): n is a, c, g, or t
  misc_feature (110)..(110): n is a, c, g, or t
  misc_feature (125)..(125): n is a, c, g, or t
  misc_feature (152)..(152): n is a, c, g, or t
  misc_feature (163)..(163): n is a, c, g, or t
  misc_feature (180)..(180): n is a, c, g, or t
  misc_feature (191)..(191): n is a, c, g, or t
  misc_feature (202)..(202): n is a, c, g, or t
  misc_feature (209)..(209): n is a, c, g, or t
  misc_feature (224)..(224): n is a, c, g, or t
  misc_feature (239)..(239): n is a, c, g, or t
  misc_feature (248)..(248): n is a, c, g, or t
  misc_feature (291)..(291): n is a, c, g, or t
  misc_feature (382)..(382): n is a, c, g, or t
tgagaggagcgtggctgtcncctctctccgccatggcgtgtgcccgcccactgatatcggtgtacnccgaaaagggggagncanctggcaaaaatgtcactttgcctgcngtattcaaggctccnatacgaccagatatagtgaactttgtncacaccaactngcgcaaaaacaacaganagccctatgcngtcagtcaatnagcaggncatcagactagtgcngagtcttggggtacnggcagagcngtggctcgaatacccagagttcgaggtggtgggactcaccgcnctggccagggtgcttttggaaacatgtctcgtggaggccgaatgtatgcaccaaccaaaacctggcgccgttggcatcgtagagtgaacanaaccc

SEQ ID NO: 538280 - DNA, 1155 bp, Homo sapiens
gctgcgcagagcgagggcagccatggtcttaatcccgcgtgaatgattatgagctcgtgaggcggcttactgaccccatacgcttatcccagcgagctactgatatgcacgagcaggagatccaacagcaggaccgtgcctgtaatgaactgtcaggtatgaactagcgaaacctaatcaggtggatcccgtgaggtggatcgaagaaacgttcgatcgcagctattttccgacgaagaaccggtcgtcagactttgactttgaccgagaaacgtgtattggagctatcaggcccacgtcgctgtcgtcctagctgactgtccatctgactcacgacacggtgtactgcacgatccaagggacgagtctactgtagtacacaggctaggaactctaagcctggcacctgggacacagcatttgctttccacatgcaaattacgaccatttggggcctcggaggtcttgcacatgcccaattggccttcccagccaagtgcgctatcgtgcccaacgtggcacatgcgcctggctccatgtctccgtggcactcttctctgactgagcgacaacaggcacacactgtaatcagcgtaagcaagggggcatcaattacttattgtctcccaaagagctttcaaggctggggcagtgggaacccgttattcgccttgtgggcgcacgcccattggacggggcatctttgggaacattccccttaagttttgaaccaaaatcttaacctgtgtcccacatcttcgctccttttccagaatcgttaaccgagttttcctataaaaacgtggggccccgggaacaattgacacggctccccctttggggcgactaccgccgctcgccgttttgggtgaaagcgctttaaatttctctcagaaaggctccaagggactgggggccacatccctcgacggcgcgcagcttaatctgctaaacttcccgggaaacttggcaaggcgactgttcccaaattatccttttatacgccccagggcttgaatcccccacggtattccccgcttcgttccatgggcttcccaaggtgttaacacctcgcgagcgctgtggcttcaccaagagggaacccgtggggagcgccaacaaggtacagcacagctagtcctagggacaacgtgc

SEQ ID NO: 538281 - DNA, 126 bp, Homo sapiens
tcaggcactgattgcctacaacgaggtctgttagacatggttaacgcatttgatcactacaggtacttgtatgtacctagagaaggaacccatcctgggtgttggtgtgagttggtatatgctact

SEQ ID NO: 538282 - DNA, 348 bp, Homo sapiens
tttcagtttgctttctagtgagagacgtacaaccctctctttcacatggacactcagaggcctttgcagggttattaactggccaaactttcacactagtgggctcaaaggaatacaggggcccaatggagacggaggacgacagggaatggcctgtaggtggagcagtcagaacacacaaggcatttatagcttaagtttgcaatttttccaacggcacctgctcacttagtgtctctggtcacatttagggaattctcacaatgtttcaaactttgtcactatgattgtatctgtgatggcactccctgatcactgatcttgaatgtaactatagtaattgtttag

SEQ ID NO: 538283 - DNA, 871 bp, Homo sapiens
gttacagggtgatgataatctccatagattgattagaagtggcttgaaaaaggcaagatgactcttgatgacatggatgaaaatctacgaaatcagccctcgagttattcaatgatagtggatatactaaattatttccctagaaaggaagatgagaggagtggagtgtggtatggcgagaacggaggtgctatttcacagtcttttccagttaataatgggagcactgaaggtacagatgcatgagcagattatgcttgggtcctaatgcagggtatagggctggtagaagttgacgacagcaatgttgatctggcgagacaagtgtggttaagaacatcatgtaagaggttttgaacagctgatgactgtataagacaaagccaagatgcaaaattaggcttgatcggcacttttcgggataactatgaacaagtatgggattgtaatccggatggcgtttcggtacttagggtgaaatatttagataccttttggaacacttaagagtttcttgagacaatgactttgtaaggatttggtacctatgctatcattgcgtttatgactgttacagtgtcggtcactgagtccttggatttcgcgtgtgtgtcacctgcaattggttccggtctgtgcacatctctggtggtaatcgtacagtctcgggtcagctgtttacttcaggttgaaggctttgtgctagcgggaggatccattgcgggcgtccaccttcacgttctttggagcccgttgtttggctggcccgggcgggaacacgcggagtgcgtgctgcgtacaccctaagcgtttcggtgttggccgggtcccaccgttcttctccccgggtgcgctgtggtgcacctcgact

SEQ ID NO: 538284 - DNA, 374 bp, Homo sapiens
actgttttattttgtatcaaagaaaaaattttttgacacagttatcttgcttgtgttgcccagactgaattgcagtggcaaggatcacggtctcactgcagcttccaactcctgggctcaagtgatcttcctgtcacatgagtctcccaagtagttggaacacaggtgccagccaccacacctggctaatttggtttggttttgtttttttagagatgggctcttgctatgttgcctatactggtctcgaactgctggcctcaggcaatcttcccccctcggcctcccaaagtgctgggattacaggtgtgagccactgcaccctgcctcagtacctccattcttcccacacaccctcctcatgtgctccttcc

SEQ ID NO: 538285 - DNA, 395 bp, Homo sapiens
ctaatgctcgagatggatcggtgatctaaatccactccttcatagtaccggatctctctttcaccctccccttcgtgttcccccaatgttataaggtaggatggttggtgttctgccatggagacaagggctaacatagatttaagtgaatacattaacggtgctaaaaatgagaattctaacccaagacatgacattcttagctgtcacttaactattaaggccttttccacacgcattaatagtcccatttttctcttgcgtatatgtagcttagcccatggtcttcttggcacatgggtggacacggatctgcggggctctgccttaaacacacattgcagcttcaacttttctctttagtgttctgttcgaaactaatacttaccgagtca

SEQ ID NO: 538286 - DNA, 236 bp, Homo sapiens
ttccttccccttcacccgttcccccaagttttcacccctttttttccccttcccccccaaaccctttttttttttgggccctttcccccttcccctttttttttcccaaacccccttgggttggggcccgggttgggtgggccggccccccccccttcccctttcccccccgggtttgggtgggaaaccttttttttttggggttttttttttttgggtaaaaaaggtttttttta

SEQ ID NO: 538287 - DNA, 670 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctcttcccctgggccactcccgggggtgagggggttaccccttcccagtgttttttattcctgtggggctcaccccaaagtatttagcgcccacccactttcagaatcggagatgcttagcgagcgcgcccgcaatcagagctctacctgggacaacacgccccaaagggagctacttcaacaatcccatggcgccggactaccg

SEQ ID NO: 538288 - DNA, 155 bp, Homo sapiens
ctgtttcttattactccagaggcataatatttaggtgctgtctacataaaataaattaggaatggtatgcttccagcttgaaaatgaacaaataaatttacatctagtactccatagtatgttggctgtatgtttcacataggcaaactgaagat

SEQ ID NO: 538289 - DNA, 727 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctttccccctcgacccactcccgcgcgctgaccctcgccaccctccccccccctcccctcacatctgctgcccaccccttcccctccacttcccctccccttgccctcctatctccatctccccccccaccctctctcccccacccacctcacttccctcccaccctccctctcttattccctcttcctctccctccccctatcttctactcctctccctctcctctctccctctcattcctcctcccctatctcaccctcc

SEQ ID NO: 538290 - DNA, 370 bp, Homo sapiens
aaagctagatgacggtcgaaccatacatctatgagggggccatcgcgtcctatcgtctggcgcttcacatgtcactctgcggccagttacaccatggtcgctggtcaaacccctagtgttcacagattccatcacctaggagaatctctccgtcctagagtctggagaggctcccttttgtgattccttcccctcaagtaggctctctccttcccctgggccactcccgggggtgagggggttaccccttcccagtgttttttattcctgtggggctcaccccaaagtattaaaagtagctttgtaattcaaaaaaaaaaataatgacattaccctcggggggggcccggaacccaatttccccttttgg

SEQ ID NO: 538291 - DNA, 219 bp, Homo sapiens
cacgaggggttccctaaccactgaaataaagcctctgcggttcaaaaccattgcaaaatggcccagggattccataaccagggccaaaaacgagagggagctcacaatcagggtataaagacagtcggggctcaggtcataatcgcaactaggagtcccacccaaggcaaaaaacgagagggagctcccatccagtttaagaaggtatattcggttgct

SEQ ID NO: 538292 - DNA, 883 bp, Homo sapiens
  misc_feature (26)..(26): n is a, c, g, or t
  misc_feature (92)..(92): n is a, c, g, or t
  misc_feature (125)..(125): n is a, c, g, or t
  misc_feature (265)..(265): n is a, c, g, or t
  misc_feature (312)..(312): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (341)..(341): n is a, c, g, or t
  misc_feature (379)..(379): n is a, c, g, or t
  misc_feature (387)..(387): n is a, c, g, or t
  misc_feature (390)..(390): n is a, c, g, or t
  misc_feature (395)..(395): n is a, c, g, or t
  misc_feature (399)..(399): n is a, c, g, or t
  misc_feature (401)..(401): n is a, c, g, or t
  misc_feature (403)..(404): n is a, c, g, or t
  misc_feature (447)..(447): n is a, c, g, or t
  misc_feature (475)..(475): n is a, c, g, or t
  misc_feature (479)..(479): n is a, c, g, or t
  misc_feature (581)..(581): n is a, c, g, or t
  misc_feature (743)..(743): n is a, c, g, or t
  misc_feature (874)..(874): n is a, c, g, or t
gattatggctttacttcattatacangtcttgcagctgtcagaactgacacacacatttcccccaagagttagaacccttttcattagcagngatgaattgaaatgtcatgtctgagtgcaattnctgctccccactcccaccctcacaaaatcccaaaagtgaaaataaatcaataaaatccccatgatttactaatagtcatccctcctataacctttctaactagtcagtctgcagtggatgatataccaaggtgggaagcngctggtcctatcatgtagcattcctgtgcattgtgagcctgaggggncagcagcatgggagcgagantnctgnatnagacgtagtatataattaccttacttcatacttgcccnctccctanatnagacncctntntnntgttacatggaaaatactagaggagatgctaagagtggttttngtctacaattggaaatgcctgagacttnttanattccaaggaaggggtgagataaggggcaccaaagagaaagagcaggttagacagggatgctcaacactcttgtcaattccagtttaatgctatttaattcnaaaccatcttcttaatcacaaccaccttcatgcctaacgccctattgttcctaggttgaggtgctctgtctatatttctgggttgttgtctactgccacccctgggtggtactgtgatgtctgagtgagattgcaaccgggatgggagaaaagaagtgtganacagggaagatcaggggccacaatgcatcaattacagtgggtctcttttggtccccaggtatggtccactaccacaagtcccctttccctacctgtcttgtgcaaatgtcaaaaatagaatctctgcccanagagaaggg

SEQ ID NO: 538293 - DNA, 628 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctcttcccctgggccactcccgggggtgagggggttaccccttcccagtgttttttattcctgtggggctcaccccaaagtattaaaagtagctttgtaattcaaaaaaaaaaataatgacattaccctcggggggggcccggaacccaatttccccttttgg

SEQ ID NO: 538294 - DNA, 784 bp, Homo sapiens
attaatgaaggacaaaatgtctcttaacttgtgagatcagtggcgagccatcccctgaaatcgaatggtttaaaaacaactgccaatttctatttcttcaagtgtcagcataaggcgtccagaaatgtatactcccttgaaatccgaagatgcatcagtcagcgatagtggcacagtacacaatgtaaggccaaaaatttcggtgtccagtgttcagtgttacagttgccttaatggtcctgtcgaatgccgctaaagattggaagctcttccatctgatatcagcattgactgagggcaaagttctaacagtagcctgtagcttcatgggtgtgagcctaccccagaagtaacatgtgtcctgtggtgcaagaaaaatccaccgagtcaagaacaggggagtggttcccacattgaaaatcgacagatgaccctgacatgcctgatcatcagtggacgtacagaaacacagatggtgaacttcatacccttgagttaagggactgaagttgtgcatctgacctctgtcacttgtggactatacattatgctgatccatttaaagaggggcctgtggccctttaatagtctaacactcattcttaactttttcgcaaaactgtttcaccagcgggaataactcctttcctgaactggcacatattgtcccggcaataagaatgtccttttggtattcaccctaacttgcgtcaaagtccaaaagatattccatccaacctttctgacatggtgccccagaatttactacattgggacgtgacat

SEQ ID NO: 538295 - DNA, 685 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttacccacttccagggctttatatttctggggggccaccccaaagactaaaagccgctttgcaacccacaaacagaaaaacccactaccagtgcacccctcggggccgcctccggccaaccgactttagactccaccaagcttacccccccgccccaattacagcctaactcggccaatcccccca

SEQ ID NO: 538296 - DNA, 666 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccctgggccactcccgggggtgagggggttaccccttcccagtgttttttattcctgtggggctcaccccaaagtattaaaagtagctttgtaattcaaaaaaaaaaataatgacattaccctcggggggggcccggaacccaatttccccttttgg

SEQ ID NO: 538297 - DNA, 612 bp, Homo sapiens
  misc_feature (58)..(58): n is a, c, g, or t
  misc_feature (63)..(63): n is a, c, g, or t
cattatggccgggggaggaacgactgagctacgttgtcagaaggcggcggtgacctgnaacgnccgtgagaacgaggggacgtaacggaggcaggttggagccgctgccgtcgccatgacccgcggtaaccagcgtgagctcgcccgccagaagaatatgaaaaagcagagcgactcggttaagggaaagcgccgagatgacgggctttctgctgccgcccgcaagcagagggactcggagatcatgcagcagaagcagaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctctccccctgggccactcccgggggtgagggggttaccccttcccctgggccactcccgggggtgagggggttaccccttcccagtgttttttattcctgtggggctcaccccaaagtattaaaagtagctttgtaattcaaaaaaaaaaataatgacattaccctcggggggggcccggaacccaatttccccttttgg

SEQ ID NO: 538298 - DNA, 958 bp, Homo sapiens
  misc_feature (46)..(46): n is a, c, g, or t
  misc_feature (91)..(91): n is a, c, g, or t
  misc_feature (117)..(117): n is a, c, g, or t
  misc_feature (207)..(207): n is a, c, g, or t
  misc_feature (211)..(211): n is a, c, g, or t
  misc_feature (324)..(324): n is a, c, g, or t
  misc_feature (326)..(326): n is a, c, g, or t
  misc_feature (346)..(346): n is a, c, g, or t
  misc_feature (348)..(348): n is a, c, g, or t
  misc_feature (364)..(364): n is a, c, g, or t
  misc_feature (373)..(373): n is a, c, g, or t
  misc_feature (438)..(438): n is a, c, g, or t
  misc_feature (440)..(441): n is a, c, g, or t
  misc_feature (453)..(453): n is a, c, g, or t
  misc_feature (456)..(456): n is a, c, g, or t
  misc_feature (468)..(468): n is a, c, g, or t
  misc_feature (493)..(493): n is a, c, g, or t
  misc_feature (504)..(504): n is a, c, g, or t
  misc_feature (515)..(515): n is a, c, g, or t
  misc_feature (540)..(540): n is a, c, g, or t
  misc_feature (568)..(568): n is a, c, g, or t
  misc_feature (571)..(571): n is a, c, g, or t
  misc_feature (580)..(581): n is a, c, g, or t
  misc_feature (583)..(583): n is a, c, g, or t
  misc_feature (586)..(587): n is a, c, g, or t
  misc_feature (589)..(589): n is a, c, g, or t
aaagagagctacctcagggcttgaatgtggactagtcgtgaggagnagagtgcattgcttcctctagggttttatttcctccccaccctcnaaattgttagctcacagccttacagnaaaggacgggggcgggcgcctgccctcagtctgatttctgagcgtccctgggtctgaccttaagggcaagggcagggagcttcacatttnaaanacagttgtggttacggcagcccagtacttttggccctccttgctgttcggttctcctcccttctcccaacctcctcactggtgttgctgggtgtggtcctcaatacagaaaananacccttgggcctgtgtcacnanacttcagaccccttgngcaacagcnagaaggagactggtcgccttttgagcctcagctctcttcctcttgttctcctagggtgggagaanannaacaaaacgctnaantaagtcccaacnacttccatcttatcctttgtgcccnacatcccccancatcttgtccnttttgccctctggtacctcccagtnccccaacatctctacccccagggactcnganaacatgcannanaannanaaaaaggcaaacgagaagaaggaggaacccaagtagctttgtggcttcgtgtccaaccctcttgcccttcgcctgtgtgcctggagccagtcccaccacgctcgcgtttcctcctgtagtgctcacaggtcccagcaccgatggcattccctttgccctgagtctgcagcgggtcccttttgtgcttccttcccctcaggtagcctctcttcccctgggccactcccgggggtgagggggttaccccttcccagtgttttttattcctgtggggctcaccccaaagtattaaaagtagctttgtaattcaaaaaaaaaaataatgacattaccctcggggggggcccggaacccaatttccccttttgg

SEQ ID NO: 538299 - DNA, 102 bp, Homo sapiens
  misc_feature (73)..(73): n is a, c, g, or t
gctcgtttgcccctcgtgttcatggggagctcgttttcttttcctctaggcagagaagaggcgattggcggcngatggcattcttttcggcgccctcggcgt

SEQ ID NO: 538300 - DNA, 702 bp, Homo sapiens
  misc_feature (494)..(494): n is a, c, g, or t
  misc_feature (553)..(553): n is a, c, g, or t
  misc_feature (556)..(557): n is a, c, g, or t
  misc_feature (613)..(614): n is a, c, g, or t
  misc_feature (664)..(664): n is a, c, g, or t
  misc_feature (686)..(686): n is a, c, g, or t
  misc_feature (691)..(692): n is a, c, g, or t
cgagaggagtcggtggcagcggcggcggcgggaccggcagcagcagcagcagcagcagcagcaaccactagcctccgtgccccgcggcgctgccgcaccgacgccccaacgatgccgctcatccccgctcgttctcacgcgctgcccagacccacgctggtgcgcccatcccgtcgccatgtccctggcaggcgcgccgtcatagttgtcctcgctgatctcgccgctcggtccttccagcggccaagcgcgcgagcgagacgagcctgcgaactgcctacgccagcgaggcctagcgagcctactagcgcaagcagctcgccaggcaagtagcgctgtcaggccacatgccgccggcgtccgggcgtccgtggcggcatgctaccttctgaggctactcgtacgcctggcgaccgtagcaatcctgcgagggttcggcgattgactccttgctaccgaagaactgcaacctgcgcatgtggccgcacgtctgncggcggcgcgccgcacacctggcgaaacgaaaaccttgcagcgacctaacgagaggctnggnncgccgcaggctacaggcagcaaaggcaaagcgccctggaaagtacgcgaagtaacnncatgtgtgtggcccccgcttaacgtgtggcaagctgtgcgtgctttccgngcttcaggatcataaactcagntgcanntccgcagttc

SEQ ID NO: 538301 - DNA, 383 bp, Homo sapiens
aactggggactaccagaaatgcattacacacctggtataattcaaaatatattatcatagagacgggtcttatccatgtgcccaagctggtctcgaactatctggcctcaagtgaacctcctatctcagcctccaagagcactgggattccaggtctaaatactgcaactggtcacatactcttcttatgtaacacaagtctgccatcactctaagtgcacttgaatcatagatatgtctgatccatccacataacaactgcctcaaagttccttgcactcagtacctacaatcttcaattccatccaggaagcaatcaagatcacactctgaaaagcacttcatccctgcttagcaactgctctgatgctgacattatgcac

SEQ ID NO: 538302 - DNA, 371 bp, Homo sapiens
acacatataaacaagtttattagattgtcagtgatactttgagacaaattcaagttatttcattttacttcatataaacagaggaagggaggaaagttttaaacttcaagctttgttcaccatgtgtgcagttagcatccacaaaagccccattgggtttgggagaattagccccacagaattttaggacctaactgttaacatgcctcactgaaaaaacttggaacataaaaaactgaagtaggtccgtgggtttgggctatttataaacaatcacaagggcaaatttatgaatttgttcttaataccagtacaattacaattcccaattaaatggagaaccttttttaagaacaattacgggaacaaaa

SEQ ID NO: 538303 - DNA, 309 bp, Homo sapiens
tccgcgtcccaggctacaagtgatcctactacctcagcctcacaagtagcgtgggactaaaggcacacaccaccacgtccggctaattcttgtatttttggtagagatagggtttcgccatgttgagccagtgcctgtctcgaactcctggcctcaagtgatccaccggactcagcctcccataagttctgtgattacagacgtgagccaccacgcccggcccaccttaccaatttcaactgtgttacgtctaggtcgacctagacgtaacacagcatggttctcagaactgagccgttgcaggttgag

SEQ ID NO: 538304 - DNA, 107 bp, Homo sapiens
ggatatagggtcttactttgtcaacccagcctggagcagatagtgcaatcatagcccactgcaacctcaaacatttttgtagagatggggtctcactatgttgccca

SEQ ID NO: 538305 - DNA, 127 bp, Homo sapiens
  misc_feature (52)..(52): n is a, c, g, or t
  misc_feature (65)..(65): n is a, c, g, or t
  misc_feature (84)..(84): n is a, c, g, or t
cccggagtccctggaagtttgcggcaggacgcgcgcggggaggcggcggagnaagcccgacgtcncggagaacagggcgcagancggcatgggcatcgggcgcaggaggggggccgccgcgggccat

SEQ ID NO: 538306 - DNA, 285 bp, Homo sapiens
  misc_feature (107)..(107): n is a, c, g, or t
  misc_feature (115)..(115): n is a, c, g, or t
  misc_feature (159)..(159): n is a, c, g, or t
  misc_feature (186)..(186): n is a, c, g, or t
  misc_feature (253)..(253): n is a, c, g, or t
  misc_feature (274)..(274): n is a, c, g, or t
aatcaacaaaacgagaatagaaaaacaatagagaaaatcattggaactaaaacttgattatttaaaaagatcaagaaatttgacaaacctttagctagatggactanggaaaaangaacattcaaattaccaacatcaggaattaacgtagggatgttntagcagtcctaccttattcacaagggnatatgttccaagaccccaagtggatgcctgaaacaccacagatggtactgagctctatatgtatatntataaatttttttcctatgcntacatacttac

SEQ ID NO: 538307 - DNA, 129 bp, Homo sapiens
  misc_feature (79)..(79): n is a, c, g, or t
cccaggtagattgtcctaagattgagtgaagctgccaacattcgcggtcaagcgaagagggtggcagccgtacgcgggnttgaccgaccggcaatcaaaggaaatccggcatacccgaaggtatcccgc

SEQ ID NO: 538308 - DNA, 135 bp, Homo sapiens
tgcggtcctacgaagacccagccacacttttcccacagatgccgcagccagttggatgttaggacatggagcaccggagttcagggtgtgagagtcgcaatccccacatgtgcatgtggaagcccctgtggggat

SEQ ID NO: 538309 - DNA, 1446 bp, Homo sapiens
  misc_feature (238)..(238): n is a, c, g, or t
  misc_feature (392)..(392): n is a, c, g, or t
  misc_feature (457)..(457): n is a, c, g, or t
  misc_feature (492)..(492): n is a, c, g, or t
  misc_feature (494)..(494): n is a, c, g, or t
  misc_feature (543)..(543): n is a, c, g, or t
  misc_feature (684)..(684): n is a, c, g, or t
cgatgcaggttacttcgctgtatcataagaacgagcttatgaccttatactagatgcatggcgacctcggtaaatcatctagcacctgtatcgtgtctgtgctaaatccttgtgtatactgtgcgctattcttcctacatgatgtcctgatgacaagagaactcacaacgtaactagcgtagagccacttgtcgagagcggcgtccaggtgagaatatcacagagcgcggtacatganatcgtaactactcgtagactcgctgtcgcgatacaagtgcccctcagatgcgcttctacttctgccacacgtacacgcgagtacgcacttgatcgggctactactcttgtttgacctagtaacaccgaagcattcggaggggctccatagcggncattcccgcgtcctctcctataccacaactaccacaaattgcacagatgtgttggcctaacacantagattggctgactgtgaaagagccactcaccggnanatgagccaccgtacttcaacgggcgtggcactgtacatcctctccaacntccctaaccaattactttaccccccaaattataagttccgataggaagcccagggcagcacccgtgtcgaatccttcgccgtgtggagcgatttggaacgaaattcgaagggtaaggtgactgccccgaactttggaagcnccacgccaatattcggttattaacttaactttagccaattccaacagaggatgcggttcctttgccgcacgtcagttggaggcctagatcgcgcgcaagcaatataggggccttaaaccacacaccagaattggcgaatttcccggtggcacagttcctaacatccaaaagcccacttttcagcccggcctatcaatctgaaccgtgcggggggttattaacctaaccgtggttccaagttagcgtcttgacacagtcctatgttgagatggcaaacccaacagtatttcagtggccccaattctggtccgtcagaaatttaacttttcccccctagaaaaagttctttttgaccaactaaggggccgcgctattataccccgtaattaagacagcacaccccgtactaaccccgccgtcctaaggaagccaaaacaatacaacgacacaccgcaacaatgcacaacaacaaagcagggggggcgggaccggcaccacacaaagaaatacattccccccgcgagagggtccccaaaaggtattaacgccgctggatcccgaccacttctccgaggcacacaacaggagggcggccaccctaaaaagggagacgacagccaatatataaagccgtacaggaaccagagcgaccgcgcagttaaaaacagcgcgtgggtgtcatgtcggcaaatccgggacagccgcgggccacaacgtggtaaagagacaaccaagtctaggcgggggcggcaccaaacaagg

SEQ ID NO: 538310 - DNA, 508 bp, Homo sapiens
ctacatagtctcccaagaattttttaggatttgtttaagaaaatacaaattctcggctgggtctcatggctcatgcttgtaatcccagaactttgggaggacgaggcagctggatcacttgaggtcaggaatttgagaccagcctgaccaacatggggaaaccgtgactctacaaaaacacaaaaaattagctgggtgtggtggtaggtgcctgtaatcccagctacttgggaggctgaggcgggagaatcgcttgaaccccgaaggcagtgtttgtggtgagcagaaattgcttcattgcactccagcctgggcaacagaatgagaccctgtctggaaaaaacaaaaaaaaaaagggaatatcttctaaaaggtaggggtacctagttttcttccatagggtttcctataaagacaagggttttttcatcataaatatatatggggatctggtgggaggggtcagtggtacccagaggcgttccagcagaagcaagtccctgggggg

SEQ ID NO: 538311 - DNA, 1137 bp, Homo sapiens
  misc_feature (233)..(233): n is a, c, g, or t
  misc_feature (421)..(421): n is a, c, g, or t
  misc_feature (555)..(555): n is a, c, g, or t
  misc_feature (566)..(566): n is a, c, g, or t
  misc_feature (596)..(596): n is a, c, g, or t
agccctgaccgtgacccgagtctcacccagcatgatgttcgactgccgaatgagacatagatggcctgtctgtcgatctcgtgaccacgagtctgcatactctagacgtgtgtgacaacctgttgataacctgtgggtccggacagtgtacacatagtagagtgcgtgttggcagctacgccacgactgtcttggacccactctcatggagatcaacagtaaccaagtcatgncgtatcatatctgcctggcaaggtgggacatccgctcggagcatatctgctgcaacgtggttggtcctgctggtcacatgtatcgtatcgtgtgaaagatctttgtggaggatcctaaagttttccatcgggtaggagcgaaatggtcacaactgtccagcagtggttctgaacagtagggtaggacnacgcagctggcatgaacatgcacagccaatgtagtgatcccgagtcgcatgtccaacagaatagcttgacattgcctgatcgactcatatcggctcgggttgtgccgaaactaagccacgcattacgatactantagtgttcgantccctgtgtgaacgagacgaggacctaggnagtcgatacacagcgcattgctaagtgatgtgcatcgtagagaccctcgtatcaacgactgcactcgtgtgaaacaagcaggactagggcttggtagcaagcaagtcctcatgaaggaaatccatggtatccatcagatggaccgccacggaatacctgtctcggcgtgacgcaaaaggtccgttggcgttagggaaaacctcggagagagttgacggaacctatctttttcccggaacatttgggacgggcagtatttccccttaagggagttccttcgtccccggagagaccggtgatagaggggccccaagggtgtgtaaacccgggggccaagctaactatcctgtctgcacacacgatgcttcctcacgggatataccacctcgtcgcgcggtgacaatcgggcggctctctaatcgcgtcacacaccacattatacctaggatgaggtgtgcgaaccacgtcatcctgatgggtgttattcatacagacgacgagcgcgcagaacaatcccgacctcgtatgtatgctagtgcgg

SEQ ID NO: 538312 - DNA, 588 bp, Homo sapiens
  misc_feature (90)..(90): n is a, c, g, or t
tggatgacaaaataaatggtcccagaaagtaagtgtatgaatgtgttctttaatttagcccgagcttgcaacagaaagtcgtcatgcgcntgtttaactccgccctgtatataccagccttggatgcccacagcggtgcaacgaatagactagtacaccacgtgaaacttagttggcgtaacagattgagttccatgtctttgagatcctctcctgagttcctacgtggtacatcccgagtcgaagcgtgtcttcacatatataataaaaccttcaggtattaggatctcctgatgcacgcagttttcctagaattggaagaagttccgtcatggccatgtgccctatgctcctacctcatcatttccaataaatttcagaatattagacacagaagagacatcagggatcatctagtccaatctcaccatgttatcctggacaagaagtcagtaaacttttactgtaaaacaccaaattgtcagtatttctgaccttgtggggcatacaatcctgtctttactatgcaaatctgccctctgacaccaaagcagctatgacaatacttaatgaatgacatggtatgct

SEQ ID NO: 538313 - DNA, 401 bp, Homo sapiens
agtcctattcgacttggagagaccacctctgggaagtcaaatgaacagagactatcgccctcactccgcagatggagaaactgagatccagagccctcagctcagcatcatctaaaagaacaaccatattccttgtgtctagcagcagcctagagatgccccaaggctgcatcatccaatgtgaaagccaccagccacactaggttattgagcgcctgcagtgtggcaggtctgaaatgagaatggctgtcaatgtaaaatacttatcagagtcctgaagacttagctcaaaaaaagaatataaaatatctctttaataattttttatacatattacatgttgaaatgatattattttggatatattgggttaaataaaagacattataagaactaaaaaa

SEQ ID NO: 538314 - DNA, 113 bp, Homo sapiens
aagagttcgagaccagcctgggcgagatgacgaaaccccgtctctactaaaagagtacaaaaattagtcaggtgtcattgtgtgcacctgtagtcctagctgaataatctcaa

SEQ ID NO: 538315 - DNA, 467 bp, Homo sapiens
tcaaattatattcagaaagcttctgcccttgtacttattaaccaaagggtgttcaggggcatgcacaaactgatcctacagccggagatccactcccggatgttcacccagatgatccagacgcctttcataatgataaagctgctctgcttctttgcataagagaactgtccttttagccataaaacatttatagaacctctacctgctaagagtggctcttaccctactgtccatcttcgatagagtcatgaaccccctataaggcttactacagagccacattgctgggaacacctgcaccaccacaagccacctagccctcacatagcccgccaagggctctccagaccatacattcagaagcatgggatgagacctacttacatactgaccatattttggaacactcacctatacattggcagatcggaaacccattcctaacacacacactaatcaccgtt

SEQ ID NO: 538316 - DNA, 418 bp, Homo sapiens
  misc_feature (10)..(10): n is a, c, g, or t
  misc_feature (76)..(76): n is a, c, g, or t
  misc_feature (159)..(159): n is a, c, g, or t
  misc_feature (204)..(204): n is a, c, g, or t
  misc_feature (272)..(272): n is a, c, g, or t
  misc_feature (281)..(281): n is a, c, g, or t
  misc_feature (298)..(298): n is a, c, g, or t
  misc_feature (315)..(315): n is a, c, g, or t
  misc_feature (417)..(417): n is a, c, g, or t
agggtccaancgattctcctccctcggcctcctgagtaagatgggattaacaatgcaccctccccccgcgcccggnctaattttttgtgtttttaagtagagatggggtttcaccatgttgtccgggctggtctcgaagtcctgacctcgagtgatctnccccccttggcctcccaaagtgctgggattacagcctggatacanctgtggagcagccagagagtttgattcagccaggactaggcttttgacaggtgatggcataagcacanagggtccancaagtttaggacacaancaagagagtgactaaanccatggatgatggattccaaggatggcaaggaagtaagaacaggaaggcaagatggactaagataaagcagagaggacgaagaataaaaaagtttgtgtatna

SEQ ID NO: 538317 - DNA, 164 bp, Homo sapiens
gtataataccctgatacctatctttgagttcaacctataatacgtgtggctaggacacttcgtggctcaggtacgaacgtgcttgtggcagacaagtctgtggcttggtgagtctgtgtggacagcagcctctgatcatgtgcagggtactaagcgcgtacggg

SEQ ID NO: 538318 - DNA, 422 bp, Homo sapiens
gcacgagagcgggagatgctgctctctgtgctctttgacacgtgcataatgtgcaagaccatgtgacactgtgtgagcaccatatgtgtctgtgggggcacagaaggcttcatattttcaagtggaactctttacctggcccggacagaaggagaagaactttcacaccacaacaagaagccgggaagaacttcaaagggcacaagaaccaagtgaattggctgtgaatgtgcactgagaggaacgtgctggtcttaaggttccacaacaagaacgcgcgcctctgggaagtgcagagaaagcagtggattcggacacggggcctttcagaatttaaggccagactggcggtgtgccactttaacaaggacctggtgggcgccgagcaccgggacccgcgccacgggggctttctgtggccc

SEQ ID NO: 538319 - DNA, 402 bp, Homo sapiens
ggcgcgagccaggtagtcggccaaggagacattctgctcgccatcgtcgccctgggtagaggcgaagcgcagcaggccggcgatcttctccttgttggcgacgtcttcggccgggccttccttcatcacctggccgaagttcttccagaagcccttgtattgctcgggctcgttcttcgccagtttctccagcatgtcgaggacacgcttggtcagtgccgacttcatcgagtcaatgatcgggtctttctgcaggatttcccgcgagacgttcagcgacaggtcgttggaatccaccacgcccttgatgaagcgcaggtacagcggcaggaacgactcggcctggtccatgacgaacacgcgctgcacgtagagcttgaggcccttgggcgcttcacgctg

SEQ ID NO: 538320 - DNA, 768 bp, Homo sapiens
  misc_feature (44)..(44): n is a, c, g, or t
  misc_feature (294)..(294): n is a, c, g, or t
  misc_feature (297)..(297): n is a, c, g, or t
  misc_feature (307)..(307): n is a, c, g, or t
  misc_feature (419)..(419): n is a, c, g, or t
  misc_feature (531)..(531): n is a, c, g, or t
  misc_feature (569)..(569): n is a, c, g, or t
agaaaagttctccggtgctggacatattttggaaaacaccaaantagtgggaatgacccggaatgggatgcagaggtatgcccttcccttcaattctccctgcttgcccgcatgagggcagtacatgaacggctacagctgctgtactggaagcacaggctttagcacaagaaaaagctgaaaaagagctgtaccagaggctcgggagtgtctgacctgctctctcagcgcctgggctctcaaagttttttctttggagatgcccctgcctccttggacgcctttgtcttcagntanttggccctgntgctgcaggcaaagctgcccagtgggaagctgcaggtccacctgcgtgggctgcacaacctctgtgcctattgtacccacattttcagtttttacttcccctgggatggagntgaggtacccccgcaacgccagacaccagcaggcccagagatttaggaggagccataccggcgccggaaccagatcctatttgtgttggcaggaatggcaaccatggtgggntacgccttgttcagcggcattgtctccatccagcgggnaaagccttgttggggccccaggcacccggaccctgggcatggttgaggaggatgaaaaggaatgatttgtcctcacgctcccaagactggtttttttattttcatgcattccaaaggcccccgtgcctccttgttgttggtacagccggacacggggtgctgccacccaaaataaagccactcacactgattgggctca

SEQ ID NO: 538321 - DNA, 315 bp, Homo sapiens
tcctgtttgcgcctcctgagtagctgggattacaggcatctgccaccacacccagctatttgtgttatttttagcacacatggagtttcaccatgttggccaagctggtcttgatttcctgacctcgtgatccacctgccccggcctcccaaagtgctgagattacaggcacgatccactgcgcccggctgcccagcctaaccgcccagcctaatttctttctttcttttctttttttttttggagggggagtctcgctctgtcacctaggctggagggcaatggggcaatcttggttaattacaacctccgctt

SEQ ID NO: 538322 - DNA, 588 bp, Homo sapiens
catgatggtacactcatgttatcacctgactcagtcagactgtctaattatctgcaagttcacagatattctaaaacatgctgtccaacatacagactccctgaaactgttcctctggctttacatcacacaaatcagcctaccagtacataacaatacaaaccatcaccatgcagagtgataacctccatgtaagtgcagtttcagcaccaggcaaatggcagcaaaactcttcactacaggttcccttgccatcagtagtctcaccagggcgtgcatgtggtgcttttatatccccgcagtgtttaatccaatatccacgtggtagagactcagtagttgcctctcaagtgggaattagacttcaaagactctgattaaatcctatagcaggggtcagcagactatagcctgtggagccaactccggtctgtttttatgaatatctgactctttttgtaaataaagttttattggaacactcccacactcgttcatttacatgttgtctatgactgctttcacattattatagaagtgagtcatcgcggcagaaaccatatgacacacaaaggctaaaaaatattg

SEQ ID NO: 538323 - DNA, 868 bp, Homo sapiens
gccgcggattgccgtatacagggcagcgctcggggcttcgctcgctggctgcccgactcttgcccctcggtcgctgttccccgtcgccggcgccccgctctacgttgtcgtggcgccgccatggagcccgcgcctcgctggctggcggggctgctgcttcgacaaccgcgccctgcggcgccctgccctgtggatggctgcctgccgcccggtcccgatgggcgcccctgtccgcgcctgtggcccgtgccctgggggcctgcttcacccgctgtgcagcccaccccgctgcgtgcagcctgcgcctcgtggcgctgtcagagcccgcgctggcgttgctgggcctgggcgcgcctgcccgcgcgcgagccggagggccgaggccgcgctgttcttcagcggcaacgcgctcctgccgggcgccgagcccgccgcgcactgctacttgcgtgcaccaattcggcccagtccggccgggcagcttgggcgaccggcgccgccatgtacctgggcgaggtgttgcacggtgaccggcgagccgctgggacgcttgcagcttcaaggggcggccgggccacgccctttctccagacaggccgacggtcgcaaggtcctacggtcaagcatccgggagttctatgcagcgaagccatgttccacctggaagtcccaaacaacggcccggcgccttggtcacgtccgaattccaacggtgagagcgccgaacgtgttctatgactggtaatcccaaatattgaacaatgccacggtcgtgttagcgttgtagcttaccacgtttcataagggtatgaaatcccttggagactttaaagtcctgcggatagacaccaacggcgtatcagagcca

SEQ ID NO: 538324 - DNA, 482 bp, Homo sapiens
  misc_feature (7)..(7): n is a, c, g, or t
  misc_feature (159)..(159): n is a, c, g, or t
  misc_feature (162)..(162): n is a, c, g, or t
  misc_feature (172)..(172): n is a, c, g, or t
  misc_feature (256)..(256): n is a, c, g, or t
  misc_feature (280)..(280): n is a, c, g, or t
  misc_feature (300)..(300): n is a, c, g, or t
  misc_feature (334)..(334): n is a, c, g, or t
  misc_feature (380)..(380): n is a, c, g, or t
  misc_feature (466)..(466): n is a, c, g, or t
ggagaanaattttgtaaaatgtaaattagagggaagggaggatagaagaaaagtgggaaaaagaaaaaaagggtggaggatgggagatgaaaaagaaaaaaggaaggagaagggagaaggaggaggtgaaaggaagggaaaggagaaaaagaggagggnggnaggggggggnggattagaggtaaatatagaagtaaagagaaggggagaaggaaatgtagttaagagaaaatggaaaggagtaggggaaggagtngggggaaataagagagatgaagtnataagaactggtagggtggnagagagaggagaagtagtaaatggtaatgtagtnattgtaaaaagaaaggatattgaaggaagaaatgaattggtatgangtatatgtgtaggatgtatagagggaaatgaagtaaatgaaggaatggaatgtaaataaaaaaaggaggttggggtaaaaaatganaatgatgagggaaaat

SEQ ID NO: 538325 - DNA, 165 bp, Homo sapiens
agtagtagaatataactcaggtgacgaaatcagaataggtgtaggataaatggggtctcctcctccggggtggtcgaagaaggtggtgttgattgttgctggtctgtcacgtagtatagtgatgccagcgaggtaggactgggagagataggagaagtaggactg

SEQ ID NO: 538326 - DNA, 121 bp, Homo sapiens
ttcaatgcgccagaagttcagtacctgcttacgacggcatcggttaggctgagctgagggcatcataggagctgcttttcatggtagtcgaatttctttgaaaattgctttagaactctgt

SEQ ID NO: 538327 - DNA, 135 bp, Homo sapiens
atccccacggcctgttgtatgtgtaggggatgctgtacgcttctgggcgagatcctgatgcctgctgagattccacagtgcgtgcgccaggtcacacttgtaccccaccagcaccatgtgcacgtcatcctgagt

SEQ ID NO: 538328 - DNA, 224 bp, Homo sapiens
cgaatcgcgctgctggcgataaacgttgagtttttcttccgcttggtccagctcgctcgcgcacttcaggtaactggcacgtctgtaagaattcaaggctttgtgaatcctacgtcacgtcctcctggcagcgatattctgttgcaaatagttgttagcgatgctgttcagaatacgagtaatcaactggggatcatcaccagtcatgacctggagatctccag

SEQ ID NO: 538329 - DNA, 482 bp, Homo sapiens
  misc_feature (423)..(423): n is a, c, g, or t
  misc_feature (455)..(455): n is a, c, g, or t
  misc_feature (465)..(466): n is a, c, g, or t
aaagatacttgcttcagttttgcagtcaggaattcaagaactgcacaaccctcagaagtgaaaaatcactgggtagatttgcctcatcatcctttattgaaacaaaatacataatatctgtttggaaatatgtctcatgataaattaataaaactattattaaatgttttatttgatttcagctacacagtaacccagtaagataagtaacacaggcaattctgtttaacagatggaaaaaattagtggtccaagatgattactcagcgatcctgaagcgtagttctatattcctttccaccagcccaatgttgcccgtcctctcaaccttggtgcacattgctatctcctctgttatgggatgtcacacaatattcaatgcagtgaatttgaatatgaacagatattaagttttccctattntatgaacattctggttacttgggccttccttngtgacattcnnttgtacactttccact

SEQ ID NO: 538330 - DNA, 122 bp, Homo sapiens
  misc_feature (4)..(4): n is a, c, g, or t
aaangggttaaagacaaaacccaagcatgggattttgccggaaatattagcgttaaaggagctgagttgagtcaaaatcccatgcttgggttttgtctttaaccttgtaacgcttgcaatcc

SEQ ID NO: 538331 - DNA, 430 bp, Homo sapiens
  misc_feature (362)..(362): n is a, c, g, or t
  misc_feature (423)..(423): n is a, c, g, or t
ttgagacagggtcttgccctgctgcccaggctggagtgtagtggcgcgatctcggctcactggacccgcctcctggattcaagcacttctcctgcctcagcctcccgagcagctgggattaaaggcacccaccaccacacccactaatttttgtttgtttgtttgttttttttagtagagacagggtttcaccatgttgtccaggctggtcttcacctcaggtgatcctcccacctcggcctccaaaagtgctgggattccaggtgtgagccaccgtgcccagccttgcacctcagctttactgagctgttgtcctgggccttcctccccaccttttccgttgtgaacttctttttcttgtncttgctggcatttgcttggaatttccaatcaacggttgaacagaatcaatgaaagcagctnatgtgtt

SEQ ID NO: 538332 - DNA, 202 bp, Homo sapiens
tccgtgttgtgaccaacggtgtggttactgtgagtgttccgaatttaacagctcggatttgtagtgtttcaacccaggaaaattttacttcacagaagtaacaaggcgggaggcatggttagctcacgcctgtaaacccagcactttgggaggccacggtgggagaatcgcgttgaacccagtgaggtcgagaccagcctgg

SEQ ID NO: 538333 - DNA, 261 bp, Homo sapiens
tttgagatgatgatggagatagcggtcatggatgcggggccctcccgcaggtgctggtgatgatggagatagtgggcctgggtgcggggccctcccgcaggtgctggtgatgatggagatggcggtcatggatgcgtgggccctcccgcaggtgctggtgatgatggagatagcagacattggtgcgtagggcatcccgcaggtgcttgtgatggagatagcggtcatggatgcgggggcctcccgcaagtgctggtggtg

SEQ ID NO: 538334 - DNA, 325 bp, Homo sapiens
ggcagagctacggtctatgcaggcatcacgtgtgtggtagggggagagtctgtaggtaaacttgcgtactgagtcagttacacaagcaatgcatttccgtggagaagtatatccctacggtctgtgacaattatgctgccaatgttatggtagatggaaaaccggtgaatctgggcttatgggatacagctggacaagaagattatgacagattacgccccctatcctatccgcaaacagttggagaaacgtacggtaaggatataacctcccggggcaaagacaagccgattgccgatgtgttcttaattcgcttgttccgctg

SEQ ID NO: 538335 - DNA, 190 bp, Homo sapiens
ggccccccccccttttttttgggaaaatttttggtttttttttgggggggaaaaaaaacccaaccccccggggggggaattttttgggggcgggggccccccttttaaaaaaaaaaattttttttttggtaattttttttgggggggggaaaataaaaaaaaaaaaaccctttttttttgggggggggga

SEQ ID NO: 538336 - DNA, 141 bp, Homo sapiens
atatactcttcttaaccctttcaaaataaatttttcagggtgacagaaaggagagttaaaatacatttttgtaaaggtgttaacatttgactcacaaaggtaatggttctgttttattcaaattaaaagtttttcaattta

SEQ ID NO: 538337 - DNA, 213 bp, Homo sapiens
tgatctagaggatcccgtttctctgatcgctctgtgcccagactggagcacagggcatgatccatactgtggcctcaacctcctggactcaagtggatcctcccacctcaacctcttgagcagctggggccacaggcatataccatgcccagctaatctctttaattttgggtagagacagggtctatgttgctcaggctggtcttgcactcc

SEQ ID NO: 538338 - DNA, 313 bp, Homo sapiens
agcggcgccctttattttaataagtgtatgtatctccaacagcccatcgccttctctcagcaaatctgtttctctgtatctggcacacagcctcatcaacactttgcctatccagttgttatttctatttccaacacagggcacacacccagatggtcagcatagcattcacactcttcatttcattctttcacaccatttcacatttgggcatctatcagtccagtcatctgagcatttcatcaggcatgcaactatcaggtattcacacaggcacaccagtgtcagttacacacacagtacaggagtgcca

SEQ ID NO: 538339 - DNA, 159 bp, Homo sapiens
ggatgcgggggaactgtgttagtactgagacatcctgcgaataggcttccggctgtcaggcgtttaatggggtttagtagggtggcgttattttcgttaatgttagtaagggtggggaagcgaggttgactgttagggctgagaagaattattcgagtg

SEQ ID NO: 538340 - DNA, 358 bp, Homo sapiens
  misc_feature (27)..(27): n is a, c, g, or t
  misc_feature (47)..(47): n is a, c, g, or t
  misc_feature (61)..(61): n is a, c, g, or t
  misc_feature (89)..(89): n is a, c, g, or t
  misc_feature (111)..(111): n is a, c, g, or t
  misc_feature (126)..(126): n is a, c, g, or t
  misc_feature (139)..(140): n is a, c, g, or t
  misc_feature (142)..(142): n is a, c, g, or t
  misc_feature (163)..(163): n is a, c, g, or t
  misc_feature (186)..(186): n is a, c, g, or t
  misc_feature (217)..(217): n is a, c, g, or t
  misc_feature (229)..(229): n is a, c, g, or t
  misc_feature (245)..(245): n is a, c, g, or t
  misc_feature (252)..(252): n is a, c, g, or t
  misc_feature (269)..(269): n is a, c, g, or t
  misc_feature (282)..(282): n is a, c, g, or t
  misc_feature (286)..(287): n is a, c, g, or t
  misc_feature (310)..(310): n is a, c, g, or t
  misc_feature (327)..(327): n is a, c, g, or t
  misc_feature (342)..(342): n is a, c, g, or t
taggaaagtgaagctcaagggtaaccngtgaggctatgaaattgccngtgaattaagaccngggctagagtcaacagtccagaaccccnatccgtatgaacaggggcccgnttctggttgaaatcnaggttaggatgcnncngagaaaataaaagactgcacnttggagaggcaagcacgctatcngggttgttgttttgttttatgtcgtggtgcntaggtgaggacntagctgggtttattcnaagtggncgggtctgggctattcntgagaatgtcccntccnnttctgagaacaagtcagccccgnctacctgcctccacccnggagactgatgcacnagatctgtttgtgaaa

SEQ ID NO: 538341 - DNA, 549 bp, Homo sapiens
cggacgcgtggtcgaccacgcgtccgctcagcgatcgaccacgccgtccggactattactagatcgcgagcggacgccatttttttcttgcctcagacacacattgtcagtttcctcatcctctctctcgtagatagaatatacttatgtatttttggctgttccaatagttagtgtcgattctgttggacctttctggctacacttgagtgtcttacatgcatctgtactgtgagtgctacattaagttttataattagcccacaccgtgcacaaaagaggcagtgcttccttatgagcttcaagcgtgacgtcccggagaaagacactgattggcccagcttgggtcatgtggccatcctgcaatgaaaacgacaatgggctattatgatcatatgcccatccccgagggtgaatgtgacagtgcggtacatgtggtgacagctctatcgacaacaatgtgagatgtgaactacaggttgccaacggacggacgaatgtcggctaggtaacaaacatgctggataatgcctataatcccagcatcac

SEQ ID NO: 538342 - DNA, 578 bp, Homo sapiens
  misc_feature (66)..(66): n is a, c, g, or t
  misc_feature (87)..(87): n is a, c, g, or t
  misc_feature (89)..(89): n is a, c, g, or t
  misc_feature (150)..(150): n is a, c, g, or t
  misc_feature (198)..(198): n is a, c, g, or t
  misc_feature (205)..(205): n is a, c, g, or t
  misc_feature (226)..(226): n is a, c, g, or t
  misc_feature (252)..(252): n is a, c, g, or t
  misc_feature (271)..(271): n is a, c, g, or t
  misc_feature (275)..(275): n is a, c, g, or t
  misc_feature (281)..(281): n is a, c, g, or t
  misc_feature (287)..(287): n is a, c, g, or t
  misc_feature (291)..(291): n is a, c, g, or t
  misc_feature (340)..(341): n is a, c, g, or t
  misc_feature (362)..(362): n is a, c, g, or t
  misc_feature (365)..(365): n is a, c, g, or t
  misc_feature (370)..(370): n is a, c, g, or t
  misc_feature (384)..(384): n is a, c, g, or t
  misc_feature (393)..(393): n is a, c, g, or t
  misc_feature (402)..(403): n is a, c, g, or t
  misc_feature (421)..(421): n is a, c, g, or t
  misc_feature (424)..(424): n is a, c, g, or t
  misc_feature (428)..(428): n is a, c, g, or t
  misc_feature (442)..(442): n is a, c, g, or t
  misc_feature (474)..(474): n is a, c, g, or t
  misc_feature (525)..(525): n is a, c, g, or t
catgagcggcggtaggatggcgcaggttggagcgtggcgaacaggggccctgggcctggcgcagcngcagctgcccggcctcggacnangcctggaggccgccgcgagcccgctttccaccccgacctctgcccaggccgcacgccagcncaggctcgtgcccacccaccaagtaccagtgccgcaccagtggcttangcgtgcncctcacctggcgctgcgacanggactaggactgcagcgaaggcagcnatgaggaggagtgcaggantganccatgnacccanaaanggcaatgcccaccgccccctggcctcccctgcccctgcaccggcgtcannaactgcactgggggaactganaanaaacngcgcaactgcagcngcctggccngcctagcanncgagcaccgttgcacgcngancgangactgcattccacncacgtggcgctgcgacggccacccagactgtnccgactccagcgacgagctcggctgtggaaccaatgaaatcctcccggaanggatgccacaaccatggggccccctgtgaccctggagagtgtcacctctctca

SEQ ID NO: 538343 - DNA, 1616 bp, Homo sapiens
taaaaatgggagtctcactctgtggcccagtttgggagtggcaggggcgtgagatctcgggttcaccaaaattctctggcgtctcccagtgttcaaggcagatttctcctctcttacagctctcccggagtagctgggagattacagggctcttgtggccaataaggccacaggctataattttgtgggtatttttaaagatagagaagacggtggggtttatcaccactgtgttgtgcgcacagcgctgtgtgtctcttgagaacctcctgtgaccctcaaatgtgactcacattccacctctgcggccccaccaaaaggtgcgtgtggggtccccacctgtgcgcagtggagagctaccacaagtgaggcacacacgtgggcgctctgaggggggttataagggtctatccacaatctattcatctccccaattacacatccatctttggtgagcaccatcttttaaatgtgttcgagcgaaagcatctatacctcgtgcgggcctcctaccacataatcttccgctctctgtggtgcgtgcagttgtgcactatacacaaagtgtggggcgtgtggcgacaacagaccgcgcacaccagatcgctccgctgccgacacacatcccgtttctctccccaccttctcacgcgcgcatatatcaaacacacaggcgctatgaaacaacatctcagcagatacccgccaaattataagttgacactttcccctgttgtttaacacacccccccatgtgtcgacatacaatcacgcgttataacccacgaggtggcaagttacaaaacccccgaaggtgggcaccattccgcggcggatgacacacaacgacggaacaacaacctgtcaacttctcttcctgtcatgtagagtgatttgataatcagttactggcgcgcaagcgacatcgagtacgacatcctatgcaccacactcaccttttgtagtgcgagatcgccgcgacccgcgaccgaacgacgctagtgcgcgagaacgaaccgcctgaacacgaatgagaggagggcgaaagcaagcaacaacgactgtctccaccgcgaggccaaccctcacgaagcgggcgagagaacacacacgcagcacctgtgcccacccacccacggcggggcgcagtcacccacaggcgaaagcaaagaaccaccactacgagcggcagaccaacaccaacgacccccacccacacacaaaagacagtacagccggagccgaggagacaacaaacaacccgcggagcagacagcgacgcttcgacagcaccaacaaccagacgaacgccgcgtggttggcgcacaaacaaagatcagtgtggagcagacaccataacacagagattgggtgtaagacaacaaaccggggaagcggaacacacacgaacccgacgtggatgtgggcgcacacacacggctgaagtggtcgggcacgcacatgacacacaaactcatacagtaacgcaacgaccacctacaacaggacagagacagccgacgcggagggctcgccacgtacgccaggccacatccgagcccgcgcgaagatagacacaccagcagtcactccatagcacgagcaggcaggcgcaa

SEQ ID NO: 538344 - DNA, 553 bp, Homo sapiens
tgagctacttggatggctgaggtgggaggattgcttgagtccaggaggtctaggctgtagtgagctgtgttcaccccactgcactccagcctgggtaacatgagtgaaaccctgtctctacaaaaaatataaacattagctggacgtggtggcatgcacctgtagtcgcagctacttgggaggctgagctgggaggattgtttgagcctgggaggtgaaggttctagttagctgaaatcacaccactgtattccagcctggctgacagctagactgtctcagaaaaaaaaaaaaagcaaatgtgaactggaacactaattgaagagtttccctaccttgtgaatggggaatctgtttgtatttcctaccttgtcatatactgtactctgcagctgttaggatgtgagaaaatgcctgtggggacagtatgagcctggtgttgtacagggtatttatggatgtgtaggctaggaagatatgcaaccaagggattacagccattgcattctcttccctgtactttgtgatgagaaacaaataaattaattttaaa

SEQ ID NO: 538345 - DNA, 633 bp, Homo sapiens
  misc_feature (50)..(50): n is a, c, g, or t
  misc_feature (84)..(84): n is a, c, g, or t
  misc_feature (127)..(127): n is a, c, g, or t
  misc_feature (132)..(132): n is a, c, g, or t
  misc_feature (158)..(158): n is a, c, g, or t
atgatgtacttgtttgcaagagagtttcataaaatcattagtaaaaacancctgctacttcagttggaatattggcagcccggncgtgattgatggctcatgcctgtaactctgacactttgggagnccaangcaggtggattgcttgagctcgggantttgagaccagcctgggtaacatgagtgaaaccctgtctctacaaaaaatataaacattagctggacgtggtggcatgcacctgtagtcgcagctacttgggaggctgagctgggaggattgtttgagcctgggaggtgaaggttctagttagctgaaatcacaccactgtattccagcctggctgacagctagactgtctcagaaaaaaaaaaaaagcaaatgtgaactggaacactaattgaagagtttccctaccttgtgaatggggaatctgtttgtatttcctaccttgtcatatactgtactctgcagctgttaggatgtgagaaaatgcctgtggggacagtatgagcctggtgttgtacagggtatttatggatgtgtaggctaggaagatatgcaaccaagggattacagccattgcattctcttccctgtactttgtgatgagaaacaaataaattaattttaaa

SEQ ID NO: 538346 - DNA, 846 bp, Homo sapiens
gcagcttctgtactgccaggtccgggtcggcgctgcactgcggatgagaccggtgcgactcatgaaggtgttcgtcacccgcaggatacccgccgagggtagggtcgcgctcgcccgggcggcagactgtgaggtggagcagtgggactcggatgagcccatccctgccaaggagctagagcgaggtgtggcgggggcccacggcctgtctgcctcctctccgaaacacagtggacaagaggatcctgtgatgctgcaggggggccactctctacagtcgtcttcagcatcgatgttgtgggggtcgtacgaccagttgggtatggatgtacaatcaacgaatgcgtgggatcccgagttggtacaccccagatgtcctgacagataccaccgcgaactcgcaagtctccctgctacttacccacctgccgcggttgccggaggccatcgaggaagtgaagaatggtggctgacctcgtggaagccctctggctgtgtggctatggactcaacgcagagcactgtcggcatcatcgggctgggcgcataggccaggcattgctcggcgtctgaaaccattcggggtccacgagatttcctgtacacaagggcgccagctcaggcctgaggaagcaggcacgaattcacgggcagagttgggtctaccccctgaagcttggtgcccaaatctgttcaacgacaggccttggtctttaacctgaaccgtggatctgcacaggactcttccgaatatgaggaccggtgcgtcctaacatcagacgggcaccaaaccagcacctgtccggactgcaaggtacttgctgcgcgttcggccccactggttgc

SEQ ID NO: 538347 - DNA, 555 bp, Homo sapiens
  misc_feature (87)..(88): n is a, c, g, or t
  misc_feature (103)..(103): n is a, c, g, or t
  misc_feature (106)..(106): n is a, c, g, or t
  misc_feature (108)..(111): n is a, c, g, or t
  misc_feature (385)..(385): n is a, c, g, or t
  misc_feature (407)..(407): n is a, c, g, or t
  misc_feature (413)..(413): n is a, c, g, or t
  misc_feature (509)..(509): n is a, c, g, or t
gcttggccagccccattgaatttccctgtttcatagctaataccctcaaggctctctgtgacaaggtattcaagacgggggctagannttattcttggcatcntgngnnnntctcacttgtgatgttgcctcttatttcactgagtaattggaagcaaacaggacctccacctgctcccagaaccacaactttgctccctgcgaccttcctgtgctcctaacctaagtccaatccctctcctctgggtgggacatgtatcgaagaacgccctctggcagttgtgcgcattctctgctccccactaatatttccttcttgactgggttatttccagaagcgtgcaaacatcctctaccatctcccactgctaggtgggactcttgnactcactttccactccagctgncacccnatttctctttatctcttcatagcaaaactccttgaaaggattgtctatacttgctgcatccattcctcctagtctctgttgaactctgtccactgnagcttccctcctgaaacatgctcccaccccaggaacagttcctatc

SEQ ID NO: 538348 - DNA, 231 bp, Homo sapiens
ctcgatttgaacgatggtcacatcaccatgctctaggctgggcgagagagaccctgtttcagtcaacctgacccctctttaattcgcaaattgattgtaccatgacactctttttaatgtgattatgggtgcaagtaacatccacaaaaattagagatctaaggaaaacactaccctaatcaaaaggccacaaaatgtattcacagtaacagcttccacttactgggtttt

SEQ ID NO: 538349 - DNA, 813 bp, Homo sapiens
cagaatacaagtacagccccacatgcaggctgggccagtgatccccgccctccaggagtagcccaggcaaaggcctctccttgggaaagaagcacagtggtggaccccgcccagagaagcaggctggaacacaccaggcagagaacagacagcagacacgagagagtccatgatcctgcaggccctgcaactggactgtgttcttcctgtggtgccaacagaagaaacgggccagacatggagagggagactctgcggaaggccaccaggccacacagaggacagggagcttcccccaggcctggcactctactgctgcaggtgtagcctgggtggccccactgagcccccagcaccagagagcttggctgtgcaggtgcttcggggcgtggcagcagttcgtgcaaagagggtcccggtaccgagaccacctggctgacctgccggacggggaccctgaggaaatgcctggaacagtgggtgcggatgaagcagctccgggaatcagatggggcaaaggtgacccagctgtccctctgcggcagaaagcaggacgtgaggctgtgtacaccgcagggcctggagcctgtggctgggtgcagtgggccaggccaggggcagcagagccaggcgggtccctgcaggatgctgccggaatggcctctgtggcgtgtgtgggagaatagggtttcagggcagtggcgatccttttcccggcttgcggacgatgtgacgcgcttgatgtggctttggggcgtggccgttcctaatggcaacctcgttgggcctggaggcccactcttaaggcggccg

SEQ ID NO: 538350 - DNA, 228 bp, Homo sapiens
tagctctcgcacggcacaagagtagcttccttcaggtggtctcgctatcccggatcatgacggagcccagcatgtcggcgggagccagcagttggcgctcagcgtacaaccggctagatgccctaaaaaaaccactacctctgtactccagagagtccacgcgggcgacatagttacttgggatgtagcccacattccgggtggccagggatcgagccttccaccact

SEQ ID NO: 538351 - DNA, 122 bp, Homo sapiens
gaatttcattggactttcaggataatttctatgttggcaacttttcgttttccttaactcaccagtttagtttggcatgatttgattcctgtggttggtgatcccattctactcggatggtg

SEQ ID NO: 538352 - DNA, 103 bp, Homo sapiens
gagtcggtccaaccttgactctttgtctccataaactccagactttataaccaactacctacttaacatatcacttggggctaggcttggtggctcacaccca

SEQ ID NO: 538353 - DNA, 368 bp, Homo sapiens
tcaggcgggcttgggggatgactttgaaaaaaagtttaatgcgctgaaggttcccggcccaaaggataaaaatactccccagggggatcccgaaaaaaaaaaaaatgtgaaattttgtgctgagggggggtttttttcaaaggcccggattgtaaaaaatgaaaaaaaaatggaaaaaatgaaaaacttaattccctttgatcaaatgccccttgggggcttgaatgaagctttccccaaaaccaaattagccaagaaaagggttcccttttggcctccccacccaattgaaaatttataaaattgggtcccggaggaagttttggcccttgtattacccattttggccattaaaaataataatttta

SEQ ID NO: 538354 - DNA, 448 bp, Homo sapiens
gttagatctagaggatcccggatgctctctcgtgtgggggagtgcatcccgtctgggtgatgtcgatagatgtccactcaggaggctcattgcagaggggaaggcgtaagcatggatttacaaaagaggcaccggtccgggataccatgtggtctcgaattgtaccggagttcgagagtacgagtagggcttgatggggctcagggtcatggccgaggctctccagcctgtgtggatgaatgcactcgcagatctcatctctccgcggctccctccccagccggatgtccagccctgcccttgcactctagtctcatacgctatggctcacttggcatctcaaatgacagttgcccaaaacataattccagcttctccttccagattggtttcatctcccttcggtctcactgaaggacagccccacagagagagcgtcgggtacgga

SEQ ID NO: 538355 - DNA, 387 bp, Homo sapiens
tagcagcgcagcaacatcaatgaaaacctcctgaatccatctttggggctccaaggctggcagtgggcagtgggctctgtgatcgagtgatgaatccattcaagggaacacactggaccttgtccagctgaaacagaatgaggcagcttttagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagttttggcacaagactcctgtggaagaggtccctgctgctattgccccattccaggggagggtgttgattgatgtggctgcgctgctacg

SEQ ID NO: 538356 - DNA, 522 bp, Homo sapiens
  misc_feature (445)..(445): n is a, c, g, or t
aatttgccctgtaggccaataacttggcacgagggcgtcagtgaaatgcagtactccatctacatctcactcggaggctgggtcttcacgatgttgattggctcgctgatccctggagctggtgtagtagaaattctggtagtgtccctggtcctcttgatctgtgctagtctcccactaaggtatctaaagtgacccctacctaggtgacagtcagagtgtaggggactcttggggtatccctgtgtcctggtctattatcctagcttctttgtccttcagtattcccagcccagcctgccaataagagtacataattgtgtacacgtggcttttattcattgtatcttttttagattcttctatattgtactgattggggcaaaacatgcttttatcttctgccttttctattgccctgttacgtctcatctatacgtgtgtntgtgtgataggtgtatgaaccttcccattcatgcccgcctaccaactacaaacgtgtttttttcttctttgaaaaaa

SEQ ID NO: 538357 - DNA, 320 bp, Homo sapiens
agttcgactggagacgcctcacacagtctacgatcactgatcagcgaacattgtgagtctactaccaatgcggtatctgaatcggaacgtcttgttaatagcgccggtcacgtgtattaacgccgatacccttctaattcctctgcctacatcaatccatggccgtttgcctcaagatggtcatgaaatataaaaccagatcattcgctacttcaaactcttcaatggttacatatttcactcagagaaaagcgctaggtctaggaggccttatgtgatatgtaccccagccagctctctgacttctcagctcctacttt

SEQ ID NO: 538358 - DNA, 266 bp, Homo sapiens
agagagtcctttccccaactgaaagccttggcacctttgtcaaacatcaactgaccctaaatgtttgggtttattgctggattctccattgatctatatcttgattctcatgccagcacacactctactactgtagttttatagtaagttttaaaatggaaagtgtgaatcttccagttttgttccctttcaaaattattttggctattctggatcctttgtatttccatataaattttatgatcagattgataatttctgcaaaa

SEQ ID NO: 538359 - DNA, 413 bp, Homo sapiens
tcgaggtataccggctcacgctgtatcccagcacgtgtgggaggcgaggcaggtggattacctgaggtcaggagttcgagaccagcctggccaatatggtgaaaccccgggcctactaaaaatacaaaaaactagttgggtgtggtggcagacgatgcctgtaatcccagctactcgggagcctgaggcaggagaatcgcttgaacctgagaggcagatgttgcagtgagctgagattgcaccactgcactccagcctgggcaacaagagctaagctctgtctcaaaaaaaggacaaaaaaaaaaaaaggggaagaaattaattttaaggaagaaaaggcaattttctcacccttttagggggtagagaaccacgggtggtgagagagcgactctctgataatttataaaaga

SEQ ID NO: 538360 - DNA, 633 bp, Homo sapiens
gagaagtgcccgggtcctcgcaggaaataggcaaactcagcctgccagctgtgcacacatgcacttcaatgtatagttcctcggcgcgcctctgaccttttcccggagcactacaatcccagaagctatagcacaagggcattgaatcgccaggaaccccgagggagtgcgtggcttcagtgaccggaagaagcttcctgttgccaaaggtgacacgtcgtgcctgccagtggcagccatgctcaggagatgaatagaaatgacttgcatgcgagaggctgcagatatacgaaaaattctagagacggcttctgactcatagaccagggcataccttaccatgtaggcatcgataagaaagagctgagtggacaccatcaggcaacgagagttaccaattacaaggagaccgatacgagtagcagtaaacaaacacgtgtcagacaaacacctgcgccctccggactaacctcaaaaagcagccggtcagtacacactcgaaaccaactaatgcgatcgcaacacagactacagccaagaaaaggacagaacacgaaagacacgaaagggacgagcaatgaaataacaaacaggcacagaccacaaaagacacaaaaacgcaaacggacagcc

SEQ ID NO: 538361 - DNA, 620 bp, Homo sapiens
taggagtgacgtgtgagctgcctcgtgggcatgcgcatggagtggatggcgcatggcgcgggcctggtagcagatgtcctggttctactaccatgtacctgctggtcacggtcgctctacatgctgtagccctgggagctggacggtgttcaattccatgctggtttccattgtgagggatggcactatacacatggatacgtcttcatgctcccattcacatcattagcagattattgcactacttcgaaatctgtacaattgaccacacgatggcgacacaggagtcagaggattccattgggagaaagacccaaacctacgaggtcggaatgagaacatacaagatgtgataaagaaaaatggtttcatagcatgtcaagccataaccaaagcttacgtaaatacatacaacttcaatgatgtaagacacagcgaaaaaatcactcacttgagctcatggtgtatgctgctccatcttaatttatataaattggacaaagtagacaggctcattgatataagcaggatttatgatcatagtgtgtaacaattttgttaggttcactgaggggcacttatggactatcacgattattttcttatcaggcaactaggag

SEQ ID NO: 538362 - DNA, 301 bp, Homo sapiens
  misc_feature (24)..(24): n is a, c, g, or t
  misc_feature (59)..(59): n is a, c, g, or t
agccggaagaggagaccggttccngaggacttgagaaagaccccctccagggggcgccntggcaagtgcttgtgcccacgtccgcccaggacccagccgtgttgagtgaagctcttggggccagcgtcgtcctgaccgcacaggagagagctgaaggtgggtgcccaggccagggtgtgaactttctcccatggtttagtctctgacgcgcactgggccggaagttcaactgagtgcagtgcaggtggattccctcagcagcctgtgtgttgtgtgaaataaattggacttgaaacaaaaa

SEQ ID NO: 538363 - DNA, 165 bp, Homo sapiens
aacgagatccgatagtctcccatctgacaggtgtgagacaagatcccctcttgcaggcaaatgactgcctcattcacaaatctatgtcaacaggcggaactggatgtctacgatctgatgagacattcagacttaggaggcagacttcagactcgactaaaatac

SEQ ID NO: 538364 - DNA, 296 bp, Homo sapiens
  misc_feature (140)..(140): n is a, c, g, or t
tccccaaaaggggggggggggggggggggggggggttttttttaacaaaccctttttttttacccccccgatccccggggggccccccccccctttttttttcccccttttaaaaacccgggggggttccccccccccgnttttttttttgggggggggggggggtaacttttttcccccgggacccccttttcccctttggccttttttgggggcccttttaacccgtttttttccaaaaaacgggggggggcggggcggggttttccggggtttttttccccccccggccccca

SEQ ID NO: 538365 - DNA, 563 bp, Homo sapiens
accaagatgggatatactgcttttttcagatgagtgaggggagacgatttcctgagacatcaagatttttcttgatgttagaatgagattttttttttaatggtaaaattagttgacttgtaagaatgatactgtcatgagtttttgacctaaattcttggagcctgtcactgctgtcattggctaggataattgtcatagggatatgtgtaactttaaggcctttgatatgtattatcaggagcctgctccaatttgaattatgttttccctgccaagtgcagcttttcttggtacaaatttctacttgctgtttagatttttgagtaacagcagtgagaaagtaacaaaaacaagccgcaattgggaatcaggtcagtcctacaggtattgtgttactactttgtggactttgtcctcaaaaattgtgctgaagtcctatattgacctactttctagacattggttatccattcctgcatgatttttaaataatattttctgtgattgatgaataaactactcccctttttactagaacaaaatgttcaaaaatgaaaaaa

SEQ ID NO: 538366 - DNA, 1053 bp, Homo sapiens
gtggtgggtggtgtccctgggtgctcgttgccgtgttgtggtgtggcgctggtgcttttttgagttccggttttcccgtttagtgtgtcttctgatggtataccggtttcgggttatttctcgttctgtgcgtgtgatggtgtctccgtgagtgttacccctttgtctctttggaggcgtgtatttctggtgtaggatatgcccgttggggtgcttgttcatgccgggagagccgcccggcccttaacggcgctgcgccagtggggtggcgcttgcttcgctgctgcagcacccgtcgcctcgtacgcacaagcccaggaggctgcgtatagcacagcagccacctcggttacagccaccatccgctctgaatggcacgagtgacacctggtaccaggagctcaaggccatcattcgagagcagcagagcgcggcccatctggacggcggaagatcagctggatggctccttggaggacaacctagacctccctcaccacggcctggccgacagctgccgctgactctcagctgcgacagccgcgttaacacgcgactaccgagatcggatcggcgagggcggcgcgtatcaccggatggtcgagggctacacagacggcgtaggagggggccctaacgcggaatgtggatgatgagcccccgggctccaggccctggccacggtgccgtcggagacccgtgacaggacagactgagtcacgcagaggcccgagggagtcgtgggagaactctgcggcctcaatgcaggagggcccaaggtaggacagccgccacccaccagggaccagtggcgacaggacaagcaatgcgaacgcgtatgaacgggaagccactgaagaataaagtttagtgcgagtacatgatgcggagtcctccgatgaagacggctatgactggggtccggccactgacctgtgacctctcgaaggctgccagactggtccgtcctccttctccctcctggggctggacttcagtttcccatacagaacccacaaccgtaatatcctccgcctgtcttaatacagaatc

SEQ ID NO: 538367 - DNA, 641 bp, Homo sapiens
ccccgcatttttgtataatggcgattctcagcgaatttatttcccgttgtgcgcccctcttcccacaccagtcactcttctgcatgttccccccggatactcccgcaaacatttgttttcacccgcggcccgctgaacacaacctatcatttgtcaccccccctctttgaatagcaatatttttaaagaatatgtatccccctcctcccttatatgaagaaatggggcccgcagacaaggcgcccccgcgagacaataagtacactgtgggaagagggccgtgttgaaaacgagtgtcgttgacacacacccgcgaggtgtgttggttgaccgcgggtcctctccccatctggcgccggtctctttctaccagcaagtgcgaccacgacttctctagggatagattaataataattattgcgaccccacttttactattcttagaacagggcttatcccagcattacttgttcaagcccctctctaccccccttcttctatttgtcgtccccgagagtcatagacataatagaagaacacgtcttcttcgggtgggggctgtttaggaacagcgagccctgtgtactcctcctccctgacacccaaatattgatagggcggccccaacataatacgaaaaa

SEQ ID NO: 538368 - DNA, 153 bp, Homo sapiens
tcgctttggaatgcggcatatgaagacacctgctctagtatgacgctctgagctacaagcttccactgaaggggctgggaccctgacgagcacttctctatatggagatcatctgctccagaagccaaccgaggagctgcaggaagattcaca

SEQ ID NO: 538369 - DNA, 211 bp, Homo sapiens
gttacccgcagtctgtgatccatgactgggctacctcttcctacatgatgagccctgagcgcttcgcaagtggaatgtgacgtccctggagaccctgaaggctttgcttgccgtcaccaaagggcacgaaatgagtcctcaggtaggcacccatgatcgaccgcctttgtgaaggtgaaggggccacgctagacataagataccctaagac

SEQ ID NO: 538370 - DNA, 205 bp, Homo sapiens
gtgatgggaacatgcttgtgaactgcgtaacacatctactttgtgtatgtgtctgtttatgggggtggtttatcatttttgctggtccctagaccactttgtatgaccgattgcagtctgagcaggccaagggctgaacagctaatgtcaggaccctcagcggtggagcctactggggggaccagctgactcttggacaagtggc

SEQ ID NO: 538371 - DNA, 106 bp, Homo sapiens
atctagaggatcccaacaaactgaacggtaatgtacgcttcattcattgccccacaatcctaggcctacccgccgcagtactgatcattcggatgtccccctctat

SEQ ID NO: 538372 - DNA, 509 bp, Homo sapiens
tggtccgcaggctggagcggctcgaccacctggcagttgtgttccggcagaaggcctccatccacgaggggtggactgacgggaaggaagccatgctgaagcaccgagactacgagacggccacactatcggacatcaaagccctcattcgcaagcacgaggccttcgagagcgacctggctgcgcaccaggaccgcgtggagcagatcgccgccattgcccaggagctcaacgagctggattactacgactcccacgatgtcaacacccggtgccagaagatctgtgaccagtgggacgccctcggctctctgacacatagtcgcaggggagccctggagaaaacagagaagcagctggaggccatcgaccagctgcacctggaatacgccaagcgcgcggccctcttcaacaactggatggagagcgccatggaggacctccaggacatgctcatcgtccataccatcgaggagattgagggcctgatctcagcccatgaccagttc

SEQ ID NO: 538373 - DNA, 252 bp, Homo sapiens
agctcccaacaaagagtcttcaaaagattgttctagctttattactagaagcttctagtacttgagtgtctggtctaggagattgtgttggttgttcactgattcaatggtcttgttgggagcttaagctccagacagagaggtctctggataagctgtgctccctgacaatccctttcctttaatgggaaaaggggaacctggtcttaagatgcatacctaatatcagactttaatccttaaaagcaagat

SEQ ID NO: 538374 - DNA, 411 bp, Homo sapiens
tcttggcttgtaggccgagtggctttaccccttaagccccagccccagctcaagcagtgaatgaaccgctgtctttcagctttagaaaatgtagggaaatgaaacaagctctgaaccccatgtgatggtacttgcttcctttgcttagtatctcagtactcaggaggcagaggcaggaggatggccagaaattgaaggtggtttccaggccacctaaaactatatagtaagagcttgcctcaaataaaaaaaaaaaaaaaaaaaaaaagggaaagaaaaaaaaagaaaaaaccaggtgggtgttggtgcagttttaatcccagcactcgggaagtagaagcaggcctatgctgtgaggtggaagccagccagttctaggacagccaaggacacacagagaaacccgcctct

SEQ ID NO: 538375 - DNA, 132 bp, Homo sapiens
attttatttttttttaaaaccctggagcttctggttcctatcagttcctgttgttaatcgtaaaaccgttgtcccttcccccattcccggatccatcatgttctttttcttttaaaaatcaaaataaaggta

SEQ ID NO: 538376 - DNA, 791 bp, Homo sapiens
  misc_feature (307)..(307): n is a, c, g, or t
  misc_feature (707)..(707): n is a, c, g, or t
  misc_feature (723)..(723): n is a, c, g, or t
  misc_feature (729)..(729): n is a, c, g, or t
  misc_feature (731)..(731): n is a, c, g, or t
cgaccacgcgtcggtctttgagataattgtttttacctgtattgccctttatcttttttaggtaattcttgtactcctgctgtctacctctcctcacaccccagcaccccccattttttcaaaccttggtatctgtgggtgaacagtataatcttttcatctgcttttagaatgtgggatatttccagtacctacttttttttttttttttggctgaatccaaagatttttaaattaaaatatttttttttttataaagatcagaaagtgatattaagggagatacattgtttcttcctttaaaaantaaacgggaagttacttgggtaagtggtccatatttatgatgccatttttctaaacgtgcttcgggatggaagggtgtaaatttcaataacggggctacttagttatcagatattaatatcggagggtgagtggggggtatctatataaggggtagggtattacagaagataatgggctggatgtcctagaagttcttggatccagagggtgggtgcagctgaaagtaaccagatggtttgccagttacttgtttgcctgcccagttccccttttatattggcagaagctgtgagtttggtcccacaattaggtccctaggagcaaaacctcaggatggatttatggtttctcaacctccaaggcacactgttaataaccgacagggggtgtctctctcnttcaatatatggggtngaagantnaatttggagcatttttaattcccccagaatggcttaaccttggaaaggaatcagttcaca

SEQ ID NO: 538377 - DNA, 488 bp, Homo sapiens
gaggtaggacagcagatgatccaaacctctcgggcccacctcccagcctagggctctttccggggccacccgtccacctctcccatcaaattaaatcactttcctacacctgacagcagcccatggtcataaagcaagtaacaagccgaaggtcggtgtgggaggtggattggggaacacgggatgtccttaatggtggaaagaaccaggaaaactccatccagatgccagggagataccaggggtggccacgaggccaggtgacccaggaagaacttcgtctccttcaatcaccgggtccctttctggtggggcacggggtaggggcggagaaaatccagctggtactggctgatgacgcagaggtcaaggtggcttccggagcccaggtcgttgaagatgccagaggcgatgggttcgctcaccagattctgggcttcctcctcctgagaaccagaaggggggcaatacggtcccggggcaaacta

SEQ ID NO: 538378 - DNA, 178 bp, Homo sapiens
ggacttagcacacgccgaaagcccatacccccacgttagacgctcgaaatcccagtggagcgcagttgttgcgcaacaactctcgtccattcggatctgtgtggactctcggcgtgtgcatgcacacgccaagcatccatacacttcttgaagtcaagtcatatggacgaagttgttg

SEQ ID NO: 538379 - DNA, 199 bp, Homo sapiens
tcatggacacttaggtagcttacaaatcctgactattgtgaatagtgctgcaataaacataagagtgcagatattcctttaatatacttatttcctttcttttgggtatacaactagcaatgggattgctggatcatatagaagttccatttttagtttttgcagatcttactgagaattgtatctcaaaaatatagtc

SEQ ID NO: 538380 - DNA, 291 bp, Homo sapiens
  misc_feature (32)..(32): n is a, c, g, or t
gagcagcttcggacacaagcagcctgtcctgnctaagctttagccctgtcccacttcacgtggttctcagcgggctcgatggaatgtctgtagctcaccacaattctgcttccatttgtctttcaattcaacgtcagggtggggggagctggtgctgtgccaatcacagggagaagagcgtgagttcccacgtatataattccttggcgtgcgccttggataaagggttcacagctcctgtacacccctgtcagggcaggctcttttccattgccccgtggttcaaggccc

SEQ ID NO: 538381 - DNA, 194 bp, Homo sapiens
ggacggagggcctgctcatggtctgcatgttgtactgaataatgtcttctctaaaccaacgactttccacctcaatgctgaaccaaccagcattactacacctgaagagcaatgctgataatcactgccccttgagacagcagaatgccctttgcatgagagagactggctgggcggccagctggggaagcatt

SEQ ID NO: 538382 - DNA, 102 bp, Homo sapiens
acgtagcccagcgtaacgtagcttactgatgggcccggacgaggccctcaaaaccgtggaaatgatcagaccccacatatgcgacagacagagaatgaaaaa

SEQ ID NO: 538383 - DNA, 174 bp, Homo sapiens
ccgttactctgagactcctagacgaccgtttgactacgctcttgacataagactataggtgagacagcggctggggtagatggggctgaggcgctcaacgaaggatgtcacgggctccatatttctccatccagagctctggattttcgagacttcctgctcaagccagatttg

SEQ ID NO: 538384 - DNA, 558 bp, Homo sapiens
  misc_feature (147)..(147): n is a, c, g, or t
  misc_feature (149)..(149): n is a, c, g, or t
  misc_feature (234)..(234): n is a, c, g, or t
  misc_feature (361)..(361): n is a, c, g, or t
  misc_feature (430)..(432): n is a, c, g, or t
ctgctgggacttatggacgttcttctcaaccactgcacctggcctgaaatagttttaatgtgttgtatccttgtccccctctttgaaagcttatatcccaaaaacagaaatgaatcaaactcaagtcttgctttcaagtagctgaantncccaggcctgacttctcttgccagctcttttagtttgtgctttatgacagtgagctgtttgtattccttctacacctgtttcttnacctgcaagctaggcatgataaagtcatatttgtgtccttcctggcacagtgcctggcaatattgtgcccttgaatgtctgttgaatgaattattgaacaatgtgagacaaactctggaagaagttnggtccaagagacaaagcgtagtggacagaggttttggagcatcagacctgagcaagccagggggatccnnnataaggtgggctcttcatctaggaaggactgagctgccaaacaggttatggtcaagggtcagctggctgcaaggaggagaatgagacccagtagcagagcaagaattaacacaagattaaaatgcc

SEQ ID NO: 538385 - DNA, 172 bp, Homo sapiens
tgtggagtaatacgcgtcgttaagtagaggttaacgagggtgatgtggctatatggtgggtattataggcttttgttttttgtgaattcttcgcatcatgcccattttggcaataagccggttcgcgggggcaggcctcctctggagaggagggtggatcgaattcagggtg

SEQ ID NO: 538386 - DNA, 531 bp, Homo sapiens
agttgatttcagtgatgctcagtgtcgtggtcgggtttctttgaaatcttgatctgccacttgcacctaactgtagtacctatagggtaggttcctaacacattctgtggcctcaatttcaccattcttccaagtgggaataataatagtacctaccaccacaacagtatgaatgatgcatgtaactggttaaaagcagtggcacaggccaggtgtggaggctcatgcctgtaatcctagcacattgggaggccaaagcaggcagatcgcttgagcttacgagttcgagaccggcctgagcaacatgacaaaacccagtctctacataaaataccataaaaaaagggaaagctaggtgtggcagcgcatgcctttgatccccagctacttgggaggctgaggttagaggattgcttaagcccaggagcttcaggctgcagtgaaccagggttgcccattgcacctcagcctggacaacaaagcaggaccctaatcccccgaaaaaaaggcagtgcaggtagtacagtgctt

SEQ ID NO: 538387 - DNA, 177 bp, Homo sapiens
aggatcccccgtgatacgtcgcccggacggatgcgctgcaggtgcggtttcaacgggatgacgcccgcaatcccttcgcgcgtgttggcgatctggagcgccgccagctgtccgcactgcttggcgtcgacacatacgggtagtcgaggccgcgcaagcgaacggcgccgtcttcgt

SEQ ID NO: 538388 - DNA, 190 bp, Homo sapiens
  misc_feature (19)..(19): n is a, c, g, or t
  misc_feature (55)..(55): n is a, c, g, or t
  misc_feature (111)..(111): n is a, c, g, or t
  misc_feature (121)..(121): n is a, c, g, or t
aatacaataaaatgatacnggagattaaagatgaaatgaccgttttaggaaaaanccaagctgacctgatagagcagaaaaaaatcacttcaagaatttcagaatacaatnacaagtattnacagcagaatcaaccaagctgaggaaagaatctcagcttgaagaaaagttctctgacataactcagacc

SEQ ID NO: 538389 - DNA, 803 bp, Homo sapiens
ggaaaaaaaaaaaaacctctttgaaaagtaataattataacctaaatagtctaggaaaaaatgtcccagttaattggatcctgctatgtggtttaacccccaatatggtgtcattcatgggtcgtttggaaaaatcctaacggctttaaattatgctggtttaaccatctgctttggaggaacaatgtatttttttccctgggatatgatacttataaaatatcctatctggggctagagtgccaggaagctaccatgcttaggtaataaccccaattatctggctaataaacggcacctagaatttgaccccctgttgggcagaatatattgggattatttaaaccactaggggggaatttactttaacctctttaagggagttgacatttacaaccaattattacctgattaacttctttattacaacttattacgggtattaggaaataactctcaatattctcctctttttaacgctaataaagttaagtgcttcggaatttatcatgagaaaaagggttttcagcacattacttgaggcggcttaaacccccacggatctctcgtgatatatacattgtcgggttccccaactgccaaacgcatgattgtgatcgatagcatattggctggtccccaatgcccagggatatgacatggtgatatccctcaaattatggtgtacaatgctcggaacacatattggatcctataatgtgctccacgcagaagtgttaggggcggctaaaggtgaataagtcatcggaaatgatcgggtacaaccattaagtccgtaagat

SEQ ID NO: 538390 - DNA, 130 bp, Homo sapiens
ctgaggatacgacaacatagaatgaaatcccccaagatgcagctgctcattgtcagattattaatcaaccctgctgctgacctggaatctatcaactagtaagcattgattttaaaaataaataaggcat

SEQ ID NO: 538391 - DNA, 492 bp, Homo sapiens
cccacggggataacatcactcagatctgctccagcctggggccctcagaggctgccttctctccactgttctcaagtcctcacctcacaacttctctctacacagggcttggtggactccctctccgacctccgagacatatgcatagataaccccagactctgatagattccagctggagcacagggcttatcatccctaggactcccgtctctgatccatcaaaacctctccttcctcctcactgtctggcaatgcccagactctggtccgcgctgtggcctgtggatcctgggtgcggagtgggactggagcagccaccaagctgagcatgctggaaccatacccacaggcttcagcctcagtccaacagcagctcgtgaggctggacctccctctctgactcctctaaagcttttgcattccataaagcccctaggcaggcccatgccctgggatacttccaaaccgacacttgttctcctgagtccc

SEQ ID NO: 538392 - DNA, 285 bp, Homo sapiens
actgtactccagtccagggtgacggagcaaacctccatctcaaaaaaaaataaaaataaaaaataaaaaatgagagagagaatattctaaagcaaatgctattccaggccagagagagagagacagagaatattctaaagcaaatgctattccaggccaggtgtgttggctcacgcctataatcccagcactttaagagcctgtggcgggcggatcacctgaggtcaggagttctagaccagactggccaacatggtaaaagcccgtctccagaaaaatacaaaa

SEQ ID NO: 538393 - DNA, 285 bp, Homo sapiens
gactggtactagcagaacaagtatgactctgaccgagagggacgcgatgccacgggagatggaaccaaagagaaaccatatacaacaggtctacacggctttgatgacagtagggaacaagaaccatttcctaccatttacgtagcttcacaaacagaacatgagaggtggcctgttatttctacaaatcagagattgacagaaccattaaaacagatgtggcactacgggaaccaaactgaagacgtgacactccctgggacaaagacaacgacggcagacacg

SEQ ID NO: 538394 - DNA, 340 bp, Homo sapiens
aatacatctacaatatatcaagggcaatgtattagatatgtatcatttctcctgctcttcatttgctcgctcaagttttaacttttcctctagcacagcttcccttcaggttgaagaacttccattagtatttctttaagagcagagctcctgtaaatgaagcctcttggttttccatcacctgaaaatatctgtattcagctttcactcccaaagatatattttttctggatatacaattctgggtggatagttcttaatttcgtccagcattctaaagacggggtttcactgtcttcgtctttggccaccatggttgtgtatgagacatggacagtca

SEQ ID NO: 538395 - DNA, 147 bp, Homo sapiens
ggaaccagagaggaaccaagaagggaagaagaccagagcaagcaagcaagtggatttgcttccttgacgacgcagattgaagttcttcttcaacaacaaccttaagtttcttctttttattggattccagttctaagtcaagaccag

SEQ ID NO: 538396 - DNA, 423 bp, Homo sapiens
  misc_feature (32)..(32): n is a, c, g, or t
tggtatgaggtgttatttttttggaaattttngtgttatgagagttaagtggaggaagaagtgaatgtgtaggttgaagtgtaaaagaagaaagatgaggtagaggtttaagtaaattgttagtttgttgtattgtggaggttataggagtagaaatatggaatgttagatgttggggatgttggtataagttgtgggattgtatgttattgtttagagtttgttttaatggatttagaattttattgttttttgattgttgattatttttgagatttattttgtttataaataaaatgtttatgttggttttttgttttggatttgtgatattttggattatttttgtgtttatttgtggttgagtgtaataattatataataaattattttttttgttgttttagttgaagaattaaatta

SEQ ID NO: 538397 - DNA, 437 bp, Homo sapiens
  misc_feature (33)..(33): n is a, c, g, or t
  misc_feature (157)..(157): n is a, c, g, or t
  misc_feature (163)..(163): n is a, c, g, or t
  misc_feature (224)..(224): n is a, c, g, or t
  misc_feature (259)..(259): n is a, c, g, or t
  misc_feature (274)..(274): n is a, c, g, or t
  misc_feature (311)..(311): n is a, c, g, or t
  misc_feature (324)..(324): n is a, c, g, or t
  misc_feature (340)..(340): n is a, c, g, or t
  misc_feature (342)..(342): n is a, c, g, or t
  misc_feature (352)..(353): n is a, c, g, or t
  misc_feature (358)..(358): n is a, c, g, or t
ccctttttgaggtgtcagagcttgccaagtttnacaccgccttcagtaccgaactgctatacaagaacattataaaatacaaagtataaactacatgataatcctctttacagaattcagattagtgcattatcacaacattgctttaaaaagggangtgagnttactggcaaacctccaattgcttttttaatgaaggatgacacaaaatggcacgcaaggtnaacactaaattttgtcgggtgctcaaaaactgttnattgtgggaaagttnctttccaaaagtaattttgaccttaaaatattaaccnttattctttaagncataaaggatggtaantnatggcccccnnaaccnggtgatatggttaaggtaactagtttagtggggtaacaaactggggtcttaagaatccgtatcgcccttgcgttttggt

SEQ ID NO: 538398 - DNA, 145 bp, Homo sapiens
cgaaagccgatcatacactatctttcctagtgcttccctaactagctgtgactacaggcactgtgccaccacacctggctcattttttattttaattacttttgggaagaaacagggtccccaccatgttgtccggggatgggtc

SEQ ID NO: 538399 - DNA, 224 bp, Homo sapiens
gggaattgtgcccgtgaatttaacaaggattgatgggcattgccatcttgtctttttttttttaaacagagtctcactctgtcgccgaggctggagtgcagtggcacgatctcggctcactgcaacctctgtctcctgggttcacacgattctcctgcctcagcctcccgagtagctggtattataggcgcccaccaccacacccggctaatttgtgtcttttt

SEQ ID NO: 538400 - DNA, 196 bp, Homo sapiens
  misc_feature (164)..(164): n is a, c, g, or t
tgggcctgtcccaggacagccccggtctgtgatcgcctttggtgtgccctgggggcatgcgcgtgcagtgcgtgtgcatggccaggaatgggatactggcattcgaggtcacgcagtgcgtgggctttacacgcaggcgtcacggtccacccgtctcgactccngtgtgtctcgagcatgaggcttccggcgcctc

SEQ ID NO: 538401 - DNA, 183 bp, Homo sapiens
caatatcaaagacattctgcacagaaagaggaaaaaaatcctaaaatttatactggaaccacaataagaccaagaatagccaaacgcaatcctgagcaaacagcacatcaacagctggaggccatcaccattcacctgacttccacattcatctcacaacagtgcatcagtcaaacacaaaca

SEQ ID NO: 538402 - DNA, 319 bp, Homo sapiens
ccctgtgtgtgcacaataaggaagggtccccaggttgtagaagccccaagttgagaacaataatgaacaattattgtatgaacaattgttagagacagctaatcacaaacaacctgcgggcacaatgacctcattccacacgtagcacccttcagcaggaccctataaactttcctccagccctgcctctttgcaggtgccccttctctgctgagctgcccactgcaacatattttcacaatttctctaataaatctgcccttctttacctacaactatcttggtagatggctttaccacctgcaaaactgaccctagg

SEQ ID NO: 538403 - DNA, 340 bp, Homo sapiens
  misc_feature (22)..(23): n is a, c, g, or t
  misc_feature (25)..(25): n is a, c, g, or t
  misc_feature (94)..(94): n is a, c, g, or t
  misc_feature (129)..(130): n is a, c, g, or t
  misc_feature (163)..(163): n is a, c, g, or t
  misc_feature (181)..(181): n is a, c, g, or t
  misc_feature (290)..(290): n is a, c, g, or t
  misc_feature (325)..(325): n is a, c, g, or t
cgcaggagccgcagggccgtanngnccatggcgcccagcggatatggagtggtcttgaagccccacttccacaaggactggcagcggcgcgttngccacgtggttcaaccagccggcccgtaagatccnnatacgtaaggcccggcaagccaaggcgcgccgnattcgccccgtgccccgntgcgggtgcccatccggcccatcgtgcgctgccccacggttcggtaccacacgaaggtgcgcgccggccgggctttcagcctgggaggagctcagggtggccggcattnacaagaaggtggcccggaccatcggcatttctgtngatccgaggaggcgg

SEQ ID NO: 538404 - DNA, 165 bp, Homo sapiens
gtctcatccacctgaggatcgatcagtcgaattattttcagaggcacatttttcacgttataactgcatcttcattttagtcgtgcaaccctcttcacgtacagtcgactttccaacacctagctcgaacctcaataacgacagggtaccgacgctcgaaattcg

SEQ ID NO: 538405 - DNA, 238 bp, Homo sapiens
gttctcacaattctccgtgggactgggctgaggcaggggcttcgctctattctccctaaccagtacatgtcttccgtttcccccttggcacttagcagttatcccgccgcagctatgcctttctactccatccctcccttgtcccgtggctatatattgtgccttatttaatagctggcaaatatggacacttaaactatcagaagtgaaccacagtaaagattaaactgcagaaaag

SEQ ID NO: 538406 - DNA, 573 bp, Homo sapiens
  misc_feature (311)..(311): n is a, c, g, or t
tcatttcttcctaatctgatgatcttgattctttttgattaacatgaaaaatcctgtctgcttgttttgggaaaaaaaaatgctttttttctcttctagctctcctgtgtgacttttaggcatgtcatttcaccttgtctgggtgtcaggtcattcacctgtaaaatgagttggcttaaatatctccgagattccttggaaatttctactatttgcactatagtgaggattttaataatgacatgacttctcttttcattaattttgtccttcattctgaggtataaagatagtttaaagggtaagtttgnagatgggtaaatgtgcaatatttgttagcttctgtcctaagaatatttggattcatgactagagctagttgattctattaccttttgagtgagaaacgttagacagcatgattaagaatttagcaaatcctttctcatcaccataacttagctgagttgtaaggaaatccttttgagaatatggcattttgttttagtgattacaaccttgttaccagaatggagctttttacttgacaccattaaaaatatcagtatggac

SEQ ID NO: 538407 - DNA, 329 bp, Homo sapiens
  misc_feature (200)..(200): n is a, c, g, or t
  misc_feature (207)..(207): n is a, c, g, or t
  misc_feature (217)..(217): n is a, c, g, or t
  misc_feature (221)..(221): n is a, c, g, or t
  misc_feature (238)..(238): n is a, c, g, or t
cacactcccataaccttgcgtcccacttggaataatgcgcgataattgggtaattacttgggcgccgtatcctccattatcaaattcatacaacgtattattgcctgaagtcgtaattttttgtgctgtcatgattttggttaacacaatggtcatcgcttggtcatcgtcaacagttacaaacgccggccccaaaccgncaatggnatgttctggngccncagttgcctgttgccanggttggtgggccttgtaacgggttttgttgtgggttggttcatcagcaatcagcgcatagcgttggccatcaaaatcataggaattaaggt

SEQ ID NO: 538408 - DNA, 165 bp, Homo sapiens
  misc_feature (6)..(6): n is a, c, g, or t
  misc_feature (29)..(29): n is a, c, g, or t
  misc_feature (50)..(50): n is a, c, g, or t
ggggtncattcgcgtacgaggtgggatgncggaacctacagaccaggggnagtagtgggggagccggctccggtagatgtcctcgtccttctcgaggaacacgcagatgatcagccggtccacttgtcctgtgtgtccagccatctcgcagcgtggccagccgtt

SEQ ID NO: 538409 - DNA, 341 bp, Homo sapiens
cgccctgggggttttccggacccccgcggggtttggagccccccaaatatgggtgggttttggggtttttccccctaatcccccgggggggaaaacccttttttttttttcgccccggggttgggtttggcccccccggccccggggggcccatagaccccttccccggggttgaaggggccccggggaaaacccccggttgggtttttgggttgggttgggttggcctttgggttaacccggtttttagggggggcgggttttgggggttttggccaatcccccccccccaattttcctggggttttaaaaataaagggggtcccccctttttttttgga

SEQ ID NO: 538410 - DNA, 152 bp, Homo sapiens
aagacactatctttcacttgggagaagccttgagaagggccgtgatagacctggatgtcttcctaagcatgtacgtcttctgtccgtaacagtccagctgaggcactatgcaaaagcaggaagacttccggtctcagtaccttactgactct

SEQ ID NO: 538411 - DNA, 141 bp, Homo sapiens
aacaccagcttccagattcaagcgactctccggcctcagccacccgagcagctgggattacccgccaccacatctggttaaattttttggtatttttacgtagagctgagtttggctgtgtttaccggctgtggggtaccg

SEQ ID NO: 538412 - DNA, 329 bp, Homo sapiens
caattttaaaataagcaaataaataaggttctgtgtcaattaaataaaagttctctcaccatccagtcatcttaaccatatacgcccatgggtctcttatccacccatagacttagtggtggcagcagggttggtaggaagggagtggcaagggctctccactcaccggcccagaccccagattcttggcctcacagcatcagggtgtcagggctttcagctctgctcggtctccgtctcgactgaaacccatccccgtcttgcctggccgccgccgccggccgcagggcacgggtccggcgccagcgcggcggcctgttccgggcgtg

SEQ ID NO: 538413 - DNA, 197 bp, Homo sapiens
ggttatgtatggactgggatataatatcttcattaattatttttataatatatgacatttctgttgtaagtacataagtaaatgtgtgtgtatgcacacaatatatatgtgttataaaaatggattaatttatgatttcaaatatggagtatttattgagcatccattatagtccaaccatggttctaggattgggg

SEQ ID NO: 538414 - DNA, 526 bp, Homo sapiens
gaatatcgacaagatgaaagatcaagaaattggaaaactattgaaagatctcagctcaaagtttaaagaaatttaatgaaacccaagcagaataagtacaaagaagactacacacatgcatgttgatatagtttggatatgggtcctctgaaatctcatgttgaaatgtgatccccaatgttggaggtgtgacctagtgggagatgtttgggtcatgggagtggatccctcatgaatggcttggtgccatccccttcatgattagtgagtttttgctctatttgttcacgtaagaactggttgtttaaagagcctagcacctccttcctgcctccctcttgctctgtctcaccatgttgacatgcctgctctgcgttggccttccgctacaagtaaaatcttcctgagacttcaccagaagctgagctcatgtcggtgctatgctgtcagagcctgcagaaccatgagccaaataaaacacttttctttataaattctcatctcagatattcctttataaacaatg

SEQ ID NO: 538415 - DNA, 554 bp, Homo sapiens
  misc_feature (29)..(29): n is a, c, g, or t
  misc_feature (43)..(43): n is a, c, g, or t
  misc_feature (57)..(57): n is a, c, g, or t
  misc_feature (61)..(61): n is a, c, g, or t
  misc_feature (109)..(109): n is a, c, g, or t
  misc_feature (140)..(141): n is a, c, g, or t
  misc_feature (206)..(206): n is a, c, g, or t
  misc_feature (221)..(221): n is a, c, g, or t
  misc_feature (231)..(231): n is a, c, g, or t
  misc_feature (262)..(262): n is a, c, g, or t
  misc_feature (266)..(266): n is a, c, g, or t
ggaaagttcaccctggttagttcccaagnggatttcataactnggaggggaaacccntacnaaatgtataggagtgtggaaaagcctttccagccagagattcaaattntttgtttcaaacattcagagggatttcatanntggagaaaaacccctatggaatgtaagggaatgttagggaaagctttcagttcagaatgcacacntagttcaacatgtgngagttcatantggagagaaaccttacgaatgtaaggtatgncganaagccttcagccagtttgcctaccttgctcaacatcagagagttcacacgggagagaaaccctatgaatgtatcgaatgtgggaaagcatttagcaacagatcatccattgctcaacaccagagagttcatacaggagagaaaccctatggatgtaatgtctgtgggaaagcatttagccttcgtgcatactttactgtacatcagagaatacatactggagagagaccctatgaatgtaaggaatgtgggaaggcctttagccagtttctgttgcttttttccaaga

SEQ ID NO: 538416 - DNA, 223 bp, Homo sapiens
gcatccaacctccatctttgtctctccttctttgcgatttttgcatatagtctcctcagttgcttctctcacttttggcaagtcctaatatgttttcttaatttctgagtacatccttaatgtccctctcagaacatttttccagatttccctttggaggcttcccctgtatagcctaacctttcatagtgatggatacatattctttgggcacggaagatca

SEQ ID NO: 538417 - DNA, 361 bp, Homo sapiens
cgaggagccccaacgcgctgatagcctcccccttctccctcatttgtttagtaccatgagggactcatattcctaccgttttttttttggagagggagttcgctcttgttgcccaggctgaaatgcaagggcatgaccttggttaactgaaacctttgcctcccaagttaaaggggttctcctgcctgggcctcccgagtggctgagattacaggtatgcgctaccacgcccggctaattttgcattttggggggagacggggttcctccatgttggccagacgggccttgtaggagaaatagactccactaaaatattacagccaattggtaaaaataagacgagaaatcgcaacacctt

SEQ ID NO: 538418 - DNA, 234 bp, Homo sapiens
cgtattagcacaagtatccatattgaagatactgagagacaggtttaaggaagtgaggtttcgggctagagcttgtacaaagaaatgagggctatccctgaagccctgagggaggacagtccatgtgagttgttgtgactggagggtgtcagggtcagtccaggtgaaagcaaataggttttgggaatcagagtgtagggaacatggtacagaaggcatcctccatggtgctga

SEQ ID NO: 538419 - DNA, 576 bp, Homo sapiens
gccgcccgtccaagagtgggtctttactggattccgatgaagttttattggactgtttgtctttgttctcgtgcctcttgtattctagcatccgcccgttccccttatagcccagtagaccagctgaccccgtccgggagtgacagcgtcatccttggtgataccactacccgtggtgcccagtgatgaagaagatggacagcctcggcgggctgtggaccacgagaaagagggagtccagtatagctactccttattccacctcatgctctgcttggcttccctgtacatcactgatgaccctgacccactggtacaagccctgatgccaagtttcacgagcactgacccgccagtggcccgctgtgtgggtccagatcagctcccgctgggtctgcctcctgctttacgtctggacccttgtggctccaccttgtcctcaccccgtcgggagcttcacgctgaaacctctgagctgcccaggacaccccctggaactccccaaggtctccttccccgaaacccatataccttttaagtttgtttccactaaaatattaagtgaatgctttgcca

SEQ ID NO: 538420 - DNA, 209 bp, Homo sapiens
tgctgtatccttttggttggtttgttttctagaagtacgttcacgatgcttatggggaatgcaatgtatgatatagctagctctctcaccacttagctcactgtgaggataaaatatgcatgcttattgtaattaacctggtgctttgaacatcttttttaagggagaaaaatctcaacccacgttatgctcatccagacaagctgacc

SEQ ID NO: 538421 - DNA, 400 bp, Homo sapiens
  misc_feature (1)..(1): n is a, c, g, or t
  misc_feature (20)..(21): n is a, c, g, or t
  misc_feature (73)..(73): n is a, c, g, or t
naaaaaaaaaaaaaaaaaannaaaaacacactaagcaaaaacaaatcaaatcctatttgcagccgactccaanaggtcatcagccggctggataaacagatgacaaagttcacagcatataaggattaaaagcagatctgcacacgcagtgaaaatatcattgagggcaacaaaatgccattgtgaccttgactggaatgtgtccccattcctactctaccaaacgccccaccgcactctccgcacaaagaacaccccgcatcccctctccaccccgctcctctttgcaaccgtaccgcagccataaagatgaccccgatcctggcaatcacgagccagaaaccaccactgcgcaacaccaacaggcctaccccgccgaaaccacaccacatagcaacca

SEQ ID NO: 538422 - DNA, 440 bp, Homo sapiens
gacggctcaacggaactttatgtgggtgtgttaggtatggatttctctgttgatactgcgtgggatttattggggggggggtgtaaaaagtaaagtggaggttcctcctcaaagactttcctccccatctgattgggaataaatagtgacttctcttaaaaacataacttattcaaagacctgtactaacattcttaaatatctgctagctgtaataaagaaatcaatgtactttatgttcttagctcccacaatttaacctaaatattggcccgggcgtgcttatactggtccaaacaagcattaggtcatagcctgttcctcttccttatgggaaggtgtttttacctttttcaacattccacaagttacttcctccttccttggttctcctctgccttggcctcttttaaaaagttccgttgaagccgtcgggtacc

SEQ ID NO: 538423 - DNA, 1231 bp, Homo sapiens
ggaaacaatggttcatggcgataaacagctggctatttgtatctcaacaactcagattggtcacataaatgccacggcattccgaagtttcgatttcgattaacattgacaggcattactgtgtgtctcaattttttaacaaacctgaacactgtgacttactaggggtttcgtaactttagcacgaactcttacctgggtacgaacaccacttacgacctgacattatatgtacacttctctggacacggtctcaactcctgactatcaaacataactcattgaaactacaattccatttgtacaacagttggtacacgaacaggttactcgcagcattactattggtggatgctggcacccgtgcgacgttgagacaccacaatcaatcttgggccttctgccgtcgcatcggtcaatttccacacgctacatggctaggccggaaggtagcgggccactctaacagacaacttgcacctggttctggggctcgttggccacttttaacaaagtttccatgaagcaccaacattgtcccacaagggactaacctcctgacggacaacactcccgaagttccttggaaattgggaccaactgccttactggtcaggcgcaagaactaacctgcggcttaatagacgcccctttggcaacagcgttccaaaggtgcatcattactacatcaacaacgcaatcaccttgacaccccccttttttgcttaccagccaacgcatcgttcccactacttgtttgacccaattatgcacaactctggaggcatcacagctaacgtgcgacattctacaccttcagcacttgggtgcacccaccgtgcgaggttaaacggacaacaacaagcccggcgggcgtaccacggcaatggaccctcaatctgcgtcaccggcggctacaagcccctgtgacagaacaaatgggcaggagaccaggctcaggcagggacgcgaccactaatctgccccaaacactatgtgacgaggtcggcgcagacggaacacgtggaaccaccgagagttaaaagcgagatagccactgcgtgcccggacaaactggacccacaaggggaacacggaccactccgaacaagaagacacagacgacgcgcgtacgagccgcccaagaagcacggtacagccagcgacatgacgataccaccccataggaggggaccaagcgacgaaaggcaaatggccacaacaagaaacc

SEQ ID NO: 538424 - DNA, 932 bp, Homo sapiens
ctgcgcggttgttctctggacgcggcgtactttaatctccgtccgccttctctcctacctaatgtgcgtgccggcacccgatggaacgcatcagatggacattggacaccgaagcccccttgaggcccccaagaactactcttaatcgagttggtgacactacaaggccgacaaacgcattactcacctttacaggtggacatacactgactgaaacactgagcaccagtatatcattcaaagaaacgggtacagatcaagcgggcctggtgccaccaggatgagtttgcacattgggtggaacgccagatggcacatgacattaacgaagggcaagtcccaatctttacacaggtacacccacatttgggcaaacctatttttgccacacacactggtccttggttacaagacacaaaaggggtaataccccctttaggcagggagccatttggaaaattaaaccacccacaccacaaggtggcttcttaaacggcgcttcggacacggttgatgacgtacccaagcgaccccaaggatgtcaataattaacggctggggaacaaggacaacatttaggataacgaccttgttgagaagggaacaggatttgccaagaatgtccagcgcacagcgatttgcacccaaggtgacgggacgacaattgttgcaacacctccctaaagagatactactcgtgggcaacagacggcgctcttgacccccacataaaaggtctggccatagccaaacggaggtccccaccgaggaaagaagcgaggctataacaaacctttgtcttgggcctgacacttgacacgcaactggagttagacaccacattcaattgaccttggcaccgaatcgactgaaactggcagtacacggcaatggcattcaactgcacctgactagcacatcttcctgatcag

SEQ ID NO: 538425 - DNA, 305 bp, Homo sapiens
aatagctaggtagcacgcgagcccttgccaggtacgacacttagtaggatgccaaagtatttcgggccacgaggggaaaccacctccctattattaggtagttgttcctccagatcgaggactcgttgttggtggctcatttcatttcctcccctttggctcaaaacaagatgaaaaagcgaggtttgctacactaacagcagctgggaaagaagttatgcttgttggaattggtgacaaaatcagaggcatactttataggactcattctgaccaccttctcgtggcattcaaagaagtgggaa

SEQ ID NO: 538426 - DNA, 255 bp, Homo sapiens
ccactccaccttattaccagacaaccttagccaaaccatttacccaattaaggtttaaggcgttagaattgaaacctggcgcaataagtttagtaccgcaagggaaagatgaaaaattttaaccaagcataatttggcaaggcttaacccctatacctgctgcataatgaattaactggaaataactttgcaaggggagccaaagcttaagacccccgcaaccgaggcgagctccctcagaccgacttgaagggc

SEQ ID NO: 538427 - DNA, 409 bp, Homo sapiens
tacatctttatgcatagggtgtatgtaccaggcgacgctatttgtggtagctatagagtctattcttcatgctctggattactcgaacaatgggattatctttcttaaaaacctttggaaaacatgtcactatgtacgacaaatactcagttctattggtggtataaagttagtggtttgagagtatacttccagacttaaatactatgcatttcagtaacatatcttattgtattctgtgcctcattgtgtatcctgatagcaacataaactagagatactaaatgataaaataacatccctatattagcatctttcttttccttttgtgtttgtctaacattttacaatattttcaccaataaaatatggtattacagtttcatcattccttatctgacacccttat

SEQ ID NO: 538428 - DNA, 192 bp, Homo sapiens
ggtcaatccccagaccctatgttgagccaggcctctctcacctctcctactcacttaatgcccgcctgacagaaaccacggccacatttggttcttagaaaccccctgtgaggcgttctcatactctaatgagcaaccgcttccctattgatgtatttatttgtttgtgtgtttcaattggcccttatcgag

SEQ ID NO: 538429 - DNA, 862 bp, Homo sapiens
  misc_feature (82)..(82): n is a, c, g, or t
  misc_feature (90)..(90): n is a, c, g, or t
  misc_feature (97)..(97): n is a, c, g, or t
  misc_feature (100)..(100): n is a, c, g, or t
  misc_feature (103)..(103): n is a, c, g, or t
  misc_feature (141)..(141): n is a, c, g, or t
  misc_feature (166)..(166): n is a, c, g, or t
  misc_feature (172)..(172): n is a, c, g, or t
  misc_feature (183)..(183): n is a, c, g, or t
  misc_feature (194)..(194): n is a, c, g, or t
  misc_feature (208)..(208): n is a, c, g, or t
  misc_feature (210)..(210): n is a, c, g, or t
gtcctcccggggttgtagcggaggaggagcgggcgccatggcggttctactggagaccactttaggcgacgtcgtcatcganttgtaacngaagaanggncgngtgcctgcttgaatttcttgaaactgtgcaaaataaantattacaattattgccttattcacnatgtanagagggatttnatcatacaaantgggatcctacagngnactggccgtggaggaaaatcgtatctttggcaattgtatggtgatcaggcaagctttttgaggcagaaaaagtcccgagaattaagcacaagaagaacggccagtgtccatggtgaactaatggcagtgatcaacatggatctcagtttcttatcaccacaggagaaaatctagatatcttgatggtgtccactacggtgttggtgaggtgacagaaggcatggacataattaagaaacttaactgagacctttgttgacaaggactttgtaccatataaggatatcaggataatcatacggtgatttagatgatccatttgatggacctcctgattattatcctgatcggttaacagaacatacagggaacaatagataggtgtgaataggagcagatgagacatgatgatctcacatgaagaattagtgaggaagttgaaattaaggagaaaggaggtaaatcaggtatactttggcaggtggaacctactgatggaatttaatcgaaatgtgtgtttgtcgtgccggccaagtggtggaaaattataattggcaaagggatttcgaggagagacctgttataggtgaggaggggaataaggttttatacctttacggatagggcattgaatttaaatattaaaaagata

SEQ ID NO: 538430 - DNA, 604 bp, Homo sapiens
ggcctcctcatgggaatgtgtctgggggtcgtgtgtgccacaggggctgcagcgcagagtatgcagattgcctttgtgcccccggctccgcttcctcagtgccctgccggtgtcccttccctggctacccaatgctcaggcatccttgtgacctgtggttcttgggctggtgatggtgcacctgagcaacctgtgcacgggcagcaccatcctggtctcaactccacccaagactggaactccagcgaccccagctacctcccagtgacatgaccctgtctgaccactgccatgctgacctgacaggctccggcttgcccttggacacccacttggtccccttgcttctagtaattctacctctccaggactggcacactagcagccaacacctgactcctcctttgtcagtgacgatccctgactgtgctcaggccctgtcccccagtgcctgtactgtaattcatcccagcttggaggcaagggaggggttttagcttcattgtacctacagggcaggcagaacgcttgatgcccttcaacaacatgcttgcagccctgggggtgtggtgccctggagtgtgctctcctaccaggtgtacag

SEQ ID NO: 538431 - DNA, 227 bp, Homo sapiens
aggatatgcaggcacactgtaccctccctgccaacatgttccagccacacaaggctgtgacagtggacctgtgaaccattatatatccaaactataaagaaacactgctctctgagaaaagacactgcccagtgtgatgaagctccagcccctgttaggtccaaaacccagtccaaactcagtccctttagagagctgctgtgccttgtaagtgtctacctgtgcgt

SEQ ID NO: 538432 - DNA, 448 bp, Homo sapiens
gggctgttggagttgaaggatgtgtcctacaagctgtcttttgctgggtctgttggattattttatttgtattggataggtggtgaggcatagtggagccatgaggagttttaaaaatgagacattacttaacattcatcctgcaaaaataaacaattcagtagtttttagtatattaacaaacttatgcaaccatcattactatctaattccgaaacatttcatcaccccagaagtaaaccctctacccattagctgccactccctgccccatttctccttcccccttagtccctggcaactactgttctattttctgtatctatggatttgtctaatcctgacatttcatataatcatttttcttttcttttttttttggagacaggatctctctctgtcacccaggatggagtacagaggcacaattgcaactccaacagcctct

SEQ ID NO: 538433 - DNA, 403 bp, Homo sapiens
  misc_feature (45)..(45): n is a, c, g, or t
  misc_feature (60)..(60): n is a, c, g, or t
  misc_feature (65)..(65): n is a, c, g, or t
  misc_feature (68)..(68): n is a, c, g, or t
gttcggcacaggcctggagaccgccgggagcccgacttcctggcnctttgcctttgggangcggncanaggaacagcgccaacctctctccacaagccagggaccctacaacccaccgcctcaggccagaaccagcagctgatttagataccatcaagacacctaaaaccttatcatgagccagatgctgtggaagagattctgggagaatcctgaggaccccccagttgcagccatgtcaagactgatgcttgaggaggaccccaactgttcacgaggcaacacccgttcggaacacagccacctatttggggggaaagattcaaggaaggttgttcacagatgggtgggaaggaaaaccttgagggaaagcggggacaaccagttcacatttgagtatttt

SEQ ID NO: 538434 - DNA, 127 bp, Homo sapiens
  misc_feature (125)..(125): n is a, c, g, or t
attcggcactagggcaacctccacctcccagatgcaagcgattcttgtgcctcagcctcccgagtagctgggattaaaggcatgcgccaccacgcccaggagacagcttcccaaggctggaaagnaa

SEQ ID NO: 538435 - DNA, 1099 bp, Homo sapiens
aaaataaatgtgtatgtgtgtacatatatatacacacacatagggcatatattatgcattgtggtgaaaagaattggctagcataggggatttttctgaagcactgcaacaaagtagaaccgtatgcaagaatggcttcagttatcactttctgggtgtctgtatcctaagaatgtttctgaaaagatctaaagcctttggtatcccatatcccaaattcttatgagccactcacagcaggcagcatatgttgaaataagattattgactgggtacacaccgtgcattggccgtcaccagtgtactttatttgttgattaaagttgatctgacttctcagcctcattctggagctaacacaaaatgaaaggcatgaaatccatgaacacattgcttctcggcctttgggctaagatcaacgtgtagaaatccatgaacactaaaggacttcattgattttttcagagagtagaaaacaacttagttttgcttgttttcctgaatgcgtcataggcttgtgagtgagtttgtccattcaattgtgccttcttggtgttatgatgaagatgggggtactctaaggagatcaccagtcgtgtgaggatgcctttaaaaaactattgagcttcaatgggggaagaccaaaagggtcaaaggggccctgaaaagttaccatcggggggaagtcccgaaaagagatgcccggatgagacgctaagatgccaaagaggaaggcggcaaccccgggagagcacacccaagaaaagcataatgcgccaagacccaaagggacttcatccctgtctgcgcccagacacacacagatatcgacagaacaagccgcggggaggaggagcgaaaagaacggccccagtaggatccgcgggcacaacaagcggtacactccgcagcgagaacctagatcggaaaacaacaaacaatattaatgaacaggacggagcgataagagtgacaataacaaacggtgggagactagatattagagagattgatgagaggaaacaccaactcctctgcttctctgtttctcttccttctcctttgctcttagagaaacacagggaacaaacagaaaaaa

SEQ ID NO: 538436 - DNA, 184 bp, Homo sapiens
  misc_feature (107)..(107): n is a, c, g, or t
ctctatgaggatcccagatattccgggatctgagtagtatgaatcagtaccagagcttgaagaacagtgattccacccgaggcaaccacacaacaatgcccagctgnctggcaggcagcttgaaatcagatgatgaaccagtcagtaacagcaaaacagagtctggagtgaaagagaaggcacg

SEQ ID NO: 538437 - DNA, 508 bp, Homo sapiens
  misc_feature (315)..(318): n is a, c, g, or t
  misc_feature (341)..(343): n is a, c, g, or t
  misc_feature (359)..(359): n is a, c, g, or t
  misc_feature (373)..(374): n is a, c, g, or t
  misc_feature (380)..(380): n is a, c, g, or t
  misc_feature (382)..(382): n is a, c, g, or t
atatgtcattccatcagtgaaaaaatattttctcccagggataagaaaggtattctggtaatacattatcatcaatccttaaacagtaacagtcttggcacttatcacaaaaccgacccatttcttataaccagaaagattatcttagactgtccttcacattatactttacctactgccttgtaagaataagagttgctcactgtgtttacttgctgtcctccatattctccattgcaccattggtgtataacgttaagagtttcattgaatattattttaagtattacaaaaggcagcttgcttcttaatttnnnnccccccccccccctctttttttnnnaaaaaatttggggggncccccccaaatttnncccttntnttggggggggtttttgaagaaatttaattttttgatgtaaaaaggaactgttaaaaaagttggaagctttgcccctgtgtatatatatattttagcaataaagcagcatgggctgagaatgcaaaa

SEQ ID NO: 538438 - DNA, 228 bp, Homo sapiens
tgaggatgagctgcaaggagtgagaggggacaaattctcaccttgtaggagcctgcagggtgacgctgatactgagcacgtcccaggggcatgtattggcctgaaggtgcggtggggattgagggctggcgccagccttcctctgcagctgacctctgttgtgctccccttggacggctgagagccccagctgacatgtaaatacagttgttggcctctagcgacccg

SEQ ID NO: 538439 - DNA, 191 bp, Homo sapiens
tgcatcgtgatcaatagttcctccttgggtttgaagtcactgtgggcattgctgacagcgtgcaaccctttcacattatttaatgcgttagaattattatattctgtacattgttgctatctctaaagttgtacaatttatttttcgtcttttggacttaactcctaagatgactcagtattacctagttt

SEQ ID NO: 538440 - DNA, 113 bp, Homo sapiens
ttggttgctagtgattaaatgtctaagcgagggtagggaaggggaatggttgaacctctggagatcatatgtaaccaatcctgctcagatctgtctggggcagcggggtagca

SEQ ID NO: 538441 - DNA, 862 bp, Homo sapiens
agttcaagaccagcctgcccaacatggcaaacctctgtctctactaaaaatacaaaaattacaagagcatggtgacacacgcttgtaatcccagctaccggggtggctgaggcacaaaaatcatttgaacctgggaggcagaggttgcagtgagctgagatcacgccattgcactccagcctgggcaacagaacaagactctgtctaaaaaaaaaaaaaaaaatttagaaaactatttttcaaaaaggccaaaagttcaagggttaagcaaaatttgttaagtaggtcaaacgggaggtgcttcaacctttggattttagccccatatacctggttatttcccccaaagtgcctccctcaataaacgggcatctagtagtcttagacccttatcaaaacctggtaaaggaaacaagtggaatctcatactaaagtttaaataaacagctagtcttggagtgagatacacactcacaagaatgtcttaaagagataagctaccagtagaaagagatgtcttccgctatccacctcaggacctgaatagcctaaatataccatggtggtttgtccccggtggggcactgggaccaaagctggaaatcttcgaattagtcaggggcttcacaggagttccgggccgtcgaaagggcttatcccagccggactgtaatggacacattcttgaacgcatactatcgctaagggaacaggcccaaaatggaggcacttcggaagtcttagacactaaacacggggggggggaccgatccactgagggagaaagatggttgacggcatggcctaaaaagggggtcccgggaaaacaggatggggacacacaagcgttgatggaggctat

SEQ ID NO: 538442 - DNA, 623 bp, Homo sapiens
  misc_feature (337)..(337): n is a, c, g, or t
  misc_feature (456)..(456): n is a, c, g, or t
gtaagaaatcacagaatcatatgattctgcttttaccatgcccctggagcaatgtctgtgctagggaaacttcccgtcccatatcctgcctcagcccgccaaggtagccatcccatgtaacacactgtgtcctggtgctctctgccactggaagggcagagtagcctagtgtgtggccctgtccatctatcccagtcagggccattcccggacactccatgcttagtcactgcctgcacgaggtctgtgctgaggccttatcattcattcttatgctcttgaattgtctcatattgcgagctgaacatgctgcagtttctacattttagactcaaanacatgctctcccctatatcctggttctgagttagccttcctccatatcctattctaaacaacattttaagagacagtgtaggtgttccgttcatcctgtaactctagaacatgatcctnttttgaacacttcgagtcctaaggaaacgaggagtgcttgtcccctaagcagtgttgtaagtggcaacggcaggcctgtctgaacggacactttcctgcctaagggagagtggtattgtgcagactagacattctagtgctgctgacgattgactcattgggaaatc

SEQ ID NO: 538443 - DNA, 452 bp, Homo sapiens
aacgtcagactccttgtccaatcttcacggtgctttgtggggatctgtaggaggtgggacttctgtggggttaaggggatctccagagaagcgcgcacaagctgtccccttcccacatgtgccaatccatctcctacagccccctgactgatcgcctgctggctgggggcagctcccaggatatcctgccttccaactgtatctgaagcccctcctcctaacatggcgattccggaggtcaaggacttgggctctccccagggtctaacgggttaagggtgagccacatacacagtgccaagggggatgtcaagtggtgatgtcgttgtgctcccctcccccagagcgggtgggcggggggtgaatatggttggcctgcatcaggtggcctaatcactctgagtcacaggtgtgggatggagagtggggagaggcacttaatctgtaacccc

SEQ ID NO: 538444 - DNA, 743 bp, Homo sapiens
  misc_feature (502)..(502): n is a, c, g, or t
ccagcctgcgaattcccattggttgcagggtcctctgtgtgttcttgcccctcctgcttaatttaacccagtcccttctgcctccctccgacaacctctttcccatccgtagccttaaattcccgagctgcccgggcggatcgtagtgttgattggagggatgagaatacccgccgggtccgattggcactgtctccgcctgcgttctcggagtagcttccctgcgggtgggctggagttcggcggccggcgtagggcgcggcctgcagggcggtgggagcctccccggggctgctcgtgttgcagcttgggatgatactggcggaacgcaggacccaactcccaaacctgcggaccttgaccacggacgagccctgtcccagctccccacgtgcccaggggaccagagcaggcaggacgccttccaagtattcaagggccgtgggtttgcctaacgcttcgtccccttgtgttttcttgaaccaaccgttagcggaccagngtgtaccccttcagggaggcccacagttccggggctgggccgctcattgaatgcagtgattcaccacgtaagttttaattaaccaaacttgataaggtgctccggaggaggaaaaaattaacttgttgaaaagcggcaacttgaagggttctccccccaatctgcagttgagcccgggatccagaacagaacacaggccggccgccctgaagaaaacttccaagagcaagaagaaacaacg

SEQ ID NO: 538445 - DNA, 155 bp, Homo sapiens
ggggagaatagcgtgggtgatcctctgcttctccttgtgggagtaactgggactcctgttgtgtgcgtcttgctacggattctgctatcgactactgcttctgagatcgtgatcttccactaacttgtgacttctgatgcccgatcaacatttaa

SEQ ID NO: 538446 - DNA, 578 bp, Homo sapiens
  misc_feature (2)..(2): n is a, c, g, or t
  misc_feature (483)..(483): n is a, c, g, or t
anatgatactgagtggcagcacttcaactcatggtcttcacagcaagcttagggggcttctccaaagctggcttgggaaggttgtcaaaccttacaaaaacaagggggaacctttttccggaaaaatttttttgggaaaaaagtttttagagggcccccttggcgccccttggggttttaaaacccaaaaaccccccagaactttttttcccccgggggaaaacttttttttttttttttccccccccaagaggaaataaaaaaaccccccccccggggggaaaaaaatttggtttcttaaaaaagataaaaaaacaaaccggggaggggcccccccccatttaaaaaaaaactcccttttcccgggggggggggggccccccccccaaaatttttttttttttttggttttggggggggggggggtttttttttttggaagagagacaacaaactctccctttttgttgggccccccccccngggggggggggaagcgcccccccccccttgggggggggggggggggggggcacaccatttttttgttttgtttccccccccccccggcgcgggtg

SEQ ID NO: 538447 - DNA, 311 bp, Homo sapiens
cacaactagggtcagcttctgcaggtggtaagccatttaccaagatagttgtaggtaaagaagggcagatttattagagaaattgtgaaaatatgttgcagtgggcagctcagcagagaaggggctacccgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 538448 - DNA, 452 bp, Homo sapiens
gagtggtggcaggctcctgtaatcccagctacttgggaggctgaggcaagagacccacttgaacccaggagttggaggttgcagtgagctgagattgcactactacactccagcatgggcgatggtgagtctccatctcaaaaaaaaaataaatagctggatgcaggccgggcgcggtggctcactcctgtaatcccagcactttgggaggccgaggcgggcagatcacctgaggtcgggagtttgagaccagcctggccaatatggtgaaaccccatctctactaaaaatacaaaaattaggcaggcgtggtggcaggcgcctgaaatctcagctacttcgggaggctgaggcaggagaatcgcttgaacctgggaggcagtttgcagtgagccgacatcgtgcaactgcactccagcctggcaacagagcgagacttcatctcaaaaaaa

SEQ ID NO: 538449 - DNA, 305 bp, Homo sapiens
cgtacatttaataaagctccaaaggtaatacagtactagatcagacacagatgccaaagtgcagagaacattctcagatggggcctgggatgcaggatgtgctcacgcctgtaatcccagcaccttgggaggacgaggaggtgcggatcacgagttcaggaagatcgagaccatcctggccaacacggtgaaaccccgtctctactaaaaatacaaaaaattagccaggtgtggtgacgggtgcctatagtcacagctactcaggaggctgaagccggagaatggcgtgaacccgggagatggag

SEQ ID NO: 538450 - DNA, 319 bp, Homo sapiens
gcctgactactttcaggcggacaaatggtcactgcgcctggtgggtggctcatgcctgtcatcccagcacttgggaggacaaggtgggtgtgatagcctggggtcgggagttcgagaccagccagaacaacatggtgaaaccccatctctactgaaaatacagaaatttgctgggcgtggtggtgcctgcctgtagtccagctgcttgggaggctgaggcaggaaaatcgcttgaacccgaaaggcggaggttgcagtgtgccgagattaagccactggactccagcctgggcaacaagagtgaagctctgtctgaagg

SEQ ID NO: 538451 - DNA, 155 bp, Homo sapiens
cggggagggtagggtgctggatgacaccatcagctcagtattcctttgcaatcaggaaggctgatgttccttttgaagaggagttcagaaaaaggatgggtattccttgtcaccggcttattttttttttccctttaaattaggatttctttcat

SEQ ID NO: 538452 - DNA, 672 bp, Homo sapiens
  misc_feature (272)..(272): n is a, c, g, or t
accaaagtgttttaacctacttatcccccgctataaggaaaaattttttccaggaattccagaaaaagtaaaaagtgaagggggttcaagtgggctttctgggccaataagggcccagaaactgttaaactcactcatttctgcatgggacctactttggtctgaataataatattaaaatatgtgttaaaacattcctacatcagaatttgcgcctgtgttttcttccccaagaaagctataaacagcgaaaattttgttgtaagcttccntgtgtcctctctccctctctcccttccccctcccctgaaactaaaaggaatgttaaaagcccacttttctgtgaccagcagaccttatctatggtcccaattccaattccttgtaaacacaatttgtaaaatcccgtgagatcctgtctcctttgccatcccgctgcaaggttataagtagagaaaacttaagttacaattccagttttcctcaagatctgagacatgttaattgtctttgtttctccctctggtaacatcttcccaccacacatatttcctgccttagagagtttaaaaggtgataaaaaaatctaacactggctaccccgctcgggaccccttccacgctgtgaaagctttgaactgtcactctgcttaataaagcctacagcttttt

SEQ ID NO: 538453 - DNA, 391 bp, Homo sapiens
  misc_feature (12)..(12): n is a, c, g, or t
  misc_feature (36)..(36): n is a, c, g, or t
  misc_feature (258)..(258): n is a, c, g, or t
  misc_feature (338)..(338): n is a, c, g, or t
gtttacagtggnatccatatgccatagttgccatanttttatttgggaaatgtattttgccttatgatatgccttacctatcctaaagaaagttacctggcccgggtgccagttgtcacgccctgtaatccctagcactttgggaggccgaggctggtggattgcctaagcctcaggagtttgagatcagcctgggcaacacggtgaaaccctgtctctactaaaatacaaaaaattagctggtcgtggtggcatgcncctgtagtaccagctacttgggaggctgaggcaggagaattgcttgaacctgggaggcagaggttgcagtgtgccaagantcgtgcccctgcactccagcctgggtaacaaagtcgagactctgtctgatgat

SEQ ID NO: 538454 - DNA, 934 bp, Homo sapiens
gcgcttaagatcttcatccctgaagatgctgtccaatgcgcgttgttgcggacgtgtgtccgggcgccttacctcgggttcggccgtcactgctctccaggagaatgctatcggagattcatactttcattgctagcaaggaaacgttccatgcactctaacactcatcttcaaaagactgcggactgcgtgagatgtccatctattcgttggaagaagcgtattcttaggcatgctgatacctcatgttgagtcttgaagaacctggcgcgtggtctttaagctcattgggatgatggttattcgacccgcgatacatggtgcgtgagcgaatgctccaagctagaacgaaatggtcagagcttctgctctcagggcttacagagacggcgtatgtccattcgcaaacatccggaaatccctgtagcacatggatacgggagggattggttcgcatggcttctgagcgacacatgccttaacgacagtgacagtgtaggaggggcaaacgcggaaggattcactcatggtgccacagcaaggaacgagaaagggatccacatactgatgagttggcctaaccgggctagcccccaagtgggcgtatgtttaccccttgtagacgccgcaccttggtaccacaccacacgtggcatgaaaagcagcaaaaacgcaagacaccgcgacaaagcacagacgaagatacagagagaaaagaaagcacagaatgagaagaccaagagcagttcccaccaacaagacacacaagagcggcgtcggagacgttagcgagacatgggacgaccgcaccggaagagaccacgggggccaccacaggaggaccggcgaaagacactccgagaactccccactcggaacagagctgacgacgacaaaaccatgacaggaagcacggacagggaatcccccaaac

SEQ ID NO: 538455 - DNA, 292 bp, Homo sapiens
  misc_feature (92)..(92): n is a, c, g, or t
  misc_feature (143)..(143): n is a, c, g, or t
gggcccggcattctggacttctcctatccctccacccagtcctcactcaggactttctcctatccctccacccagtcctcactcaggacctnctcctatcccttcacccagtccacactcaggaccttctcctatccctccanccagcactgactcaggactttctcctatccctccacccagcactgactcaggaccttctcctatccctccaccaagcactcactcaggaccttctcctatccctccatgcagtcctcactcaggaccttctccagaaggtccaggtatg

SEQ ID NO: 538456 - DNA, 531 bp, Homo sapiens
gtagtagattgatttacttgtaccggtgtagcagacgtaacgttggaggtggccagcggcactaaaggttctgagatacttttcatataaacttctccacttatcaggtctgctatcgcgatgcttagccacaattgccgcgtgcagcctgtactaaggctgtgatttggctattgctatttggcttttcgggaagaccaatggacatgcacgatttgccagtcttcgccaattttttgcaggaaggcagtttctgttccaaatatctgcatgtccttgccctttactttggctttggtctctgtttccgcccaaatcaccgccagattcccgtcgattcgttggctttgctgcaatatcgtacgtgtcgatgtcttggcaaaagtcatatcttccggcagatgatgtccggcatactctgtccgtgaacgctcaacataaccggactcatagatagtgatgtcaggtgcaagtagttcagtggctttcgctttatcacctgatgccaaggccgaagactcaggtggtgtg

SEQ ID NO: 538457 - DNA, 162 bp, Homo sapiens
  misc_feature (122)..(122): n is a, c, g, or t
tgtccaatgccacttccaatctagctctgccgttgctagtcctgtgtcctctacagtctcagttccattgccatcttcactccccatcgctgtccgcaccacacttcctgccccagcctcgnctccactcaccatccccatctgagcccgttgacaacagaa

SEQ ID NO: 538458 - DNA, 376 bp, Homo sapiens
gtcgatctacaggatcctctcgataggcaacatcaccctgataccaaaacctggcagagacacaacaaaaaaggaaacttcaggccaataaccttgataaacatcaacaaaatactagcaaatcaaatccagcagcacatcaacaagcttatccaccaggatcaagtaggcttcatccctgggatgcaaggttgactctgcatatgcaaatcaataaatgctattcatcacaacaaaattaaagacaaaaagcacatgattatcttaatagatgacgaaaaggttttcaataaaattcaacatcccttcacgttaaaaactctcaataaactaggtattgcaggaacatacctcaaaatattggccccttatcgag

SEQ ID NO: 538459 - DNA, 713 bp, Homo sapiens
gggacatactaggtgggaaagcggaaggaatgattctgggactaccatttacgttgtacggtcaggcacagagaatgaataactagcatattggattcgtgacttctgtctttcccgccgggcctcatttcgaacttgttactctctagcagcggaaggctagcctaatcagggatatgtccagttcaaaaatgtggaccgtaagtggcaccggtactccatggtcctgaggtctccacgacggatgacagctagcacaaggaaggggatgctttcggcatagtccagtgacaccatagaccgtgaggccttgacgtgagacactgatttcgtcgacgcagggcactaggctagcgaccgtggtgagcctggcatggccaactttacccaggagccccagtatatgcctgatcattgctgtcccagcagtggaagtatcctcatgtccatccatgaagcaggtctgattttgccccagcttcctgaatcaaggtggcggccaggggcctcgaatggggtctcgagttgtctccctgtgcgtcggtgctctctgctcgtgggcagaatcctttggttcccctttgctgcctgtacatggactgctgacggtcgcttgataggtagtactgtgggccgacactctgggagtcacgaaagtttgcagcccatctgctggagggtacttggcgcagtattgctatgaatggtgggga

SEQ ID NO: 538460 - DNA, 133 bp, Homo sapiens
agactatcctggctaacattgtgaaaccccgcctctactgaaagatgcaaaaaattagctgggcattgtggcgggtgcctgtggtcccagctgctcggtggactgagacaggagaatggtgtgaacccgggag

SEQ ID NO: 538461 - DNA, 532 bp, Homo sapiens
cgcacaggtagctgcatgtgggacgcagagctaccttagctctatcctcaggttctttgtccagtccctggccaacaagacctcctgactggctatgcgtatatacgctatcctcatcatccgtcttgttgtctcacgctgtggacaaatacttggagtctgtcgacagttaatacagtacttccttcctggattctggttggagacattctgttcagtcgcatcggagccactactgtcagagcaactggccgtggctttggaaggtgatgcagtacgtcaatctgggcagcctacgacacaccagcttcccgtggctgaagccatgctgacttgccggcattagttaacctgatgaagactcctatcagaagtttattcccttcattggcgtggtgaaggtgggtctggttgaagactctccctccacagcaggcgatggggacgattctcctgtggtcagccttactgtgccctccacatcaccaccctccagctcgggcctgagccgagacgccacggccacccctcc

SEQ ID NO: 538462 - DNA, 267 bp, Homo sapiens
ggaggatcccggtgcagcggggagattcaccagggacttgggctaacccgggagtacattgagataatcaccagcaggcattcaaggaaaaatcggcaggactttcttcaactcggttcgggctactcaggcaggggaggcaatttaggggtgaagggcctttattgatgggtccactccccatttaatgaataatatgtcttgtcgggtcaaggcttgcaacactaaacgggggtttgacagcccttaaccggggggtagagtgca

SEQ ID NO: 538463 - DNA, 314 bp, Homo sapiens
atccagacactcagagttcatcgtgaccgtgcgagagtggctccacactaggcttgatgaatatgccttccgtggcctgccacgttattggtgcgtgttggcacgggggacatgccgtgtacctcatgctgcccacggagtggggcttccatactgctcacccgtgactgacaggaacacagaggtgtccacatgctggaagcgcacagtagcctcacgctcccaagtgctgtcacagagcagcggcacggtccagtaggtccaggtcgtcgccctcgccgtcgttccccaaaggcactcacctcctggttgtg

SEQ ID NO: 538464 - DNA, 648 bp, Homo sapiens
  misc_feature (587)..(587): n is a, c, g, or t
  misc_feature (621)..(621): n is a, c, g, or t
catacacaataagcagtttaataggagcaggctgagaccacatttattttgttctcctaaaagcacctacgtcaaaatccacaacagtaagaagtgcgggtcttgataagtttttatataggtcagaataggaattgtgactaacaggaataaccaactgatgacatcggcactctattcttcatagtagtataatcggtctccgccctttcagatcttagaatctgccattctatgtcggaataaggtcgctttacaacccctaaagtaaaatatttacctggggggggcaaccaatttggcttcgttacagacactgcacactagaagaggatcgtttggtgccttgtgggtccccccggggcagtactgcaggctggatggaacttcggggcccaaatcatcgccagattatgacacacccggaaagtgacgcattccacacagagagaggggccccactccgcctcttatgccaagatttcctcagatcgtttaaccactttgaagggaaatgtgtacggtcaggtttgtggccctagagacttgaggagtatgtctagcgttactatctgcgctatgttggnctcgtctttataggcacctagtgagagtcaggcncgatgtgtaatagccagatatgaattg

SEQ ID NO: 538465 - DNA, 153 bp, Homo sapiens
attagataccccactatgcctagccctaaatctagatacctcccatcacacatgtatccgcctgagaactacgagcacaaacgcttaaaactctaaggacttggcggtgccgtcgacgcggccgcgaatttagtagtagtagtaggcggccgc

SEQ ID NO: 538466 - DNA, 539 bp, Homo sapiens
gagatagaatcttgctgtttctcccaggctggagtgcagtggcacgatcttggctcactgcaacctccgcctcccgggttcaggcaattctcctgctgcagccttccatgtagtcgcgattacagacacgaggtaccacgcctgactaatttttgtgtttttagtagagacaggatttcaccatgtaggccaggctggtctcgaactcctgacctcaggtgatccgcctgcttcggcctcccaaagtgctgggattacaggtgtgagccaccactctggcctctcttttattcttgatattagaaatttatgggttctctctctcatcagactagatagcacctgtgtcaaagatgtattgctctttcaaagaaataaacataaattgtagccttatctattttctattccattgactttgcttcttttctttataaaacttccttctatggttctgggcccaagtgctcacttctataattccagcacttttggaggccaaagtggacgaatgcttgaggccacaagttcgagaccaa

SEQ ID NO: 538467 - DNA, 185 bp, Homo sapiens
tgcctggccagtgtctgacctttattcccaggtgaggcgcggagagggcccgccagtgacccactccctcttggtgacccccccatctggagttaaggctccaagcagcaagtgacacaggagggtgcctggatccagcagcctgggcttggcggcgactcccccaaaaacaccccagctgggtg

SEQ ID NO: 538468 - DNA, 274 bp, Homo sapiens
  misc_feature (200)..(200): n is a, c, g, or t
  misc_feature (215)..(215): n is a, c, g, or t
tggaggtggagtcctggacactttcggctctggcagctgtgtcttgatctgagccccaagcatgaactggaggctctgcagcccttgggagatgggggctcagggaggaccccctgaagaacccctcttctatgtggctttggtggtattccacggctggtgctcaggaagcccctatcaagaagaagcgcccccctgtnaaggaggaggacctnaagggggcccgaggaaacctgaccaagaaccaggaaatcaagtccaagacctaccaggt

SEQ ID NO: 538469 - DNA, 430 bp, Homo sapiens
  misc_feature (302)..(302): n is a, c, g, or t
ttttttgagatggcgtgtagctttgtcacctaggttggagtgcaatggcgcgatctcggctcactgcaacctccacctccacctccagggttcaagcgatttacaggcgcccaccaccacgcccagctaatttttttatttttagtagagacagggtttcaccatgttggccaggctgatctcgaactcctaacctcaggtgatccacccgcctcggcctcccaaagtgctgggattacaggcttgagccaccacacctggcccagaacccatttctttataagcctctgcctatggcgcanagggcgggtgaaggggctctcgtggcctgaagctgtggaaagctgctctgacttacctgcagcagaggggagcagtaggcccagaaaacctttcctcaactcttcaactgcctcacggcaatggccca

SEQ ID NO: 538470 - DNA, 126 bp, Homo sapiens
ggattacagatgtgagccaccgtgcctggcctcaggtagacttttcaaaaacctagttggtttggtgtggtcaattctattgagttgtttgtggtttgaatttggtaaaattctacttatatctat

SEQ ID NO: 538471 - DNA, 220 bp, Homo sapiens
  misc_feature (2)..(2): n is a, c, g, or t
anatcgagccctcaacaatctacatccacagcacgtactgccatgtctctcctactatgaatgtgtgaaccccgtgattgcagtgctcatctcgctgtcctccggaatgcccaaccacagcgccagcatccagctttgtgtacagaaataacggatattgatcgaggattccgatcagaacttgaagtacctggggctgctggcaatgaccaagatcctg

SEQ ID NO: 538472 - DNA, 189 bp, Homo sapiens
cagcgtgtgccgctgcggagtcgtacgcggtctcgggcccagggcgactgcccaaatggcccggtacatacggcgccccgcgcgcgttgcgtgcgccttgacctggctggcgggcctggcccctccctgcctggagcaccgctgggcaagctcggggcatgacaacaaacacaatggccttcgcggccg

SEQ ID NO: 538473 - DNA, 255 bp, Homo sapiens
gaggatacacccaccgcagtggtactggtactacttaaactgagttgaaagaccaattaaggaattaaggaggctgggcatggtggcacattcctgtaatcccagcaggaagctgaggtgggaagattgcttgagaccaggagttcaagaccagcctgggaaacaaagcgagacccctgtctctacaaaacataagatactagctgagcacagtggcgtgtgccggtagtcaactgctcgggaggctgaggcgga

SEQ ID NO: 538474 - DNA, 172 bp, Homo sapiens
  misc_feature (149)..(149): n is a, c, g, or t
caggtactagcagtatggtcgcgtgtcggtctaatctcgatgcgcgagcggtatggcgagtcagccacattcaggctatgatcggggtgattgtaacactcttaggatcgattcatgcacgtctgtgttatataaacaacactttctgnggtctgatgagcgcaaactgggg

SEQ ID NO: 538475 - DNA, 311 bp, Homo sapiens
aaccatacttcgaattatggcaacattgtgggctgctcctgttcataatgggcttctgctttcgttcagtatgttactgagagaaatgccgggtgctgtcgcacggagaggatggcagaatgattgctggccaggtttcagatattaacctggctgcagcgccaaaagtgaaccgaggcaaagcaggtgtgaacagatctgcagcggagatgtacggctcctcttttgaccttggaactatgactttcaacggggactattatgatagggatgtacagttacccagacacgtgtacctcctatctcctcct

SEQ ID NO: 538476 - DNA, 910 bp, Homo sapiens
  misc_feature (908)..(908): n is a, c, g, or t
  misc_feature (910)..(910): n is a, c, g, or t
ggggacgtctccagccatgaaccggtttggtacccggttggtgtggagccagggggatcttcttcggtgccgccgaaggtcccggaggaggatgaaaagctcgaataaatagatatgtcatgatggataatatcactgaagttgactcgaaaggaacggtatgaagtagaatttccaagagctatttaggaagactcgtcgaggcagcatggtgtgcccagcatattcagggatgagaagtgcgatgggagataggttcccatgagaatgtctggttgggtaaggataggtctgaatctgtagaggaatgagtaatgcgtgtgggaagagaggtctgtagatggatgtgtatcactggccttgaaatctaggaaaacgacgtgaattcgaaaaggaattagtccctatgaatcgtccagcatctaagtgacaagaatatagatcaaatattttgcagtgttaaaaggaggagaagctttgagacaaaatgtaagggcagagctaaaacagtagcggtgtcaaagagacctagcagttaagctagaaaaataagattcagctaatttactagggtggtagtacattcattcattaggaagtaatcggtcaggtgactttcttgagaagaggctgagtgtgaggccagttgatacagagatgtaacatgtgtgaaggagatggtgatggggattcacaaagtggtggtgggattggttgttgacatctgggtgggtatgcaagtatcaaaggagataatgaatgtgacttcttaaagggacatgggggcaaaattaaggtgccgctgagaaaggtgaaaagggagtgaatcgtaatgcaagagtaaacaagagattgggcatgatattaaagaggagaaaattatttgttaactttgtgtatttttgctngn

SEQ ID NO: 538477 - DNA, 173 bp, Homo sapiens
ccctgagttatgctgtcctgtatctgctccacgtctgtcactgcgtgtctgcctggtcccttttcagagctttggcacaatcctttgagttttgctaggtcagatctactttctcccagatcaaggcaaaacctcagtcgctgcaacctccgcctccgggttcaagtgattct

SEQ ID NO: 538478 - DNA, 162 bp, Homo sapiens
ctcaagaaacactgggggctggcacaaactcttggtctcttcaacaggagaatttgactggtgtatctttgggttccatggttagggagacattcctgggcacagttgggtccgttagaactaaaagtagaattttttttttttttttttttttatattttt

SEQ ID NO: 538479 - DNA, 151 bp, Homo sapiens
cattcctgaatccagaggacgttcttgtaatgcggcaaagcctttaggagtcagttgtttccctatcctggaaactatctgtaaatttaaggcattctttgttttatgttctaagtgtactcgaagtggtatttgcacaacatgagcagta

SEQ ID NO: 538480 - DNA, 679 bp, Homo sapiens
  misc_feature (7)..(7): n is a, c, g, or t
  misc_feature (148)..(148): n is a, c, g, or t
  misc_feature (158)..(158): n is a, c, g, or t
  misc_feature (239)..(239): n is a, c, g, or t
  misc_feature (250)..(250): n is a, c, g, or t
  misc_feature (254)..(254): n is a, c, g, or t
  misc_feature (257)..(257): n is a, c, g, or t
  misc_feature (318)..(318): n is a, c, g, or t
cctgaanggacccaagagtgttggaaagagaatcccaatccccctaattggcccacccaaatgggtctgaatcctcagtttcctcagggcatagggcagtccccccatgtgccctttctgttatcattttcacaacgttgaaggtganacaaagcagnggtttaatccccagctgtaattaccaaagggaagcagttgaggctaatgtctatagctcagctggcttggctaagcgaaanggggggaaagnattncanagcttccacctaacaggccccactgtttctccacagaggtgtctgctttctggccagctcnccactcatcattggcaaatgaccaaccaaaccaaaattcaaatatatttttcaatacatttcttgtctttccctggctaagggaaatgaaatatatataatttcaacaggtactgacccattaattaatccccaaaataatccaatgcggtatttttgttgtttctgctctcacaacaaaaatatttattttgactactaacttttgggattacaacagttaatctggaaaaagaagagtggtttcccaaatgatagaacattaacttggaggtttcactttttctcttcatatgctttttaaatccttgggtcaatatgaagttttccctataacatttgagcaaatgtatcataaatta

SEQ ID NO: 538481 - DNA, 223 bp, Homo sapiens
tgatgctgcagacgtatccacccttccgcgactatctctagccaatgttagaaagggcaagaccttacatacatgaccaggatgtatgagaacatggttgttaccatttaatttcaggttctgtgtgcctcctgcagtccccaccggagaagtgactcctatttaacaggctgggcttgcccgtatcatatgagctggcagtctctgtacactcatcggcaaa

SEQ ID NO: 538482 - DNA, 184 bp, Homo sapiens
gagttattttgtaaaagagttaccagtcccagtgagacctgttgtattttgttaagttttgtctgtctagacctgctgtgtccaatatggtggccaccagccaggtgtggttatgttaaaaggtgacattaaattaaatgtgcttaggtataaaatacatcccaggatttgaagacttagtatg

SEQ ID NO: 538483 - DNA, 193 bp, Homo sapiens
accacgccaccggagaaggtgggcggatctctcacacctttctccagacctgcttctgtcactgtcacatgttgctctgttgctcttttattcacttgctctttttttccttcctcccttaccagaaagtcggctccttgacaacagagccacgtgcgttattcatctttgtacccttctccggtggcgtggt

SEQ ID NO: 538484 - DNA, 302 bp, Homo sapiens
  misc_feature (45)..(45): n is a, c, g, or t
ggccccaggagcctttggttcagtacacgacccagggtggttccncagcacagctgcttcctctccgctcctacgcatcccgtctggcgggacgagcagcgtctccgtccattcagcactctgatgacccccctccccgaggcctcccactgcccgggtcccaggacccttcccccttcacctggtgaccggaacactcctttcctggtatggaacgtcagctcccgtgcacacgatgataggtcttctccttggggcctcccggccatcaacactctgtaataaacctcgcaaaaacaaaa

SEQ ID NO: 538485 - DNA, 1734 bp, Homo sapiens
  misc_feature (1)..(1): n is a, c, g, or t
ngcaccaacacacagtgagtagtgtggggtcggaggtgccttgaatagaaaaattgattttgatcatgagggtcggggtccacctgacaaactacaagaaggagatgactcagtggtgagtgacgctatgcgtgcaggtctgcaatatgagtatgtgctttccttgtggatggactcgcagatacttcaggagagcggatcaacatcctaggaatgtagcatgggtggtccagagacccagttgtgggtgctcgcacacacactctgtctacagacagaaagagggaattctatccagacggagcgtcccaacttttggtgggagtggtgtcatcctggttgatggattatgtcgcggcgtttgtgcgccccgagctctggttttgtgttgtaggagggggggccgacgcagccctccccacgggagtgttgtagttgtgtagtagtctgcttctgtgttggtggtgagcacctacatacgttggttactgtcgctgttttgttcttcctcggcgtgcctccaccccacgaggagtgggtgtgtgctgcttctccttcgacgcatcgggaggtgctgccgcccagcgagggtgaaggtgacgcttcgcggggggcgcatcatctcctcgggggggggcggcgcccccacctcgtgtgtgtggtgtccgacgattgtgagtggccgctcggagtgggaccgcacaccgagctggtacgtctaccagctattaggtggggcgaccactcaatcacctcgaccagcgagtcgtcgtcgcccctcaaaaccacaccacgtgggtggtgaggtagagagccacctcttcgtgggcgacactctcatccttgtagctcttcatcgcgcagccactggtctgctctaccacgtgagggtatgactgcgactcgcggtgttcaacaccacggcgaacatacttctgtgttgctctggtggagaggagagagttgttgttgagaggagtgctgcccccctcgggagagaaaacgaccactctgttgctctccctacagcagcgccaactctggtgggccctccaccacagcagatgagagtagatgagagatgtgagagtataaatagtttgtgtactctctctggtgggctgtttcttgtgtgcgcacaggagcgctctcgcaacacactccgagcagctcttctgtgtgagggcccctctcatatgatagatattgtggacgccctctctgtgatgcgacacgacacacacccagcgccgcgcctccactgataagcgcgtctctgtgagcgccccgtgggcgcgctctggcggccccactgtggtgcgcctctctctcagagagaggagtccaccgcgcacactctctcccgccacacagttctctgtgtgaggggtgggaggagcccctctcgcgcacagtctgtccactcgcacgccacccgctctggcgccacacatatgtgttgtgtagagacactcgggagtggtgtgagagacacagtgttgatataagagagagaccgccacacacagcagagatatgtctgtggccatctgtggaacataatctcatactgcgcccacaccccaccccgaaaacctctcggcaggagagcgctgttttacatgagagggtatagctgtggtgcacaccacaccataagacgtttattgtttggtggttttataaggagataataataagttgtgactaccacatgttgttataatataaaag

SEQ ID NO: 538486 - DNA, 310 bp, Homo sapiens
ggggaggagggagggaaggcaggcacacgaagacacagtgtatgtcgggaagtgctcacaaaccgattgtctttccttcttgggttaaagaagaaaaagtttgtaatcaatatcctgctcatcggtaatcgtgtactagaagaaacttgattgttttcatctggcgtctcggaatcttctctctcatttcatatgcacagttgtatttgggtaatgctatgcgtcaccagaatgaacacgctgtaagtaaaaatcgattgtcaggaaggaaaaagtatgaacaagaggaagctccagaggcggatccatg

SEQ ID NO: 538487 - DNA, 222 bp, Homo sapiens
ggatacagatcggtgccaccactgcccagctaattaatgtatttttagtagagacagggtttcaccatgttggccaggctggtctagaactcctgacctcagaatgatcctccagactcagcctcccaaagtgctaggattacaggtgtcaaccaccatgccctgcccttctttttcttgtatttttttagatgtggtgtctctaaaaagccattgcggccg

SEQ ID NO: 538488 - DNA, 448 bp, Homo sapiens
  misc_feature (30)..(30): n is a, c, g, or t
ttcaaagatggtaaggagcttgccctcccntggccccccacctggtgactcgcccagcacccacctgtcctgcacctcctactgggactagtgaatgactgactgtgactcaatacaataaatgtgatccacaccaaaaaaaaaaaaaaaaataaaaaaaaaaaaaaaaaaaaaaaaaataagaggacacgatgagaaaagaccaacagagagacagaagactcatagctacaaaaaaacaccaagaaacacataaaagataacataataaaagcaactcgacaaagacagcagaaaagatccaataaacaagaacaatataaaagaagaacataagagaagagtggagattggataggaagagaagaaaaaataggagcgaggaaagcgaagattctatcgaggaggataaaaaaaatcatacaaaggaccaaaagagagaaaaaaa

SEQ ID NO: 538489 - DNA, 163 bp, Homo sapiens
tagtagagacctgaattttcaccttgtgggtcaggctagcctcgaactcttgacctcaggtgatccttgcgctttggtttcccaaagtgctgggattataggcctgagcccacgcgcccggttgaaattgcaatttttgaactctttaccaagatggcctaac

SEQ ID NO: 538490 - DNA, 1671 bp, Homo sapiens
actattttatcccatttaaaccaacacattatattacagcggtctacaagtgtgccaggcccgtggggaacaccgagccgtgaaaaagtgtaccagctcccttgcccctctcaaggaagcttcacagctcgtggggcgaacagacgatgtgttaacaccactgtgcagttatacaaccgcgcgagacgaataaaaggtggtggtgcgcacgagtgtctattacacaacaggtgccgtggtgcggcgcacaaacacagaagcagacccgaggtacacacactcaacaccgatgggccagggcgacatcagggacacagccattcaccacagaatctacgagctacaaaatacacaatcacgggtgcccatgaggaacagagatgccctgtgcaccacccacacgagagccggcacccactcaaacaatctctgtgtgaaactgtgcagtggtctccacctgtgagaagagccacctgatgggcgtatgtgcgacgcgagagaacacacagcgagccacaataactttctcggtgtctattctcactgatcagagagaaccatacaatatattccgcaacaaaccacgcatcatgtcgacaccacatgtgggcaggaaacacccaccgcgtggtgccccacgcgcacatgaggaggacgccccattgtggacaagagagtagaactaaaacagagagaacacagccttgggacgctccaccgcaactcatccaaaagagggggccccaacggatgaaaccaaagcaaaggacgcgacaccggctaataataaaccgacgacagaagcgtggactcctcaaagcgctgctcgcggcagaagggagacatactacctcctttatcgacaacccaaagaggaaagccgctctaggacgacacacctccgagcgacagaaccccaacaataaaccctggaggtcttaaggtcaatactaagacgttcctcaccccacttattaaacaccccctctctgtagataggagacggaacacattgtggtacagacaaactaaaaattatctacttggtaggacgaatacgaacacacgacaagtatactacaatcatagatggcaaagcatctggttggagtgccattcacgatcgctagtagggcaaagcggcgtcactactcacatatatccccacgcttacacattgatatacataacaccaccacaccaagttggtatagaaagcaacagactgcaaagtcatactcatctacgacaaagaccaccccactagagtggcagtactctacatatataacataaccacccaggcaggcgagtctactactgaccactacgacgtaggattctagacgaacatcgacggacggaccccaccaccaacagacaaccaaaatataaccctatcacaagagcggccaaccccacaccagcgcaaacggcgaacgccaacaggctccagcagaaccacacgagcgggagtatgacccccccaatacaaccagcctacaaagaggggaggcaattgaccccaccacacaagagaccagagagcccactcctacataacacacacccctagaaaaaacgaggaggagaaatatccacacaggaaaacccaaacaaacaacacagcagcagcggtaactacaacacacactacaccaacaggagtcc

SEQ ID NO: 538491 - DNA, 277 bp, Homo sapiens
cctctgtaagcctggcggcttctatacctgcagtgatcgttctgggggaggacatcgtttcgccacataccgtgggaaaactgcatgacaatagacaaactgtcctggggctctaggagggaagctggaatctctgactatcttcacaattgaagcaattggtgaagcaacttgtcagcagcccagtttcatgtggcagggacacatcttttgcatgatcattgggcacacattcatggcagggggctcctctcagcagtcgcactagcaggcatgc

SEQ ID NO: 538492 - DNA, 295 bp, Homo sapiens
  misc_feature (105)..(105): n is a, c, g, or t
gcgttattgtcgtcaatataagaattcgattgtatgaattgtctccttggcaatctcttagataagacgatgtctcttaaagacgccaaatccggtgtcaccgtngatctatcaataaagtacttacttccctgttccacatcgcctgaacatttgtaaacatgcaaatgctttaaatagtctttcacacattcatgtcccgctgttttaatgagagatttatccaacttgatggcaaaatcatcattcgcgctgttcatctccaactttaagaaattcttatctgtagagtgct

SEQ ID NO: 538493 - DNA, 119 bp, Homo sapiens
ctctagaggatctcccccataatctctggccaacaacaccaagtctacatgctatgccaccatagcactctgcatatacttccacaataattaccatatggtgggcacacattatggag

SEQ ID NO: 538494 - DNA, 902 bp, Homo sapiens
tacctctttaaggtgccgcagcgggtaggccttgaagcagaggctgttctccgcccaagcatccctgggagcccaggccctcccgagagcagagaatggaaggaaccaagttttgtcctggagtcctcgccctcttgcaggaagaggatgtgggatccctgtatcactcaagggatctctcgagataggtcatggggcagccagaagctagaaaacaactgaaaattctgatcaccatgttagccaacgcgttgaccccattgtgggtgaaccttgatcctacaagtggttcccattgtgactgagggccttgattccatgtggagttgaagcctgatcaatctaatgtgagtgagagcgtgagaatacaattctatgtgatggatgaacagcgtgaccacgatgtgaagtgacaacgttttgctcccatggtgatggacgggtgacctccatgttagagtgaagccggatcatcatgtgagttgaaggcttgatcatcatgtgagtgaagcctgatccatgtgagttgaaaccttgatccatgtgatgacggtgacccattgtgagtgaagcctgatcatcatgtgaactgaagggctgatcccatggtgattaggtggctaatcccacattgatgaagcctgattttccatggtgatgaagacttggtcccatgtgggtgaagcccttggtcccatgtgaggtaacgcctggatccatatgaggtgagggtggttaccctgtgataaagcctgactcactgtttcagcgctggcacatgtgggaactgacccttgagtgagccggtcttgagaagattgtaccttaagtggggagcgtgactggggggtacactgaggggagaacagatggcccggtttggaaagacccgcgatagagta

SEQ ID NO: 538495 - DNA, 121 bp, Homo sapiens
  misc_feature (6)..(6): n is a, c, g, or t
  misc_feature (22)..(22): n is a, c, g, or t
  misc_feature (83)..(84): n is a, c, g, or t
aatctntcaacgaggagatcgngttccttaagaaagtgcatgaagaggagatccgtgagttgcaggctcagcttcaggaacannaggtccaggtggagatggacatgtctaagccagacct

SEQ ID NO: 538496 - DNA, 115 bp, Homo sapiens
tcctagaggatccccgtctctccacactggcatggtgaaaaatagttttggaaaacatcagattataaaatcaagatatgtccggacgcggtggaacatgcctgtaatcccagca

SEQ ID NO: 538497 - DNA, 643 bp, Homo sapiens
ggcagttggttgaagtagcaagatgttggcctttctgggtttctcttttgctgtggcttcctcactgaccttggacttttataagtatgatacaaatctacacttgaataagtatgactgttactcatacttgaacttatctcattgcacctcttctcagcagctcttcatttgagaaaatattttttcagatcatagactaaaaaatcataccatcaaggtggcggcaccaggtgccaggaggaaaagggtacttgctgtgtatcctgggtcagtaatattgaaaactgtcttcttcagcttcctgtccttctatgtgttgtgtctcttgtgacagttgttttgtcttcaagccactgacttctggaatttgcagattttgcaatccatgcaaatgtgaagaaaagctctatgttactgaccattgttgttgttgtttatagtgcaaaataaaaatagcaaaaaggaaaaaagatcaatggaggccttttggtgcttaccacagactgtgctctttcactgactgaatagagagaggaggcagagtaaacctatcctatatacacctcagtccaagcctggtctgtattatgaatggggcaacatggaaaaagaaaataaaatcagcagaccacataaaaaa

SEQ ID NO: 538498 - DNA, 382 bp, Homo sapiens
  misc_feature (241)..(241): n is a, c, g, or t
  misc_feature (330)..(330): n is a, c, g, or t
  misc_feature (352)..(352): n is a, c, g, or t
  misc_feature (358)..(358): n is a, c, g, or t
ggtaaagtgtgggagaccgaggacacagtggagcccacgagcacgagctggaacccacgaggatggcctggaacccatgtcagtctctcaccacctccagcttcgatgatgtgggtgtcctgcagaagaagctggtgcccttcctcacagagttaaatatgcatctggcccagggaattagagaagctgaaaggatgatcctggggaaggtggagcagctgcaggcctggctgcaggctgnacttacttgcccacaccaacgaggtgatctaggcagatacatgggcaacgtgttgaacttgcaacaacgcctgggtgccccagccaaancctttccaagtgttaaaaacantgttgntgcttgttttcattttccgccttc

SEQ ID NO: 538499 - DNA, 437 bp, Homo sapiens
ggcagttggttgaagtagcaagatgttggcctttctgggtttctcttttgctgtggcttcctcactgaccttggacttttataagtatgatacaaatctacacttgaataagtatgactgttactcatacttgaacttatctcattgcacctcttctcagcagctcttcatttgagaaaatattttttcagatcatagactaaaaaatcataccatcaaggtggcggcaccaggtgccaggaggaaaagggtacttgctgtgtatcctgggtcagtaatattgaaaactgtcttcttcagcttcctgtccttctatagcttcttgttccgtgctttcccctctcagggcataatgcgccccacgcctttcctgacccctaagccgtgggtcgccctccattttataagtgagacaaggggctccccttctgctcggg

SEQ ID NO: 538500 - DNA, 456 bp, Homo sapiens
  misc_feature (25)..(25): n is a, c, g, or t
  misc_feature (366)..(366): n is a, c, g, or t
  misc_feature (416)..(416): n is a, c, g, or t
cttgactcactgcaatctccacctnccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattggggatatctcctgaaaaggtttatggaaaaagaagaatcttcatcttcagtggaaggaatacttcttcattttttaaaaaaagctttaaaacttttgaagttaggntttaactttaaatagtattttccccttttatcggcagaacctttttttangggaaggcaagctttaatgggctggataaattttaaaatt

SEQ ID NO: 538501 - DNA, 974 bp, Homo sapiens
cagtagcggcatgtgcctgtaaccccagccactcgggaggctgaggcaggagaatcacctgaactcgggaggcggaggttgcagcgagcagagatcgcgccactgcactccagcatggggacacgagctgaggctctgtcttaaaaaacaaacaaacaaactaaaaagtccacctggggcttccacttcctatctcagaagggaccgtaagaatgctataaagtgtggccgtggcacagtcgttcacgcttgtaatcccagcaccttggacaggccgaggcggaggggatcgcctgaggtcagaacgttcgagaccagcctggccaagcttggcagaaaccccatctctactaagaatacaaaaaccagctgggcatgctggcgcggagcctgcggatcaaagctactcgggaggcctaggcaggagacttgcctgaacccaggaggcagaggttgcagtgagccggagattcaggccatctgaacctcgaagccttgaggtgaccgaagagcgaaagtccagtcagagataatgaacacagaaagagaggggcgaaacagggctaaccgtctgggcacgagagagggaagactggaacacaagcagggagagacagcgggctagcaaacaacgtcgtgagacatccaaaagcccgggcatctggaagcacacgggaatacaaacaccgaataagacaaaggggcagcgcacacgaaagaagagaaaacgagcgagtaggtaacgggcgcaccgaaagtgggcaaagtgcggccaacacgacggcgggaaacaagcgcagtgagcacacacacactggggaatagacgagacgaacgaagcactcacataataagaaacagacggggacacatgggcagacacacgcaaggaacaaaaagggggaagaggcacaaagggaccccgggaggcaaaatgaaccacacaggggtgcgccaccacagggtgatagaaa

SEQ ID NO: 538502 - DNA, 198 bp, Homo sapiens
tagtagatgaaactgtgagaatgtgaatccggtctgtagatgagttaatcggtatggtatcaatgttcatttcctgtgtttcattaatcttagtattattatgttaaggtgataagattacaggaagctgggtgaagggtatatatggtaactctctgtgctatgtctgcaattttcctagtaaagtctaaatattat

SEQ ID NO: 538503 - DNA, 639 bp, Homo sapiens
gaatcaaacaagcgattagttgatgtttaatgccagtatcgagaggacggggggaggggatggcgcttggacggctgtcgatgtattagagccctggcaggtttatcgacaggcgcgtcctcactctctgctctgtgggttcagcagttgggttttctgctgcgggttttttgcccggcggcggtcgcctggcgctttgatcggtccgggttgggcggggtgacgctacttgctatcgagcctgccaggccgtcattcggcggggttgtcagctcctccctggcttgtaaccagtgcacgaaatcctgaccgccaggcttcccttgctgttcccaaatgcggtacgcggtgagtcggatcgtttcttcgtccattgtgaggctcccctattgaataaaaggtgctatgagtgaatgaagctgctcacgaagtccgccttgaccacgggaggttcgatcccatggatcaagccggcggtcagcgcttgttgcgggtcgagaatgcgtggcgcggcgatcaggtacttttcggtctccagtttttcgacagcatcggcggtgcgctcggccacgatgcgtgcgtacaactgcaagtcgtaatcgaggctcatcgcatattcggacatgcgcgagtggtcac

SEQ ID NO: 538504 - DNA, 419 bp, Homo sapiens
gaatggaaactagccactgcgcccgatctacaatattgttttctgtgtcccatccataccagattattgaaccctctgtgtgtatgtttttaaatcttgcatataattctacttgcttgacttacaagtcaacaattagctattgagttctttatagaagctggaagtattttgaaatctgagatctaattactggccgggtgtggtggctcatgcctgtaatcccaatattttgagaggccgaggtgggtggatcacctgaggatgcgagttcgggatcagcctggtcaacatggtgaaacaccgtctctactaaaaatacaattacctgcgtgtggcggcgagcacctgcaataccagctactcagaggctgaggcagtggaatggctataacctgcggcagatgttgcagtgagcc

SEQ ID NO: 538505 - DNA, 236 bp, Homo sapiens
tcattagcttttctccagtggaatccttctgtacatgatgaagccagagaaaagatgctgactcagaaaaagaagcctgaagaacagcacaataaaagtgttcatgttgctggcactgtcatggagtaaagccgtggctcagatacagacctttcatgtaagagaagaagaaaacgagtggcagacattaaagagatggtagaatctaggtgcaccattgcacgtttccgtgctag

SEQ ID NO: 538506 - DNA, 140 bp, Homo sapiens
gttgcgatccctatcgatcgctgatccagcagtattgctcatctctgtgatctggccactgcctgcattcataatcggaggggatgcaaagtctcaatgtaggctggtgaaatcaagatgccatctcctcacctcctgcg

SEQ ID NO: 538507 - DNA, 251 bp, Homo sapiens
gcggcaagtagcacagtgagctagagtgtcatgagatcagactgctaacgtcatgacctagagcgctgtctagggcaaataaaagacttacttaactgtactcggccacactgttactattgtctcatctctctctcactggttctcatttaaatcggggcatggctacgcccagcacctgcaagtttggtgagatgggtgactaaaacagatgcaacgtactggaaactgtgacatcattcccgatgatc

SEQ ID NO: 538508 - DNA, 142 bp, Homo sapiens
caccatgatctaatgaataataaatatagtgctattctatgtattaatatatcacaattaattcaattatacccccactgatggatgtttctctatgactccatctgtttatgctattgggagctgctttttcttagtattt

SEQ ID NO: 538509 - DNA, 124 bp, Homo sapiens
ttttttttcccccccctttccccccagggtttaaggtcatttgggccccgggttttttccgggggggcccccggttttttccccgggggtttttggctccaaattaaaagcccccggggcccca

SEQ ID NO: 538510 - DNA, 2070 bp, Homo sapiens
caccatgtctgtccgctactccagcagcagcaagcagttctcttcctcccgcagtggaggaggaggtggcggagggtcctccctaagaatatctagctccaaaggctccctcggcggaggatttagctcaggggggttcagcggcggctcttttagccgcgggagctctggtgggggctgctttgggggctcatcaggtggctatggaggattaggaggttttggtggaggtagctttcgtggaagctatggaagtagcagctttggtgggagttatggaggcagctttggagggggcagtttcggaggtggcagctttggtgggggcagctttggtggaggcggcttcggtggaggcggctttggaggaggctttggtggtggattcggaggagacggcggccttctctctggaaatgaaaaagtaaccatgcagaatctgaatgaccgcttggcctcctacctggacaaagttcgggctctggaagaatcaaactatgagctggaaggcaaaatcaaggagcggtatgaccagcatggcaactcacgtcagggggagcctcgtgactacagcaaatactacaaaaccatcgatgaccttaaaaatcagattctcaacctaacaacagataatgccaacatcctgcttcagatcgacaatgcaaggctggcagctgatgacttcaggctgaagtatgagaatgaggtagctctgcgccagagcgtggaggctgacatcaacggcctgcgtagggtgctggatgagctgaccctgacccaggccgacctagagatgcaaattgagagcctgactgaagagctggcctatctgaagaagaaccgcgaggaggaaatgaaacaccttcgaaatgtgtccaccggtgatgtgaatgtggaaatgaatgctgccccgggtgttgatctgactcaacttctgaataacatgagaaaccaatatgaacaacttgctgaacaaaaccgcaaagatgctgaagcctggttcaatgaaaagagcaaggaactgactacagaaattgataataacattgaacagatatccagctataaatctgagattactgaattgagacgtaatgtacaagctctggagatagaactacagtcccaactggccttgaaacaatccctggaagcctccttggcagaaacagaaggtcgctactgtgtgcagctctcacagattcaggcccagatatccgctctggaagaacagttgcaagagattcgagctgaaaccgagtgccagaatactgaataccaacaactcacggatattaagatccgactggagaatgaaattcaaacctaccgcagcctgctagaaggagagggaagctccggaggcggcggacgcggcggcggaagtttcggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgtttgtggtttctgtatttcttcttttcactttaccagaaagtgttctttaatggaaagaaaaacaactttctgttctcatttactaatgaatttcaataaactttcttactgatgcaaactaaaatataaaaaaaaacaaacaa

SEQ ID NO: 538511 - DNA, 1134 bp, Homo sapiens
cacctcttggatcaccacctgctccaccattatcggacctccgtgggcccatctacaggccttgctcctgagtacaccatcctaggagctcctccattcctgatatcacctggaatgtctggactccgagggctccgttaccgctcgacgtttaaccgtcctgggacactaccacctaggccgaccacctgggctctgtcacacaatctctaggcatacctccttggcagaaacagaaggtcgctactgtgtgcagctctcacagattcaggcccagatatccgctctggaagaacagttgcaagagattcgagctgaaaccgagtgccagaatactgaataccaacaactcacggatattaagatccgactggagaatgaaattcaaacctaccgcagcctgctagaaggagagggaagctccggaggcggcggacgcggcggcggaagtttcggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagcagctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgtttgtggtttctgtatttcttcttttcactttaccagaaagtgttctttaatggaaagaaaaacaactttctgttctcatttactaatgaatttcaataaactttcttactgatgcaaactaaaatataaaaaaaaacaaacaa

SEQ ID NO: 538512 - DNA, 366 bp, Homo sapiens
  misc_feature (256)..(256): n is a, c, g, or t
  misc_feature (263)..(263): n is a, c, g, or t
  misc_feature (277)..(277): n is a, c, g, or t
  misc_feature (314)..(314): n is a, c, g, or t
  misc_feature (355)..(355): n is a, c, g, or t
gggaggctagaggcagtgtgaatcactcagaatccgggagcagaggttgcacccacccaagatcatgccaccatactacagactgtgtgacagagcgagactctgctcaaaacaacaacaaaaaaacaaactcaccatcgtacctgtgcttatgcaaggcctagcaggaacggaaatcggtttaacctttgtggacagaagttttaaaaatacatatgaaaattaaaagtatgctctgaaggaggactccacttcnggaaacntatctcaagagaanaactggccagcacaaagctgctggttacaatgggaangatgcagggacagctacaattgcaaaaataacctagacatncaccaaggagg

SEQ ID NO: 538513 - DNA, 1208 bp, Homo sapiens
cacctcttggatcaccacctgctccaccattatcggacctccgtgggcccatctacaggccttgctcctgagtacaccatcctaggagctcctccattcctgatatcacctggaatgtctggactccgagggctccgttaccgctcgacgtttaaccgtcctgggacactaccacctaggccgaccacctgggctctgtcacacaatctctaggcatacctccttggcagaaacagaaggtcgctactgtgtgcagctctcacagattcaggcccagatatccgctctggaagaacagttgcaagagattcgagctgaaaccgagtgccagaatactgaataccaacaactcacggatattaagatccgactggagaatgaaattcaaacctaccgcagcctgctagaaggagagggaagctccggaggcggcggacgcggcggcggaagtttcggcggcggctacggaggcggaagctccggcggcggaagctccggcggcggctacggcggcggccacggcggcagttccggcggcggctacggaggcggaagctccggcggcggaagctccggcggcggctacgggggcggaagctccagcggcggccacggcgggcggaagctccagcggcggccacggcggcagttccagcggcggctacggtggtggcagttccggcggcggcggcggcggctacgggggcggcagctccggcggcggcaggctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgtttgtggtttctgtatttcttcttttcactttaccagaaagtgttctttaatggaaagaaaaacaactttctgttctcatttactaatgaatttcaataaactttcttactgatgcaaactaaaatataaaaaaaaacaaacaa

SEQ ID NO: 538514 - DNA, 856 bp, Homo sapiens
tctctaataaccaccgctacaggactatagaagccaaattccaatgtgaaaatgcacctttcaattgcgcagacgaggtcataatggaggtgacagtcataaaagattttctagctctcagcagagctgtaaaccgggacccctcatccaggcagacagcacagaatctgaaaatctgcctatcaaaagcatcattcaagccacaaggctcttctgttcctggtagggggggggcaggaaaagaggagacaaagaaaaacgtttatgatctgaagatatggcccaaaatcacgcaccacgcaatttgttttctgaggaaaggaaagacctggtgcacctttatacaaagagcccatcattcatgcttgaatagggatatctggtcctgcccggcactaatttggtctctgctcttacatttggagcatttttagaacgatattaaaccatccggaagagtgatttcagggagctagaagtgacctggggttgtgaagctctataactacaaacatattgtggggtcttactggaactgtgcgcgagcagggcagagcagaggcgctttgtgttattgtgtgggaaggcataagcctatgatagacacgagagggcgggtcagagacggtaagggtgggcaggctggagatggaattctatgcccaatggagacgcgtccgccgtttgtggcgagcggaagcgctagatcgagctgggaatatttggtcagttgacgcggggggtggaggggaaggcgagtgagaggagaggtgagttcttatgtcgggaatggttgcgcgcgtgcaggggcgcgagaatacggctgcaggcctgcaggggattgggtgtgttgacg

SEQ ID NO: 538515 - DNA, 1177 bp, Homo sapiens
  misc_feature (680)..(680): n is a, c, g, or t
cacctcttggatcaccacctgctccaccattatcggacctccgtgggcccatctacaggccttgctcctgagtacaccatcctaggagctcctccattcctgatatcacctggaatgtctggactccgagggctccgttaccgctcgacgtttaaccgtcctgggacactaccacctaggccgaccacctgggctctgtcacacaatctctaggcatacctccttggcagaaacagaaggtcgctactgtgtgcagctctcacagattcaggcccagatatccgctctggaagaacagttgcaagagattcgagctgaaaccgagtgccagaatactgaataccaacaactcacggatattaagatccgactggagaatgaaattcaaacctaccgcagcctgctagaaggagagggaagctccggaggcggcggacgcggcggcggaagtttcggcggcggctacggaggcggaagctccggcggcggaagctccggcggcggctacgggggcggaagctccagcggcggccacggcggcagttccagcggcggctacggtggtggcagttccggcggcggcggcggcggctacgggggcggcagctccggcggcggcagcagctccggcggcggatacggcggcggcagcagctccggcggcggatacgcggcggagnagtccggcggggatacgctccggcggcggatacggcggcggcagctccagcggaggccacaagtcctcctcttccgggtccgtgggcgagtcttcatctaagggaccaagatactaacaaaaccagagtaatcaagacaattattgaagaggtggcgcccgacggtagagttctttcatctatggttgaatcagaaaccaagaaacactactattaaactgcatcaagaggaaagagtctcccttcacacagaccattatttacagatgcatggaaaacaaagtctccaagaaaacacttctgtcttgatggtctatggaaatagaccttgaaaataaggtgtctacaaggtgtttgtggtttctgtatttcttcttttcactttaccagaaagtgttctttaatggaaagaaaaacaactttctgttctcatttactaatgaatttcaataaactttcttactgatgcaaactaaaatataaaaaaaaacaaacaa

SEQ ID NO: 538516 - DNA, 118 bp, Homo sapiens
gctctagaggactccctccggggtcctcactggatctaacgcaattctctgcctcagtttcccaagctgggactacaggcatgtcgcacacacccggctactttttgtatttttagta

SEQ ID NO: 538517 - DNA, 124 bp, Homo sapiens
catccctgagaatcggaatggtttaaaaaacaacctgcccaatttctatttcttcaaaatgatcagcataagcccgcctccagaaatgtatacctcccttgaaactccgaaactgcatcagtca

SEQ ID NO: 538518 - DNA, 147 bp, Homo sapiens
atttaagttttttcattagtaccatattaccattttttatcaattagaaaatgttatttaacagctaaaattatctatacctatctttattaatcactattgttccagcagttttcatgtcaaattaataatctatagggagattgt

SEQ ID NO: 538519 - DNA, 431 bp, Homo sapiens
  misc_feature (411)..(411): n is a, c, g, or t
tggctcagcttggctgtgacgtccccacggacagagaaagggaggctgggtaaggaaccgggtccttcggggtagacctcggggagttcctccaggcgggcaggctcgggggaagggcattggaagaacatgacggggtccaagtggtccagaaggcccaacaggatatcagacggtaagaggcaaaaattaaatgaagtacaacggtcagaatagaagggaaaatctaacgggaacacttggtacggggttccataaggtaaattagtcattatgtgataagatgagctcgggacccaccagaaccatttatctacacttcactcagtcctcacagggctcggtgaggcaggaatggtaataacccgggtggggtatttatataaaaaggtctcccccatccggaatatnctggattcccggaagggagc

SEQ ID NO: 538520 - DNA, 842 bp, Homo sapiens
ggcgagagaggacccaggtgttctggcagtgggcgcctgtggggcacacgtctgggccagggtgcaggcggccatggctgggagactgttcgccccggcctgagtactcctatcttgtttctccagctgttcgtggagttggagatgtgcacctaaaggaggcgcatctgggtgacggacacatctggcatcttgaggccgctcggccatctgctctcgccaccgtggcgaccctgactcccatccacatgtgccttgagagtcgactcaacaagtaggggccccagggtctcgcagacagtatgggcagcgataaagaaagcccagaggccgactgccagaaacagttccaggcgtgcagtgagcgtcatccagaagcctggcccaagaacggttcttaccgaccctcctatgaagagatgctgttgattctacagttactaccaagcaggcacactcatggggcacctgcctggtcaccccggcccgtggttctgggacacccatgggacgatataagtgggacgcgctggaatcagtctggtgcaagatgagcagggtaggaggccatgtcgtgcctaacatcgactgaaatgaaactgtgtggcacagaaggtggctcgactacagttgcccctgggtgatggtggcctatgggacatgttgagcacgatcgagccccctgtaccaggtgatcgctgacaatgcccgacggcgccccagaaaaccgtccttgaagaagggtcaccaggtggatgcaagctggtcgtgatggagatgttggggctgttaaaagctcccagcttgccatgaacggaggaccagagccaagcccattacca

SEQ ID NO: 538521 - DNA, 252 bp, Homo sapiens
attgcgcggggacgggtacgtggtagtgacgaagcagtcgtcgtcgcagcacgcgtagcagagatgggcgcggcgccgtgatagagcaggaggggcgcagtattgcgacaggagacaggaatgtgaaggcccagtcacagactgaccgagtggaccctggtaccctgcgcggctactacaaccagagcgaggacggttctcacacccatccagaataaatgtatggctgcgacgtgtggccggacggtcccc

SEQ ID NO: 538522 - DNA, 326 bp, Homo sapiens
cccttaaaaaataaaacgggggaaaaaaaacaagacctgaaaatttttcccaacacaaaggggttttgggtttttaaaaaaaactttatggggggggaaagggaaccctccccaaataaccccttttttaaaaaaaaaacaagggaaattaggttcccgggggggggatttaaaaaaaaaaaaactttttttgggaattcttgtaaaaaaaaaagggttggggaaaagaacttttgttaggaaaaaggggggccccgcttttttttggggaagttgccccccaagggtcaaaaaatttttttttttggggaaaaaggggtttttta

SEQ ID NO: 538523 - DNA, 697 bp, Homo sapiens
gtgttctctagaaacttcttggggggccccaccggttaatccgccggccgtagtgtccaaagcggcccaccaggggtggcttctgggggttcacaaataatgacccctgacaattgctcccgcccgcccctccgtacgtggggacagaataagtcgcgttgattgttggccacaccaacgtggatgcgagcggacgttgtggtctctcttgtccacccacccacattggcgggccgcgccccggggcaaacttctgtttcgccgccctcaacagcgagccactaggttccacgcaccactgtggtggtctaaacatataatatgactcctctcctgagccagctccttgttacagcggtcctctgttttggcggagtagcagataatatgttggttctcacatcccgcgcgggacgcgcacgtcccgcaattggtgaggaacatcttgtaaaaaacatgacgtttcttcttattctctcaccagtttttctgcttgacgccgccactctcttttagaggattggacgattgttttcaccactctcttgtaatggcgcttctccgcgagagggtcgcccaaaaaaacaacgactgatgtgtggagagagtgcggccgcctcccttgtgacaatactatgacccgcgcggttatcccgacagcatctctttggaaaaacaaaatagacaaagaagaata

SEQ ID NO: 538524 - DNA, 228 bp, Homo sapiens
ctgtcggagctgcaggtggagcagacatccctggagcccctccaggagagcccccgtcacacaggtgtctggaagctccgggaggtagccaccgagggcattcgtgggcaccgcaaaatggtcctctacaacctgcgggcaaccaagaagccccaagatggtcaagagtcttgctcttttggaggaagattgaaccgatcaacttcctcaattgtcttggcctcaaaa

SEQ ID NO: 538525 - DNA, 378 bp, Homo sapiens
gtcgactctaagcgatcccccgtattcgatgtgttctggaatatggttggaccatgcaggcatgatgacataatatcttcatgcataggggtatggaaggactactcacaaccattctgaatgacaatacattgcatctacttttgtcgatatacaccaagcacttacaactcctatatagttcccataatggatcgtgatctcacaggtaagtgtagcctgggtttggcaaagttacgaaatcatgtggtctaaacttctcatttctcagatgaagtaactgaacaccaacaagaataatggctcttccaggtgtggtggtccatccctggaatcctacctactcacgaggctgagactgaaagatgtattgactcc

SEQ ID NO: 538526 - DNA, 197 bp, Homo sapiens
ccaactttagggcgagctgcagtctgtgcaggtcttcggacgcaagaagacagcgacagctgtggcgcactgcaaacgcgacaatggtctcatcaaggtgaacgggcggccccaactcagggacagccggagagaggcagagaggctggtgcggcaggcgggaggaggaggaggcaccggcagctcgcccctgagtt

SEQ ID NO: 538527 - DNA, 1417 bp, Homo sapiens
gggcagttctgtgctgtgtcccgcgggtctgtctcttgctttcaacagtgtttggactggacaccatgatcctggtgggatcgtcattccaagcctcctgtactgccctcctgatattcctctcctgcattgcaaaccctcctgtgtgaccaatcttctctgtgccatcatcctgcttcttgtgtgaccttgcctagcaacctgtttatttggtggttaaggctccattcattgcccaaccaaacgcatggagctcccgagcattctgtcgaggcaattatttgccacctgaacgttggaagggcaagcccggttctaaacatgccttggtcgaaattttgttacccttgcatggtggcctccatgacgacgcctagcctcatactctatgggggctttcctaattatgtccggacccggcggaatggattgttgggcctccttgggaaacgtgcctgttgcaagccacaacgatcctttcactggggaaaccctgtgagccgagaaggaatgaagagcggcggaaaggggtggctcacactgaagcactgtactacccctttgaagagaagttgactaacaaaagagccccaatggtcggattgtgtcagtgtgccccgggagcgagcaggcagtatcttttccccaatggggacacacttctcaacagggaacaaggccacagatgctgattgagacgacggaaattggaagggattggggcagggttaaaggaaacagcccacggggagagaactagtgcccgcattggtacaacgagtgcaggattaggcgccaaattaggtgccgcaccgtttggtaggctagaggaaaacatgaccatggtcccttgggaagagccagcccgaggtggtggcaccacgcagtattgttgtgggggctaggttcacgttgaccacacagtgtgaccctccgcgttgtgtggggatttacattgggcacccgccgggcagaatagagtgtgtcaagcgcagccgcgcgcaagagttactatcacgtggtgggatgagaaacgttatatcgacccattggtgcacagtggacaagcttaccagagtgattgttcgcgcggtataaggaaaattgtaacggttggaaaccagtgtgttggaaacagggcgccgtttagtaaagtatacaacagagcaaaacaggacaacagttggagagggatgagaacctaccatagccgctcatttgcacacggccaacagagagccatatccccacaccaggtagaccgtatggggagtgctaggggcgcccacgtcggtaataggtgacgatgtgtggtagatactatgtgtggtgtgaccaagaagaggagatcatacttatcacatcacccagactacgagcacaagatagcgtgcatctacaagagtagtacgttcaa

SEQ ID NO: 538528 - DNA, 170 bp, Homo sapiens
  misc_feature (2)..(2): n is a, c, g, or t
antacacagcgattgacatcctagacgtatcacccatttaaagagtgcagttttgcaaaccataaaaaagaataagatcatgtactttgcggggacatggatgaagctggaagccatcatcctcagcaaactaacacaagaacagaaaaccaaacaccgcgtgtattccg

SEQ ID NO: 538529 - DNA, 480 bp, Homo sapiens
gaccagccgacattgcggttagagtagcatgggcagcgtctggcctcggaagtaatgaacacttggattttgagtagcacgcccacatttctatcccagtctcttagtgataatgtttgtatgtacaccagtcctgactgccatgggtaataatgtacagcagcaactccgaaaatagcaaatttgattagaaaaggatccagatcaaagggtgccagtaagaaagttcagccacttccaatttctaccattatccgaggcccaacattggggggcttctggttcctgtgacagttaagcggggagagcaaaatttctcttcaacctatagcaactgtccccaatggaggcacaatatcttaaaatcagcaaaattgtacttttatctactaaaaagcttgaaaaagagtcatgaccatggatccaagaaatttcattctaaaaccaagccaggttttcttaaaaaagacaaagcagtag

SEQ ID NO: 538530 - DNA, 265 bp, Homo sapiens
  misc_feature (50)..(50): n is a, c, g, or t
  misc_feature (75)..(75): n is a, c, g, or t
  misc_feature (156)..(156): n is a, c, g, or t
agaagagctgccacttgcccctcgctctccaggtggactctgcggttttnaccccacggcacaaagtagccagantacaaaaacttcctgtttgccacccagaccttctccagctactgagaacttgttccggtgatggagcctcaaaggaatttntggattcctctcccacaagtgtccaggggcaggggtgctgtgagaatgtgcagttcacaaagggagtgagaatggcagtcaaaagatgtatagagttaagggaaagaag

SEQ ID NO: 538531 - DNA, 1404 bp, Homo sapiens
  misc_feature (631)..(631): n is a, c, g, or t
  misc_feature (1140)..(1140): n is a, c, g, or t
  misc_feature (1143)..(1143): n is a, c, g, or t
  misc_feature (1160)..(1160): n is a, c, g, or t
tgacagtcacaggttattaccgttgctataggacctctatgaaggcattccaaatacttgttgggggggcttgtatagtgccgtgcccggtatagatctagaattctgtgctgcggaactataataacgcttctagctccagacttcacactaaggaatgaacgtatgtaccttcattactctagtggggtctagtgactcttggctattagtgaatagtacttgggatgtatggatcgtagatcctttcacagtcctcatacgatcgtcaatagtactgcgtcttggagtcaagcgcgtcacgcctgatgagactctacctaagctggacttcgtggattgggcatcctctgttgagaactccatttcccaaggtggcctctgcttaggcgcccttgacacagtttgctctactcgcaataggccgctagcgcacgcctaggattctaaattatcagattcgaattgtgctatctaattggtcaacaagagtatgcctactagtagtcccccgttgacaaagtgggcttcattggttagttcccaaaaggaagagaaccaagattgaaacttgtacctaattagggagatcagtcggggggggtcctgggaagtccgataatacgttgcncacttgagaggtcatcgacttagcaaaccttttggggccagatgggatgaaccaccgtttctttcctctgtgaacccacgctttgtagcatccctctacatgattcgtttttgaaggtccttttaccctttttttggaccttggtgtaattatccgtaataaaggcctttccccgtttggccttgggttaccgggtggccgtacctcattgggaaatgggacaggttcccttaaacccctttcggtgacagttccgcggcccgttgtgtgaaccccggcgcactataatgttcactcgccgtatacgcaaccgctgttagttcaaagaatgcgccaagagagaaggttccggagggacagaccccccccatagggagtcacactccggcggaatatttggaggaccgaagatacaccacgccggggctgggcgtaacacaagcccggcgcccccagttgtatattttttgttttttctcggtttctttaatttaaattaatttacttanacnctcctactacctactcncagcggcgcgaacacgcccgcagaaccccaccgacccccgcgcggcgcacaccagacggcacacggcggccagcgcacgccgagcatcctacagcgcccgccagcggcacacagagccgcccccccaacgccgcgccgaccccgcccaacccaacacacaacggcaacacgcagcccacaggccgccagccccaggcccacccccgcgagccaagcgcacgtacaggaccccccccacgccagc

SEQ ID NO: 538532 - DNA, 188 bp, Homo sapiens
  misc_feature (163)..(163): n is a, c, g, or t
  misc_feature (172)..(172): n is a, c, g, or t
gatcctttgagcccagaagttggagaccagcctggacaacatgacaaaaccccatctctacagaaaatttaaaaattggccaggcgtggtcgcgcacgctgtagtcccagctattcaaaaggctgaggtgggaggattatgtccctggagcccaggaagtggnggttgcagngattgcatcactgcat

SEQ ID NO: 538533 - DNA, 391 bp, Homo sapiens
  misc_feature (241)..(241): n is a, c, g, or t
aaccattggtgtcttccgacacagctggcatgtccttctcaaacggctctctcctctgttctacctcaccagaagtcagagagaaaagcttctttgggggaaatccagaaagcacatgggccccatactccttccgaacctgctcgtacagccccagaacctgctgtgtagcgcaccccacagtccaggcctccattcacgtgaatgtatatagcccacgtaggcgaacccgccgctgtcnccgttgcggaactcgtgtttcggaatatggaaaagcgcatgttccttgcggcgcggcgcgcccgggctgcggtctgtgaggcccacagcgtctgtgcgcgctccccctcctgtgcacagagagtccgcacagcctcactccccattgtcg

SEQ ID NO: 538534 - DNA, 812 bp, Homo sapiens
  misc_feature (93)..(93): n is a, c, g, or t
cgcatttcgtggacgcgggtgagtgagagagttgttggtgtgggccggagaaaaggggaagatcatcggaggtgtggatttgagccgccgatnttttaacctagatctcgaaatgcatcgtgattcctgtcccatcggactgtacggtttatgtaggcaatctgtggaaacaatggcaacccagacggacatggaaacgggcttgtgctactatggaccactccgaagtgtgtgggtggtagaaaacccaccggctttgtttgtgtcgaatttgaagatccctgagatgcagttgatgcagtcggagagctagcatggaagacccactattgttggctgccgtgtacacgagtgccacctgtccgaatggtgcaaacaccgaagtcgcctcgtgcccacctccctctgtggggtcgtcgccctcgagatgatctcgtaggaggagtcctccacctcgtcgcagagtcaccatcatgtctcttctcaccaccctctgaattctgcatatacccaagtcatatttaagccctttacaggcgtccatgttgacccagcggcgccccaattacaagttggggcgggggtgtccgttccacattggagcccaagcgcttgggccaagtccgtcaggtttggacaccggccctttgtgggtccccggacgcattgctgtttctcttccggcaccttctcctccacaccttcaaccaaattccgggcggagccaacctcggacggccccaaattttcggggcaatcacgccacggcgtcattcaccactgcgctccacaactcaagcacgccctcggca

SEQ ID NO: 538535 - DNA, 231 bp, Homo sapiens
ctttaaataggaaaaaaaaatttttcccttataaaaaggcttccgttgtgatgaaaagtccttttggttgtcccaataaacttacccctccttccttttccagcccttttaagggttggctcccaaacttaaccctttgtttttgccaatcaaaaaaaccaaatgggcttgggccccgtgtgggtaacttccttttttttttgggccggtttataaattttttttttttta

SEQ ID NO: 538536 - DNA, 533 bp, Homo sapiens
  misc_feature (32)..(32): n is a, c, g, or t
  misc_feature (73)..(73): n is a, c, g, or t
  misc_feature (122)..(122): n is a, c, g, or t
  misc_feature (131)..(131): n is a, c, g, or t
  misc_feature (147)..(147): n is a, c, g, or t
  misc_feature (208)..(208): n is a, c, g, or t
  misc_feature (217)..(217): n is a, c, g, or t
ggccatgaaacgaggactctgactccggactntaaagataatccgtgtgtagtcactagttgtggtattgttncgtggcacagaactaaatatcccaaaatggtgatgaaaaagtgtattangtatgattnctttactaaataaaanacggcaaactatcttgattttagagtcaggatagtaactttcagcagaagagacgtgttanatggggaanaggagggcttctggggtacactatgctctgtgttttgatcgagactagtatgtgagtttgtttaatttgtgaaaacctttatttgtgtactgttttgtgtgtgtgtggtatatgcagttttaaaaactgatgccttttaaacacttactaatctgataatctgccgaaaaagaatatataacatatattcaaggggatggaaaattacttactgaacaataattttatttctcaagaacgctgaagattttgtttctctcttcaaaagatttaaaaaattttaactggcaaaacataatagtgactcttaaatgcc

SEQ ID NO: 538537 - DNA, 132 bp, Homo sapiens
gcgctagcagctggccaccaaggtggctcgtgaagagctgctcctggccaccggcggtgtaaagaagccccatcggtggcgggcctggtacagtggctctccgctgagattctgccgctaccatgaagtcca

SEQ ID NO: 538538 - DNA, 1091 bp, Homo sapiens
gggtatcaaccctcctgatctggacatcatgaataaacctccccggaacccaaaggaaccattgatcagacgggtggctactttttccgttacttggctattggctagttacgtacggcgttctgctaccgtgggtgctgctgcatggctggttcatatgctagctgacggtaggtccaagagtgtcctatctacacagctgagtacatattcctacagtgtacacagaggacaacccggactttcgaaggcgtggatcgtgcacatcttccgaatccccatacccgatgacaatggcgctactctagctatctagtaactatagaacatgtgtaacgccctcaacagcttgtccgaaaaccagtccttgctgcaggatagcacccacctgagagaaacatctaggctacgtgggactcaatactagacctgctccatgtcactccaatatcctgatcctctatgtcgaacccttgcccactcatcttccagaatcacacccgctgacacgtgaaccagtggccgcatagctgcctgcaacaatactcctgccccgtgaatctacatggaagacacgcctcaagatacgcgccccgccaccctacctgcacacctgcaacctcctggccgctacccagcctaccatacaaccaattctcgcacacaaacacttcacccgctagaacacgcaatacctgacctctgtacatacccaacccaacccacactctaccacccacccgctccatcaactgcacgatacgaccccatccaccacaccctcccaccacatcacacacaactcatcatacaccccactctcccgacacaaacacccaccctaccccactccacaccctcaacactcaccccttccacaccaccaatcacgcatccacaatatcacttaccactcacacaccacaaaacacaacacacaacaccagccacacaaaaaccacaactgccatccacacctcgacactcacctacaccatcctcacctacatccactatctcaccacatctaaccatacaccaacacacaccccactccacacaaattataaccagatctaccccccatcacc

SEQ ID NO: 538539 - DNA, 173 bp, Homo sapiens
ctagtgcgcgcatggtgcttggagcatagcgtgtctaaaagcctggataacggaacggtttggacggcaccagcctcttgaagccaggacaggcatagcatggcaaaagccactgagcagggacgtccgggtagcctgcagccacttgcctgctagcgggccacttcactcgc

SEQ ID NO: 538540 - DNA, 528 bp, Homo sapiens
agtgactaatcatactaatttttgttgtgatatggagctttttagatttttggtcagttcagagactggccgattctgcaggaaacagaacactggcaaagcatgggctttgagcactagtcccagttaatccactacatggaaactctacatggagccgtggtttaacacacacagaaataacacctatctcataacactgttatatccagcaatttaaactggttattttgagaaaggatcttgctctgtcactcagtctggactgcaatggcacaatcacagctcactgcagcctcagcgtcccaaactcaggtgatcctcccgcctcagcctcctgaatagctgggaccacaggcacgtaccaccatgcccagctaactttcaaattgtttttgtagagacagggtctcactatgttgtcgtccaggctagtctcaaactcctggcctcaagcaatcttctggctttggcttcccaaagtactgggattacaggcttgagccattacacctggccaaatacgtg

SEQ ID NO: 538541 - DNA, 192 bp, Homo sapiens
gggcaaaggcccccccctttttttttttcccatttttgataagggcggcccaataattttttttaagataccccaaaaattttggtttttggaaaaggttttaaaaaaaaaagttttggggggggggttggttttggggcccaaaaaggggttgggggctttttttaacccctttacctttggttggtttta

SEQ ID NO: 538542 - DNA, 133 bp, Homo sapiens
gactctgaggatcccgacgctcctctgtggggggagttgttcattcctcccggttaggcttggtggtctcgatggcatccaggagtgcatctattgacctttgtggtgatgtgtaacagcctcttaagggcag

SEQ ID NO: 538543 - DNA, 368 bp, Homo sapiens
gacatcacaggccgtaatagcgctgtctgtgtgtgagcccggcatcgctatcgcggtccacagtcaggatgtctccatcccacattgcccagctgagtggcggagttggtggatcggatattccttcctcatgcacatggtggcgggagacgaaggcggtgcgcactcactggtgtcaccgggcagctgtctagaggacttcctgcgccagcccattcatcgaatgcaatggaggccgggaaccttggccatactacggccaaacaagtacagcttcggagtgaccaccattccccgagcagcgcttccaggggctcgcccacggctgacatgcctcaaaggcccggtctcatcccgaacacacatca

SEQ ID NO: 538544 - DNA, 355 bp, Homo sapiens
cgggccttggctgcctggtcacggtggtctgggttgcgggggtgtaatgatcttccccatgatccatacccttataccaaccatacactgaggtgtagtaaggggagcgtaagcttcagctgcaagccaactgcgtggtggagtgcatgtctcgctcgtgtacgtactcgatgaaggcataaccagggggctatccagacctgttacggtaagaccatgtgtatacttaggataggtcggtacacctcaaaatctctcgggagcttggatacttgttgtgtcataattcactctcgccaggaagagagtctagaaggcattcccctaagcatagggatcattgtgagggtcccac

SEQ ID NO: 538545 - DNA, 167 bp, Homo sapiens
cctagttttacgaagttcaatagcaaagcttaaaagacaagtgaaattactttggtcacatgtaacccattgtatctaaaatattatttcaacataatcaacacaaaaagttattgcaagacactttactttctatttttagtgctattgaaacttctaaaactagg

SEQ ID NO: 538546 - DNA, 106 bp, Homo sapiens
tcagatcgacgcagtgacagagatatatgtacttctgataataatggaggtagcgcaatcgcgtaagctacgtatgccaactattctttaacatattcggatggtc

SEQ ID NO: 538547 - DNA, 550 bp, Homo sapiens
  misc_feature (174)..(174): n is a, c, g, or t
  misc_feature (363)..(363): n is a, c, g, or t
  misc_feature (409)..(409): n is a, c, g, or t
  misc_feature (429)..(429): n is a, c, g, or t
  misc_feature (451)..(451): n is a, c, g, or t
ctcacaacaggcacaggagctggtgtgctttccatcccttccgggctccctacccctcacttccaagggttctctctccggcttgcgcttagtgtcctacagggggtggtgaagcgatggagctcctcacgggactcgcctctctcctctcctccccccaggaggaactggaanggagggtaaaaagactaaaaggagggggaacagagttcacggtacaaattggacaacggtcaccaaaattcataaaaaacaatagtacggtgcctctttcttctcaaagaagggatgacacaaaactatgagagtgacaaaagggtgacaggtagcggggacctaggctatcttaccaggagggtggtntggcttatggtatatgggtgtatgtagggtaactatttggtacaanagaggacggtaactactatngaggtggtacagatggaaattnagtggttgcatgggctggcggaggaggggtggacttttatatatagatctacataagaagtgctacatgacaaaaaccacacctaaagaaattctaaga

SEQ ID NO: 538548 - DNA, 344 bp, Homo sapiens
ggtaacaggaaacccccccccagttgcccggttcggtggaggccattcttgggacaggtttttttgtcagtgaacaagggggtcattttgggaggggtcggcggtgttggcgcccgggtccctggtgccttgccctatttgggatagccagtcccctggaggggggcttgggccagaggagccaccaaaaacccaaccttttccttgagaaagccccctccttgttttaaaaaggggctccgtgaagtttttcccaaacccgcgctgcctccagtgcgttttgccctttttttcaggggggtaaatctgtaaaatcccattttctgtggcctgtttttcctgga

SEQ ID NO: 538549 - DNA, 110 bp, Homo sapiens
gatatttgcatgcaaggggtgactggaagggcctgaggattacagtagagcagattgaggtggtgccttctgctctatatagaaacagaaaaacattaaacacagtggga

SEQ ID NO: 538550 - DNA, 537 bp, Homo sapiens
  misc_feature (39)..(39): n is a, c, g, or t
  misc_feature (66)..(66): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (152)..(152): n is a, c, g, or t
  misc_feature (210)..(210): n is a, c, g, or t
  misc_feature (225)..(225): n is a, c, g, or t
  misc_feature (241)..(241): n is a, c, g, or t
  misc_feature (243)..(243): n is a, c, g, or t
  misc_feature (250)..(250): n is a, c, g, or t
  misc_feature (253)..(253): n is a, c, g, or t
  misc_feature (255)..(256): n is a, c, g, or t
  misc_feature (271)..(271): n is a, c, g, or t
  misc_feature (278)..(278): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (301)..(301): n is a, c, g, or t
  misc_feature (306)..(306): n is a, c, g, or t
  misc_feature (313)..(313): n is a, c, g, or t
  misc_feature (316)..(316): n is a, c, g, or t
  misc_feature (321)..(321): n is a, c, g, or t
  misc_feature (325)..(325): n is a, c, g, or t
  misc_feature (331)..(331): n is a, c, g, or t
  misc_feature (349)..(349): n is a, c, g, or t
  misc_feature (359)..(359): n is a, c, g, or t
  misc_feature (528)..(528): n is a, c, g, or t
tattctgtatgtgcctccctcatttctaatgatagtgcnaattgtgttaaataagccaaataaccnttgccctcactctatgaacatggggctatgggaanacantnctacaatctatcatcatttatttaggtttttaggctagccagctnttttttttcaaagctttcttttgtatttttagttcctattttaatcctaactttagtntactgtgtttgtganggtgtctgagtttttntntgagggntangnnaacagttcagttcanaaacacnganaatntnctttttttttttanttttntgttttnagngggcnttgngggacngggcagcgcttaagccanaccaaagtcnttggaacactgcagatttgctttagaggtagataaaacagaaatcatgcagttaagtcaattgagaaaaaaaaagggatttgttgtctttacagaacatcatgactaaaagttgatcctttgctcttggtgcacatttaagattttacctgttttgggaataccaagtnttcttgtct

SEQ ID NO: 538551 - DNA, 1035 bp, Homo sapiens
ggagagagagactagtctcgagtctttgtttgttttttaaggttggagggggaatgctgggagatggtaaggggtatggagacatatcatataagtaatgctagggtgaggggtaggaagtttcataggaggtgtatgagtgggtcgtagcggaatcgggggtatgcggtcgaattcataagaccagggacggtcacaagtagggtctgggggacaaaatatgtggtgctagagttcaggcgagagtgcgtcactatgtggttcctaggaagatggtcagtggcgagggtgtgatcactaacacgtgtcgggtatccggtatgacagaataggccgaggggcctgcggcgtatcgatgtgcgaaggccgcgagcactagtacggacctcccctttcggcacaaggtcgaagggggtcccggtgggctctctgccaagtggtgggagatcaacatccataatatatggccaagggtcatgagtggcagggagtcactcacgaggtgtgctcgtgtcaagtcacaacggcttccggagaggtctaacggacccacctatcttaacgcgaatcgtggataacgtacaaatgatcggccacccatgccactccatatctagatcacgcgtgcggtcctagctcgcgcccgcacgccgcacccggataccagggcgaaagttgccggccgcgaacgcgcaacacggaccccacgggcatgaacttccacggcacgacagaagcggtatgaacaaaaccacggagagttccatggcggcacgctcatccacgagcgttggacttgcgcagcgcgcccacaactccaccgaggcccgcaaccgacgcctgcaaggcacactgcactcggacggacagcgacgcgaccacgagccaccggaaatgacccatgcccgcaaggatcccacgccgccagcacaccccgcgacagcacccgatactccacaggtccaggacaaaacgcgccgacaacgaacacccgacgcatgcactacacccatctgcgtccacacgcgcacgacg

SEQ ID NO: 538552 - DNA, 375 bp, Homo sapiens
cggagaggcagcgcggttcctctgggtgcttccgcttcccttcttctgcttcttcagcctcttcgggcttctcggccgcgcgggaacccgagaacccagtgtatgacccacccctgaccccgctcgcgacatgtccaccccggctcggcggcgcctcatgcgggacttcaagaggttgcaggaggatcctccagccgcgagtcagcggggctccgtccgagaacaacataatggtgtggaacgcggtcatattcgggcctcaagggaccccgcttgaggatggaacatcttaacttacaatagaattcactgaagaatatccaataaaccacctacagttagatgtgtctctaagatgttccatccaaatgtcta

SEQ ID NO: 538553 - DNA, 300 bp, Homo sapiens
  misc_feature (38)..(38): n is a, c, g, or t
tttgcccccccccccccccggggggttttggccccccnttttggggctttttttttccccccccccgcccaaaattgggccctcccttttttcccccaagggccggccccccttttggggggggggggggttttccctttttttcccccttccttttagggggggggctttaatttttttgggcccccccccgggggggggcccttttttttttttcccccccctttgggggggaaaaaccccccttttcccggtttttgggggtttcccccgaaagggggggtttttccccccccccca

SEQ ID NO: 538554 - DNA, 331 bp, Homo sapiens
ccgtctgggcaaaaccactgacgcccagtacagccgccgcagagacgatggccagggtggatttcaataccttcattacaaacctccaattgctcttgttgtgtcggagctctaacctcagcgcacccttatgaggcgatatcgacccgtgttggttttttttggggccaagcagcatgaggtttttgcggtaattccagttgctttcccacgagcggcagtcactgatagtgttaccgccctgggagagttctgacatcgagctacacatagcaaggcgcgtaccagagtcttggccgagtggctgtaactgcgcttcgatggcaaaaga

SEQ ID NO: 538555 - DNA, 225 bp, Homo sapiens
gccaagcacagtcacctccagatcacagtggatgtatcccactttgctaatgactccagatacatgatatacttaacctgccacctgagggacaccctagctgagcaggacccagatgaactcaacaaggcctgatccttcagcaagccttccaacagctgggtcccagcggaaggcccggctgacatctgccaatgctgtaacaaagcgtgactgaggcactcc

SEQ ID NO: 538556 - DNA, 638 bp, Homo sapiens
caggagtatgtggacaagtttggaaaaagattctcgtgaaaactttaactatacggggggcacccagacgggagttgttaaacaaaaagaggggcctatttgcgccgccaaacaaactatcatgaggggcaagcctccccgcccgccagtagcatcaccacgcatgttccggagaagttttttctccacacccacggtggatttgttcgagtgagcatcttttgacgagaaagatacttctggatcctcaagttaaagtgagtagccactttattcacgccttcgagctcaagaaaagcactatttgttaaacttcttcttcagaatatatcattaaagcttggtccacatctcttgattctacaaacaccacgcgccgtgttctccttgtctataagagaccccccccctttccgtgttggtagagtcccacgacattatcaacacagtagttatgagattgtatattacccccttattatctctctacagacatatatattatgtaagactcttctctcactctctcttcttactaatcagatgtagtcgaatctttcttctctctctctccaccccgctcccatattcaacaaaaagaccgaatttaacattccacacaaaaaacaacaaatcaa

SEQ ID NO: 538557 - DNA, 929 bp, Homo sapiens
ggtaccactgtactccagcctgggcgacagagcaagactctgtctcaataaaaaaaaaaaattacaattaagaggtgtttactggatgattcttcccacttcatttgtgtttgtgtccagaaagttaaattaaagtgttcggcaagtttttccaagttaactatttggtttttgggggggtttttgtaagttagaagtctctggaagtctgtcacccaggcgtggagttcaggtggtacgcgcactcggtcgtgcgggtaattctggcgatctccaggcctccggcgagagaccttaggggcacacgggttgttacgcttacggggccgggtgggttatatcaaagggcactggcgctgtgttgtggttaccaacacatgtgcgtgcgatgttctgtagcggagcgtgcctatacataagggtgggtcacgcgaaaaacatattttaaggtcccaaagtgtatatggaccaccaagggggactaggtggatcatcatgagaactttccacagtgccggccgtaacaagtggaagttcctagacccaaacacgcggtagtattggcgctgtcaacccaaaccagggctgaccttggggagaaaaatccgcacgcgcgacatttcgcatggcgcgaaccgcggaaaccacccgatctaccgcccgttaccgatttgcaccgtgtcggcattatgaaaccaaggtatgtatgaacaggccagagggaaggttatactctcactctgaggaccatttcttctcccttcaaaaaatttatagacaacatttcagggacggttcacacatattttcaccccattaggaatagattgcatcacaacatacgtacaccagtcggtgtggaagatacttcaaacgccttcaagcagttgggcacactttttaggagcagacaaaaaggccaattgatg

SEQ ID NO: 538558 - DNA, 356 bp, Homo sapiens
agggagaaagtttgtgtgtgttgtagacagtgaagttgtggctcaaagcttttaatatgaatgttttattcaccttaatttctacattctacatttaccttgagcataatagttataaacaggcccggccaggcacggcagctcaaacctgtaatctcagcactttggaaggccaaggcgggcagatcacctgaggtcaggagttcgagaccagcctggccaacatggtgaaaaccccgtctctactaaaaatacacacattagccaggcatggtggcgcgtgcctgtaatcccagctattcgggaggctgaggcaggagaatcgcttgaacctgggaggcggactttgcagtggg

SEQ ID NO: 538559 - DNA, 400 bp, Homo sapiens
  misc_feature (11)..(11): n is a, c, g, or t
  misc_feature (112)..(112): n is a, c, g, or t
acaaagttgcnaaaaccaagcaatggggaaaggtctccctattcaataaatggtgctgggataactggttggccatatgcagaagatcgtaactggaccccttttactatgnacaaaaattaagatggtttaaagagttaaaacccaaaattataaaaatcctgaagataacttaggcaataccattctggacataggaactggcaaagatttcatgatgaagacaccaaaagcaattgtaacaaaagcaaaaatggacaaattggatttaagagctttttcatagcaaaataaacaacagggcagacaatctaccaaatgacagaaaatttttgcaaactatgcatctgacaaggggctaatatctagcatctataaggaatttaaacacagttacagg

SEQ ID NO: 538560 - DNA, 618 bp, Homo sapiens
ccttaagtatccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtt

SEQ ID NO: 538561 - DNA, 564 bp, Homo sapiens
ccttaagtatccaactatagctccacggccagaagataccagcagctctgcctttactgaaatttcagctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccgacctgggggtgtctgggctgctaaactcatcagccgttccagggtctatcttcagggattaatagactactatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtt

SEQ ID NO: 538562 - DNA, 409 bp, Homo sapiens
aggatccccacattgttgcgatatatcttttggactttttgtgtttttttaatgagaattctgtatttcattacctaaagaacaatttgctaaacataataaatcactcactttgattatgtatagataacataggaagaacaatcacatcagtaagttatagttaatattaataggtaattttctgttggctcataatcaaatataccagcattcattatagcatttcagcattttccaaggtaccaagtgtacttatttatgttgttagttagtatatatgttagtatttttagataggaattacagctactagatagtttttcaaagaagtaccagacatctctgtatatatgctacataacgtatacaaatagggtagtaacatcttatcctagcaaatttatgg

SEQ ID NO: 538563 - DNA, 115 bp, Homo sapiens
aaaatagcatgatcagctcggtaccccgtatgcgggaacgggcgtgcacgttctgcatgtaacggtcgcgcgagaccttggccaggatcgaggcggccatgatctgcgcggtcga

SEQ ID NO: 538564 - DNA, 347 bp, Homo sapiens
agatgatgaaccatgtgtctgcgtgaatgcatatataatacatgatactgttgattgtaaggacctgaacctgaagtttgtgctgtaggtttatcgggactattaccttacgggtgatcctttctgaaggacatgtggcctgctgtgatggaatctgtgaagtttgacaaggaccatgatggactcattggtgcttactgtggagggctgtggctggcagctgtggctgtgaaggtccacaaggctgctctgtgtggggcacaggacattcaggataaggtttcttctatactcagacgcggccaagaagcctatgagagactgctgtggaatggccgctattacct

SEQ ID NO: 538565 - DNA, 328 bp, Homo sapiens
cgagagggtaccgggaagcaaggtagttcttgatactcgaaagtgtagtcggctccaggatgacatcgttctggaccacgatgctaccgttgagcaatctcgcggatgttcacccctctatactgaggaagatgtcgcccttcaaaacgacatccatccgattcttgaagagggtactgaagtcctggtattcctgggaggatgcgtcattcatcttttctgtgaaatttctgtaagtcactttcggtgtcatacctaaagtggcgttgagtttttccggggtttctacagggaaggattccagaggggacaagcactggtaaccaac

SEQ ID NO: 538566 - DNA, 125 bp, Homo sapiens
tgtcacacaaggcacacctacaccccttattcccattctagttattatcgaaaccatcagcctactcagtgcaaccaatagccctgggcgtacgcctaaccgctaacattactgcaagccaccta

SEQ ID NO: 538567 - DNA, 98 bp, Homo sapiens
ctataatggcagcaggttttggtatgtatttctttgatatattgtcactttggacaacaagtccgatttctgttaataaaacttgctcataaacccta

SEQ ID NO: 538568 - DNA, 195 bp, Homo sapiens
ggaagggttcattgagcagaggcaggcaagtgggtactgggcgaaaggggtcagggccggactatcggagaggagcatgagggggactctgtgttgaaaggggcaagacccggtgatagaagcttagtactttggctaaaaggtctcagcctagaatggtggtggggcaatgaggcatgataaggaaagagtgtg

SEQ ID NO: 538569 - DNA, 313 bp, Homo sapiens
  misc_feature (69)..(69): n is a, c, g, or t
gggtttaacctgcaattcctgcctgtgttgtatcctcacgctgacaggggctgctcagcagcagacagnccgggtaggtgtgtgtgcgcgtgtgtgcacgccattgcgtgcccctgtcccatgggggcgatgtccgagcatgctctgtggagttgatgcgtggccctggagtgtccggtgcttcagtgacccgagctgctgtgtgcgtggcctccgtccgcccagtcattctggcctgtctgtgactgctcagggggtttgggcagagtgggtggaaatgtcttgctgtacgagatccaggcttaggtccctt

SEQ ID NO: 538570 - DNA, 744 bp, Homo sapiens
  misc_feature (34)..(34): n is a, c, g, or t
  misc_feature (88)..(88): n is a, c, g, or t
  misc_feature (96)..(96): n is a, c, g, or t
  misc_feature (121)..(121): n is a, c, g, or t
  misc_feature (134)..(134): n is a, c, g, or t
  misc_feature (154)..(154): n is a, c, g, or t
  misc_feature (159)..(159): n is a, c, g, or t
  misc_feature (174)..(174): n is a, c, g, or t
  misc_feature (214)..(214): n is a, c, g, or t
  misc_feature (224)..(224): n is a, c, g, or t
  misc_feature (227)..(227): n is a, c, g, or t
  misc_feature (238)..(238): n is a, c, g, or t
  misc_feature (298)..(298): n is a, c, g, or t
  misc_feature (300)..(300): n is a, c, g, or t
  misc_feature (307)..(307): n is a, c, g, or t
  misc_feature (310)..(311): n is a, c, g, or t
  misc_feature (314)..(314): n is a, c, g, or t
  misc_feature (319)..(319): n is a, c, g, or t
  misc_feature (322)..(322): n is a, c, g, or t
  misc_feature (330)..(330): n is a, c, g, or t
  misc_feature (332)..(332): n is a, c, g, or t
  misc_feature (334)..(334): n is a, c, g, or t
  misc_feature (344)..(344): n is a, c, g, or t
  misc_feature (354)..(354): n is a, c, g, or t
  misc_feature (425)..(425): n is a, c, g, or t
  misc_feature (436)..(436): n is a, c, g, or t
  misc_feature (441)..(441): n is a, c, g, or t
  misc_feature (450)..(450): n is a, c, g, or t
  misc_feature (511)..(511): n is a, c, g, or t
  misc_feature (513)..(513): n is a, c, g, or t
  misc_feature (561)..(561): n is a, c, g, or t
  misc_feature (615)..(615): n is a, c, g, or t
  misc_feature (705)..(705): n is a, c, g, or t
attaaaaattaaagtattacaatatttacaaganggttggcaggggacacttactagtataaaaataatacaaatattgtattttccncttatctnccagtcaaaatggcaaacagttttntctttctgaagtntctagtcaataaccaaagangaggngcccctaataaagtnccttgccctgtatgccccactgtttatagctttagacccncaacattctnctncaagttcagcngccctctttcttgcctccttttctccagtttaaatgccaatttgttagctttcttctccncnctccgtnccnngcnccccnctnttatagcntncntccttgcccncttatctccnttgcctccatttttagaacgtggctgagttgatactttaggaagatcactgccattaatcatctgtatccnttcagtctgcnttgcngtcagtccntcctttggtaagacattgagaggtattcctgtcttagaagaaattcgaatttgtttgggcntnggttgacacttgacaagccgtggatggttatataaatttgagtatgtnccacaaatagattcacaatcccacttctctttggcttcttcaaggactacagtnatcatttcttcctcctcagactcatcaagctcattcattggcagggcttgatcctccaagggttcaagggtattcaattttacacaattntctgccttctctttatagtagttattcaaaacttcctgt

SEQ ID NO: 538571 - DNA, 703 bp, Homo sapiens
agaggaatgaccggggtgatctaagagaaagacacgctctaagagactacaggtaccgaagaggacctcctgtcagatcacaacgtgtagaagacagttcttgaagacgtgctgatgacaggaaagatgaccgagaggaagagcggtaccctccttgaaaagttcctaccgcagctctttcatgagaccgagaaagagaccgagaccttcaaagagaaggtgaaaaagagaaggcctaatggagagctgttaaagatagggaatctctccgtcgaactaaaaatgagactgatgaagatggttggaccacactatcgacgctaagactcagggtagtggatttaaactggtgtctaaattggtttgatcacattcaggttgattatacttgtgctttaccaatcgtaattggattctttatgtaggtccaccataacacattatgcatgaccctgttttaatcctatgtaatcaattggtcatgcaccatatccacaggatgcttgaagatccatgcctttttgatgcactaaggaatgtggataccatatcaatcattacatgcgaaaatgcacttctgatacttgaatctgataagtgaacctacaggtatcgagggacactttatgttgagtagaactggactcttttctgaattgcatatcagaatatatttgtacggaggttggtttggtttggacgg

SEQ ID NO: 538572 - DNA, 276 bp, Homo sapiens
  misc_feature (134)..(134): n is a, c, g, or t
  misc_feature (227)..(227): n is a, c, g, or t
caaggtggttgtgggtagcgtgtacagagacagagaggcaggcccacgaggagaggaggctgcagatagtagggtagggtgctaggctactagggggccttggggccagctgagaattgggctctgctcctccnggtgatggtggacggcttgagggggtgggatatggctgggacaatggtccagaaagatctgacctgggtggctgggctggggggtgaagaccnttttttttttttgggaaaaaaaatttgtggcttcgtgttgcccagagtt

SEQ ID NO: 538573 - DNA, 605 bp, Homo sapiens
  misc_feature (11)..(11): n is a, c, g, or t
  misc_feature (20)..(20): n is a, c, g, or t
  misc_feature (36)..(36): n is a, c, g, or t
  misc_feature (46)..(46): n is a, c, g, or t
  misc_feature (51)..(51): n is a, c, g, or t
  misc_feature (62)..(62): n is a, c, g, or t
  misc_feature (84)..(84): n is a, c, g, or t
  misc_feature (89)..(89): n is a, c, g, or t
  misc_feature (119)..(119): n is a, c, g, or t
  misc_feature (131)..(131): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (169)..(169): n is a, c, g, or t
  misc_feature (177)..(177): n is a, c, g, or t
  misc_feature (182)..(183): n is a, c, g, or t
  misc_feature (189)..(189): n is a, c, g, or t
  misc_feature (195)..(195): n is a, c, g, or t
  misc_feature (198)..(198): n is a, c, g, or t
  misc_feature (211)..(211): n is a, c, g, or t
  misc_feature (256)..(256): n is a, c, g, or t
  misc_feature (283)..(283): n is a, c, g, or t
  misc_feature (298)..(298): n is a, c, g, or t
  misc_feature (312)..(312): n is a, c, g, or t
  misc_feature (330)..(330): n is a, c, g, or t
  misc_feature (340)..(340): n is a, c, g, or t
  misc_feature (348)..(348): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (380)..(380): n is a, c, g, or t
  misc_feature (385)..(385): n is a, c, g, or t
  misc_feature (390)..(390): n is a, c, g, or t
  misc_feature (392)..(392): n is a, c, g, or t
  misc_feature (405)..(405): n is a, c, g, or t
  misc_feature (423)..(423): n is a, c, g, or t
  misc_feature (435)..(435): n is a, c, g, or t
  misc_feature (445)..(445): n is a, c, g, or t
  misc_feature (455)..(455): n is a, c, g, or t
  misc_feature (473)..(473): n is a, c, g, or t
  misc_feature (479)..(479): n is a, c, g, or t
  misc_feature (508)..(508): n is a, c, g, or t
  misc_feature (520)..(520): n is a, c, g, or t
  misc_feature (543)..(543): n is a, c, g, or t
  misc_feature (573)..(573): n is a, c, g, or t
tggctgtttgnggatttaanggcagggcattgaggntgggaggggncccanccggcgcgtcngcttttcttaaagcaaaaaggntgccnacggggggcacgggggggccatggagtgcngagttggggggncaggggacacccngggggcncnanatnttgctggtganaaggaatntcaannggcacngaggcnggngggcaaggccccnggcaaattcccccccgtgggtgcccccccccttccccccccctgnccccccccccccccccggccccccccnggagtgaaacccagnggccaaaaagcccngggacaaacgaatgggcncccccccccntccttctnttgggctggagtgagtggnggnggngactcanccccngggcncnggcagggtctggnggggccaggatggtctcnagtgcttggcanccgaggaatntagccgggcncgggtagtagccgccgcnaggggngggccagggtggccaaagcccggggccangaatttgcagcngaggtcaatggtcccggagtccncccccctcggggtcgggcggcgggaaaganggtggccgtggcgggggtggaggtgggtgccc

SEQ ID NO: 538574 - DNA, 269 bp, Homo sapiens
agggcatcctgcagagaacaaaacaagatcctgaggtgaatgggttgagacagctcatatagaaaatgaacataactgtacataatctagtactgttgggaggtgataccatgaaaaagaaaagcagaataaggcagaatgggatgtggatggaggaggcgtagcagaatattacaaacacagttggacagggcaggctcatagaagtgatagaacaatgacttggaagtgctaactttgtgcacatgagaagaaaacacatgttacct

SEQ ID NO: 538575 - DNA, 375 bp, Homo sapiens
ctgggcaaggaggagcaggccagagccttttttggttcctttttttgcccaagccggttttaaaagccaggcacaggttgccaaaaggtgacccgaaacaggaggaaactcagtgacctttgcctttcccacattcctccccgcgggggaggacctccccgcttttaaaagccccgggcacatgtgggggcccaaacgtgggggttggtgtggacggggggcagatttccgtggatgaactgggtttggacttttaaattcataaaaaatttgagggtttgggagtcccaaaccctcccctttcctcagggcactttagcatttgcccggggttttccccgggcagcccagcaataaatggggggattgggggga

SEQ ID NO: 538576 - DNA, 936 bp, Homo sapiens
gtgctcataatgcgagctgtacttgatgtctgagacacacgcagtacagctctatctaacggttctcgaaggtccttcatagttgataagctacactgatactggtacaccttaaagattttgtggtagaggtctacgatatgaggagagattgtactttatgttgcatgtgagtaggtatctgaggagtctgtgtgtttagtagtgtgtacgtactgggtgatatgatgacatgatcgtagtattggatcaagaacaattccaggcagaatagaatggaaagatgtgcggggtatagatactgactgaaatagcttcctcatgcgtcatgtgcatcctccatgccggtgcacaatgttggttgtttcgcagggaaacctagtgacatgggctgaataaagatagagtgcttcaacgtgtgcatgtcagagactagccgatgggtaagacgccgtttccagtcattgtgcctgtggtaggggtttactaacaagaaacgctaaccaactcgagatatcggatacggaccgctgcgttatgcttccgcgacctaaacagggtccggccaaagtctcggaacgaagagtgatggacaagtctagtgacccccgaggaggttgcaggaccagaatgaactatgaatacgaacgatggctcaaactaaaggttggattgccaggagtcatgcagattggggaaaaagagagaatatgaagaagggtctttgtcccagattgcgtaagtttgagttacctacttcccaatggaatgttctgtcggattaggaaaataggttatagaaaatgtctcgaaatgaaggtccgccaaagggtgttgaacattgtgaggaaaaaggcttctcatggtggaggctttcaattggttggaaagggcaaggtaggttgctttggaaaggaaggccgcacttgggaggaa

SEQ ID NO: 538577 - DNA, 498 bp, Homo sapiens
  misc_feature (309)..(309): n is a, c, g, or t
cgtttgcggtggtggtgcctgtagtctcagctcccgagcagtgggactacaggcgcccaccaccatgcccggataatttggtattaagtagagatggggttccaccatgttgccaggatgtctcaatctcctgacctcgtgatctgtctcgatctcctgacctcatgatctggcctgcctttgacctcccaaaagtgctgggattcacaggctttgagccactgtgctcggccactttttataaatttttaaactgtacaatgtggtatttacctataggagtaacttacaatggtcatattacaagtnatttttgagtataattaaaattcatttctaaactattaatattttttccaaatggtaatatattttcttgtgaacatttgtggcctgtctgcctgcaaacttgcagacttttgtgattcacatagagtcaaatatgtcatagtctaaagacaaatttaaggtgtaagaccaattatgggataagtgtgt

SEQ ID NO: 538578 - DNA, 774 bp, Homo sapiens
gcgcgcgcctttttatttcgttttcaaagcgccttcgctgctgatactcactgggcccggctgccggcccccgttctgccctgcaagcataataaaatggctaatcatggtgaatggtaatgcggtacagttaaaagaagaggaatgaaccaattggatacttccatgttgtaactcacacagaacatctacaaggacactgatatgaggcatggcctcccatcagaaggtggcatgaaatgacttgattgaacttattttcagacatggataggtagcttatgtcgatcttgatgaaagatgcaatatgatgctctcagggaatttaatgaagaaggagctctgtctgtactacagcatgttcaaggaaagtgacttatcacatgttcatgaacaaaagtgcatttctatgtcggagttatgaatgacctacaggcagagagagaaactgggtgagcaaggtgcaatgagtccacaaagggacctagatgaagcgaagatcaaggcctgcttgagagaacggttatactcggatgtaaccacaggacagaggaagaataggggtcctaccaacagaacagagagaactcgggccggcaaacgggaaatggaacggacggaatagcagaggcaacaaacaagggatcaatgcacgaagacaatggggcccctatgaaaaagccgacccaaggggaaaccgcaagtagggaccaggccggacaaaagagagataaactcggaaagactcagaacgtatgtgaactaacccagaag

SEQ ID NO: 538579 - DNA, 322 bp, Homo sapiens
  misc_feature (316)..(316): n is a, c, g, or t
caggctacacttgctgcaggagaaaaaggggcttattcacacagcacagtttgaaatcttacttgacacactctttgtctaatggagaaactgaaaatgtgtcatacagtcttcatacagcatatcccactggtttcatatttgtctcaatagtattaaaacatgtgggcaataattttatctagttaggatattcattgcgagtgtttataaaatgtggaaacatggtaaccagtctcgatttccaatgcacagggtaattagttgatatcaattatgcgtatatatcacgtagatgtgaggtaaacattcattnttaaaa

SEQ ID NO: 538580 - DNA, 407 bp, Homo sapiens
cagaatggatttgattgatttatttattaattagacagtgtcttgaaaaaaaaaaaaaaaaaaaatgacccacaaagaaggcagaaataaaggggattatggacccaaaaaagttatacaatatacaaaaaccaaatatgcaatagggcaaaattgttccctggtagggtaatcccttaaattgctattggctgaacctcccccaatcagacgccagaggctggcagaatgggtttggatggactttttttttttttaaggccagggtctggctctgtcccccaggtctggattgcagtgccacaaccaggcttcatggcccccttgacttccctggggctcaagggctccctccctgctctctatgtcagtttccgggtcccgagctcgatccgtacccatggcct

SEQ ID NO: 538581 - DNA, 992 bp, Homo sapiens
  misc_feature (188)..(188): n is a, c, g, or t
ggcagatgtctgcgagaagcctctatgtcgctgatggtgttctccactgctgaacttgttgactatgacagtatctaggcgcgagagttaagcgatgagttgtattaatggtggctgctggcaacaagcccgtgttcatccgcctgagcttgtggatcactggatcaatcgggaatgtagcgcaggcntgatcaagtaacgcatgtgacgacagctgtgcaacgatgctgtacctagttgagagcccagtcatgtaagcagcgcctgtacctgcttgattcttatcgctcgatgagtgagccagtctcagaacgaatcgtatgccacggtggtgcatacgtattactgcaggactcctgtggcccagaaatattgattctatgaaacgatgcagcacgaaaaatctttacctaagtggagtgattcttaacaaccaagtaaggccttcatgatgcgatcacgggattcaccgcgtcttctgtacctgtggaactgccatgttgcatggaactcccattgacggtgccagggtctgtgagaccatcgcactcgggtgaggcatctgaatagtatttaggtccggacgcgaagctctggaaagaactaaggactgggacaggtgcagtacagtgccgccgccacccggtcagttttgtgaaaccacgcattgggaggatgagccgcaggtacgcgcctagcgccctttccctttgatggctaagccccttttttaagcgccgtagatgatctgggcacagtggcacaatactaggttagcagacgcccagagcgatcgtaggatcgtgcgctctctgggcaattggtgctcaagacgttgggttacagtaggtgccgcgtttttctgagaggccaagtacagataatagaggacaccgcgtgaatggcatggccgggtgcccgttgagatactgcaatatgtcgccttcggcgacttgagtcgactaaaataggtatgccggcgttgaggaata

SEQ ID NO: 538582 - DNA, 397 bp, Homo sapiens
  misc_feature (1)..(1): n is a, c, g, or t
nggcctatgctctctgctcacacttgggcttgaataccacagagaaagaagcacagaggtcaatagtacaaggctgctctaggggacacctgtgagtgagccccacaattggagggagtcttccccaccccatggtcttcatgatgcttgtaatcacgtagcatgttatgttcagtgctgagtcagatgtcgggcattagctctgtggtcttccctgctgacaggattaatggattctcagaggtgatttgaagactcaacaactggaggacaaaacccaatttgaggtcagactgcagcgaagtttcctgcctgctgcagtggaagacgggcgtggcaatgccaagcgctacacagctatgggcacttggtgatctatgtgagcagtttaaacaca

SEQ ID NO: 538583 - DNA, 257 bp, Homo sapiens
cctgacgagcctagtggaggactcttttcctcttatgtgaagaaacataaacaatatttgggccgggttgggttggtttgcttggtttttcagacaggatttctgtctcccaggctggaatatagtggtaccatcaccgctcacggcaacctcaacctctgggactgaagcagatcctcccaccctagcctcctaagtagctgggatcacaggcacatgccaccatgtctgactcaatttaaaaaatgttgggcaga

SEQ ID NO: 538584 - DNA, 360 bp, Homo sapiens
cgtctgagcaagctgggacgggctttgtgaatggcacctctgcggaagtggtccgcagcgcatcgtagacctggccaccaggtgtacggccctggacatctctcgcgagctccgctgtcagtcatggctgcgtcagaaagatccttggcagtagttactacgagactggcagcatccggcctgtagtgatagggggctcaagcccatggtgacacccccaatgtggtggagaagattggggactacaaacgccagaaccctaccatgtttgccgtggaagctccggagagcgtctcctgactgcggggcgtctgtgaccatgacacgtgtgccccagtgtcagctccatttaaatagact

SEQ ID NO: 538585 - DNA, 105 bp, Homo sapiens
acaagctttgcgtgcacgagattgaagagttcaaatctgaccaagatgttgatgttggctaagagaattctctgctccccacctctaagttgcccgccactcgaa

SEQ ID NO: 538586 - DNA, 214 bp, Homo sapiens
ggcaccttgtggcgtgtcctggtgcccgcacggcgcggggctgccccccctgacctgccctgtcctcccggcgacgtgacaccgcggccgcagaccgacgacctcccgttggtcttgctgtgctggactgccgccccggccggggtggtcggcgccgacagcgggggccgcctctggccacccgcctcatcatgctggcagctgtggcggctgc

SEQ ID NO: 538587 - DNA, 90 bp, Homo sapiens
ctcggtcctctactcccgacacaaaatcattcaagaagaaatagataccagcctgagcaacatggcaaaatcccatctctacaaaacatc

SEQ ID NO: 538588 - DNA, 658 bp, Homo sapiens
gcacttcgccctccagctgctgcagctgcagcccgaccgcgagcgtgccaagcgtgttcagcagctagcggagcgggtggcggggcccccctcaggacaccacacagattcccctcttccggcggcctcgccctagtgggcggaccccaaggggaacaagactttgggcgcggccgtccaaattgtgtaattccctcccaatcatatgcttgaacccttgtgggcaaaaaggtttggccaagcaggatttactttttttccacaccaacaaccaggggaactttgggggagttacgggggggtttcggggtgggaaaaactgttggggcacgcggttggaacaacaccaaagagttcctgtgcaggtgggcggttgcgaatctttcaaacgtcgcgggttacatctaaatacagaacagtgttaaacgttagtgggggacctgtggagaaccaaatatacaaaggtggctgtgcagtatggtctgactttcacgagaaacagtggggcaacacgtggataacactctgggaaccagaaactcgcaattggaagaccaagattgtgtccaggtttgcgaaacgtgacatttgatactacctttctcaccaaaccacaggacagaaacggggtaaaactcaagtcttctaacaagaggga

SEQ ID NO: 538589 - DNA, 100 bp, Homo sapiens
ctctgacaggacagttttagcttcgggctttcagtattctgttatttgtctagttcttggtcagtgaaagaagtaaaatctgtatatatgtaactccaga

SEQ ID NO: 538590 - DNA, 1032 bp, Homo sapiens
gactaccctctcatcccagatggtaaactggtcttaaaccggaatccagtatacttacttagctgaggttgaacagatagcctatcgacccaagcaacgatgccacctggtcattgaggccagtccgtgacaaaatgctctcagggccgcctgtttatgcctatcctgacactcaccgccagtcgccgtgggacccaaattatcttcatatacctgtgaactgtcccataccgtgctcgagtggaccaacataccagcgtgacggcaccgatgtgcatgcaggacaactcagggctggtgctccaaattactaccccaacagcttatggtgctccggaacaacagcgcttctgaccctggagacacagcatccaactagttctggagaagtgcggagattcaacactgccaatgatgactaacgtctactcaggtgcgggccatctactgcgcacgtgctgaatgagcgacacagaggcaccacgtcagcagctgagaacactcgccgggcaacacatgacacgcatgcacaaactatcatccagcaagcacaagcggtcacgaactcactgaggtccaccctgactacgggagccaccatccaggctctactggaccagtacatgctcgcaaacctaagactgcgactcacaccgacgggccgaccggatccactcggcgccaaggggcaacaggcaaacactgtgaaggccagcgccccctgccctgcgccacgcacgcacaaccgtcacccgagatccccgcccatacggactcaccacccgccgcccaacacgatcaacgcaagcaaactgccccaaaacaaaagcacgcgcacaacccaccgcgtacaccaacagcaatcgccagggcaacagacgacacgacaagcgcaccgaaaaaaccagacagacccaacacaacacaccgcccaagataacacgcaaccaacgccaaaacccatgcgcaaaaggaaccacgccaacccagcgcaacccacacccccaacccgccacaaaacgaaagacgaac

SEQ ID NO: 538591 - DNA, 238 bp, Homo sapiens
aggtgatccacccacctcatcctcccaaagtgcgggattacaggcatgagctaccgcacctgccgagatgccggcattttaatttacagtcgttcttcactttggaaagcaactcccaagtggctcagcattcagtattgttcctaaaatgctcgctactcctgatcttcagctttaaaattactaagcagcattcccacaaaggcacatgacatttttattatatgccagcatgtgg

SEQ ID NO: 538592 - DNA, 966 bp, Homo sapiens
ggaagtcctgcgagcgacgcgcgggggcgggcgagaggaaacgcggcgccgggccgggccctggagatgggtccccggcgccggggcctgtgtgtgtcctcgtgctccttggtccccgcgtgctgtcggcgcccagggtttccgtatccaatgattatttgtacttccaagtgctgaggtcctggggacattccgatacatcttcaaagccaaaacttgccaagggaacttgggcgtgggtatcttccacaccaagggtatgacgcaaggattccacctttgttcccccccgtttgaaaccttcacaagaggccttgcgggggaaacctccagaccaagcgggttctcttcacatccaagggaccaaagattgggctctggctgcaagcacggggggggggcttggcatccctttcctctccaaagaactccggcgtgtgcccccagggaagccacggcgggcgggcggcggggtggatccaattcttcgttgacaaaccgcaaggtttggaccacttggaccaggcttccctcaccggtggaggattgatccagggacaggtaaccccaaggcgccacgagtgaaaatttccccaggcccttctttccgttgtctccgcgccggagaaggggttaacattgaatcgcgacagctcctcgtggaaccaggctatggcgctgtggcagtggggcccatcatttcacatcccaagtcaatgtcaaccaaggtatcgccaacttttggaggttggtggcaagcgcgctggaccttcttgttgaaaagcaagtttgcccaaattccaggacaataaaatggattcttgaagcgtggggaaggggaccccaggaattgggtcttggcatttgggagcagccgttggggccactgggccgcgttacgcaacaggttggcgttgctcgctgaaggagcacccatggtccctcccaggccaagggtgctcgtaa

SEQ ID NO: 538593 - DNA, 344 bp, Homo sapiens
  misc_feature (64)..(64): n is a, c, g, or t
  misc_feature (146)..(146): n is a, c, g, or t
  misc_feature (268)..(268): n is a, c, g, or t
agcgagctccgaccccgctgagcaatacctttatgtggctgacctgtcttggaaggacaagcgngttctgcgggaaatgtaccagatctacttctggaacattgcaccattgctgtcttctatgcccttcctgtggtgcagctggngatcacctaccagacggtggtgaatgtcacagggaatcaggacatctgctactacaacttcctctgcgcccacccactgggcaatctcagcgccttcaacaacatcctcagcaacctggggnacatcctgctggggctgcttttcctgctcatcatcctgcaacgggagatcaaccacaaccgggccctgctgcgcaa

SEQ ID NO: 538594 - DNA, 153 bp, Homo sapiens
  misc_feature (83)..(83): n is a, c, g, or t
  misc_feature (93)..(93): n is a, c, g, or t
ggagaggaggagtgagggggacccgcaccttttcggcaggaaatgtgcccagcagctctgggtcaaagcacggttgctataangctatctctngggatgcctctaggcccccgttccctcgtacacaccgtctgcggaaacagattacactgt

SEQ ID NO: 538595 - DNA, 400 bp, Homo sapiens
  misc_feature (16)..(16): n is a, c, g, or t
  misc_feature (60)..(60): n is a, c, g, or t
  misc_feature (73)..(73): n is a, c, g, or t
  misc_feature (151)..(151): n is a, c, g, or t
  misc_feature (172)..(172): n is a, c, g, or t
  misc_feature (189)..(189): n is a, c, g, or t
  misc_feature (271)..(271): n is a, c, g, or t
  misc_feature (348)..(348): n is a, c, g, or t
  misc_feature (376)..(376): n is a, c, g, or t
  misc_feature (393)..(393): n is a, c, g, or t
catgcccaggcacagncctagccactgtggcttcaagaagtacccctggaaacagttgcnccccttaagaagntccatagcctagttacaaaatacccattatgacagggcacagttgctcatgcctgtaatcccggcgctttgggaggcnaaggcgggtggtttgcttggncccgggagtttgagacnagcctgggcaacgtggtgaaatgccatctctactaaagacaaaaaaattggccggttatggtggtgcgtgcttataatcccngctatgcgggaggctggggcaggagaatcgcttgagcccaggagacagaggttgcagtgagccgagatgacaccacngcattccaggtctgggcgacacatgtgnggttctgtcccaaacantaaaaca

SEQ ID NO: 538596 - DNA, 205 bp, Homo sapiens
caccgtgggaactgtataacgtttcaaagccagtgctcagcttctctgctccgtactagcgtgcacaggtcttaactcagccgagatgcctgtactagtttttcgaccccagggtcaacctttctgagccacagcttcccgctgggaataatgatgcctgccctatctacctcacagacttgttatgaggatcaagtgagattaa

SEQ ID NO: 538597 - DNA, 150 bp, Homo sapiens
cgcgaaaacctaatccagcaggtttctgctctgacattctcttgtctgctattcccagagagaagtctcagaggggaggggagagcctgcatctgggtggccaacgggctgattacgggaatctgtgtccatatccacactgggcatgtt

SEQ ID NO: 538598 - DNA, 283 bp, Homo sapiens
gacatgatacaacttgagctcagtaccgtgacgggtcaagctcctgatcgggtctgctgagagctgccagctatcctgtgtgaaatttgcttgttcgcaaagctactagattgttcgattagtctttcgcccctatacccaggtcggacgaccgatttgcacgtcaggaccgctacggacctccaccagagtttcctctggcttcgccctgcccaggcatagttcaccatctttcgggtcctaacactgtgcgctcgtgctccacctccccgtcacgacttga

SEQ ID NO: 538599 - DNA, 913 bp, Homo sapiens
  misc_feature (267)..(267): n is a, c, g, or t
aggagaggaggagatgaaaaaaaaacaagagaaagaaagaaacgaacagcagcgaggatggtgcgagggctaaccggtgctccccggcgaggtgtccaccacgggcttcgggaggggatcacacaggtgcagagtcggggacccgtgcgccaagcccgaggaggcccggtccgccgtagggttcgcgcctccgcccactgcccgcggcccccgtggggccccacggtcaatggaacaggtcgcgtcgcgagaaaagtttgcgccctntttgtctgcaagctgccaggcgcccttcattctttacttctgctgcgccccctgcttgcaatggtcccccggccgcccccccttgtcggggctttctcgcgcttcccccggcctgggacgcttcccgttgttcgacattgaaggccccgccgcgcagcggcggggcttttgcctcagacccacggggcaccgaacagccttgctggccggttggtgccaccagagcgtaacccacggtttgccccacgacaggtctcggacggggcaacctcatctcttttccccccttggtccgcgccccccccccttggtaaccctcgtcgtgtcggaaacaacccgtctttcccacaatccttgttttacaaatgggcccattcaaatggtagatcgcatctcaataacacgcggtttgaagtaacacccccactgctcccttcgaccctcccgcaaacagtaagcaaataattcttctagtggcccaccacatcgtttataatttcagcgcgtcagccgccttttacagttataacgtatttgataaactaaacgccatccctttttcaagaagcaccaactcggcccccaaaacaatcttgccccaaacatcgggaccccctattaaacatttaaagcggcccacataaca

SEQ ID NO: 538600 - DNA, 412 bp, Homo sapiens
gaacgatatgcagaaaaatagtatcatatcattctactctttaatattcattcacctatttttgcttcacaacctacattatattactttctggttctagattacttttataaatattatacacgctatagcaatgttatgacctaactttttcacagccactatttagtgtaaagaaattattcatatcatcttattcattgtgattattattaccactatctgcactggtgctgtgggaatggaagtgaataagagctaccgtaaggctgtcatcttcttcctggctcaggcagcggaaagaagaaactctctgagataatgaatacgaatagaatggggttctaacaggtgttctaacagtgaaggagttcagaagagtgacgctgagtaggagtgatcaggaaagact

SEQ ID NO: 538601 - DNA, 917 bp, Homo sapiens
tatcccttacagtcctccatcttcaaggaagaagtagaacggcactagaaggtcttttaacacagcacgcctcatcaagctcaaccaccaacttaagaaaggactggaaatgcttgtaatcacttgtgcgcttctcagaattcaggcctgtcctcagaatgttacacagggtacagtccaatctgaagctcctgtatagacgctccgtttattattagggccccagtgtctcattcgagcatccagtaaccgaagctgtgagaaacgttgtgaccgcgcccaagagatgcttgtgcgatcgcctacgtatcttttggttgcatagtcataggtcactgatttcaaccgattcgtcaaactactcatacgacaccctgctcttgttgacactgccggtttacactgtggctccaagcgcatcacagcgtgatgtctcttggttggctgagtcctccgaagagctgtcacagctgctgaagtctctgtaacagtagaataaatagatgcgtttgctggcaggactatgctgaagtctccttaggcactctcataatcagatgtcctaaggtcctcccaattgctagagacctttgatacctgttgttgctccctgtctgttgattaccatttgagtctctcttaggttcatccaaaagcggtatccaggccatcagccaatcattctatacgacaaaggttactactaaaaaagacccgacaatatcaccccttaccacaagaactcccttcagcttaatctctcccaatctaggtgtcccaacggccgcccctaattcccggtttgaagcagccctgagaaaggatcgccattactctctacatacaacccccaaaattttcggcgccccaagcatttcaacactaatttgtgttcaattattcgtatgaatatagaa

SEQ ID NO: 538602 - DNA, 514 bp, Homo sapiens
  misc_feature (7)..(7): n is a, c, g, or t
  misc_feature (84)..(84): n is a, c, g, or t
  misc_feature (109)..(110): n is a, c, g, or t
  misc_feature (133)..(133): n is a, c, g, or t
  misc_feature (175)..(175): n is a, c, g, or t
  misc_feature (205)..(205): n is a, c, g, or t
  misc_feature (218)..(218): n is a, c, g, or t
  misc_feature (222)..(222): n is a, c, g, or t
  misc_feature (351)..(351): n is a, c, g, or t
  misc_feature (371)..(371): n is a, c, g, or t
  misc_feature (440)..(440): n is a, c, g, or t
  misc_feature (506)..(506): n is a, c, g, or t
ttaaggnagccctaaaatgtggactgggtttcctgttttagcactgccctgctagctcttcctgaaaaggcctataaataaacngggctggctgtccgctcgtcccacnnggagtccctgacgggcacacccnggagtcgctggggcgtacctcggtgggtgcacacatgtggcnggacaggaagaagccgtggcaggccctggnggaggctcttganattngggggctttgctgcttgacaaaggcgccccctaccatggcacccagagtccccctgccctaaagggatgttgaggatggggtagcagcccagtccgcccctaccccaggcccctcgatgccagttttancccggccacccaggagaacncaggggctccaggctgggattttctttcttcccgtaaattaccacaaagttaaggtcaggacttcagancccacagtttcaccctggcttacaggtggggaaaccgaggccctgaaaaaggatggaacagacgtngccactcc

SEQ ID NO: 538603 - DNA, 1013 bp, Homo sapiens
  misc_feature (175)..(175): n is a, c, g, or t
  misc_feature (267)..(267): n is a, c, g, or t
  misc_feature (297)..(297): n is a, c, g, or t
  misc_feature (582)..(582): n is a, c, g, or t
  misc_feature (1002)..(1002): n is a, c, g, or t
gagagagcgaggcgcgcggggcccacagcgccacccccgcccccgcccctaccgagcaaacatatggcacccaccgcagcccagcgcgcgtacgagccccgcagggcgcgccccccaccgccaaagccaggcgcgcgggggagccaaaaggaggcgaggagagaggagggcgcangcccgcccagcccagccctgcccagcccggcccggaggcagacgcgccggaaccgggacgcgaaaaaaaagcagagcggaggcatcgcgcanagagcccgcgcgccgcccgcaccgggggcngaaaccaggcggggggacacgagccaggcgccgccgccggagccagcggagccggggccagagccggagcgcgtccgcgaccacgcagccgccggccggccagcacccagggccctgcaagccaggacgggggagggggcagcgagacaagcacccggcccggaagcaccccagccgccgcggccccaaccggaggggcaccgaacacacccaagagcggcccaccaacccggaggagagcaggcaggaggacagcacggcccaggacagcgagggcaggagaancagcacaggggacgccccacagcagaccatgtgttcacgggatgcccgcacaaaacagctgaggcagctactggagaaggtgcagaacatgtctcaatccatagaggtcttggacaggcggacccagagagacttgcagtacgtggagaagatggagaaccaaatgaaaggactggagtccaagttcaaacaggtggaggagagtcataagcaacacctggccaggcagtttaaggcgataaaagcgaaaatggatgaacttaggcctttgatacctgtgttggaagagtacaaggccgatgccaaattggtattgcagtttaaagaggaggtccagaatctgacgtcagtgcttaacgagctgcaagaggaaattggcgcctatgactacgatgaacttcagagcagagtgtccaatcntgaagaaaggc

SEQ ID NO: 538604 - DNA, 217 bp, Homo sapiens
gtaaagactctgcagaataacattgagtttagtttggaatcacagcaaggactacacagggttggactatttcaccatcatactgaggagatactttcacaaccaaacacgtgaagattacgagtcggacattgactatcggccacaattctttgatgtttgaggtgtaggggcactagttttcatttatcctgaggcctaggactcaaaaatgtaa

SEQ ID NO: 538605 - DNA, 98 bp, Homo sapiens
ttttccatattgagaagactgtgccatattttttgaacttattttatttgttcccatgcccaggctttggtcattggtcatactgtatgttgtattta

SEQ ID NO: 538606 - DNA, 170 bp, Homo sapiens
cgggttcttactggtgatcacaacgggaactctgacaaagctgtgtttttgactagctattcctctctgggtcctgaacacaaacctttgatctgcagaggacattcttctggcggtgggggtcgggtctatctgtctcagaaaatcaaactacagaccatgcaaacttg

SEQ ID NO: 538607 - DNA, 758 bp, Homo sapiens
taaaaaggtgtgtgggccccccaattttaacccccgggccccccgcgggacacccggggtgggccctctgggggggcctctctctctctgtgtgtttttttttctctctttagaggagcccggtggtgtgggtggtcgcgccccccccctctcttataaaaagtgtggtagaaaccgtcccctccccccccctcttgtgtgtggtggacacacacacggcggtggcgccgtgtgtcgcccctctctctctctctcccactactcttctttgtgtgtgtgtgtaacacctcacacacactctctctctgtgtgggggtgctctttatcttctctcgcggccctctctcgcgacgaatctctccacaattatatatctctctcgtagtgggctctctcacacaaaacaaaaaacaaaaaaacctctcgtggtgtgcttctttatcggcgcgggggtgcgagagaaaaagattgtggtaaagagagagtggtggcccgcgtggcgccctctcgtgtgtgttctcccgcgcgcccccccttttctttgtggcacaaggtggtggagacacactcgcgcgccggggctcctccctaatagggagggcgccttgtatatattatatctcacacagaaacgcccgcgtgatgtacacccccccgtgtcttattaggcccctcttccttacaaaaaaaaccccttccaccacctccacccccctcccaacacaaccaccatacttacccatcctccctacctccca

SEQ ID NO: 538608 - DNA, 202 bp, Homo sapiens
tgatctagaggatcccatctacactagtagggtggcgggtgaacaccatgtagttgaagttgcctttcttatacaagtgggtgcctcccggtacatctcgtaccactatcctacacctagtgaaggcggctcacccaatggtgagtgagcagctccctggatggtgttcctacatggatagaaaccgtgaggcttcctctgt

SEQ ID NO: 538609 - DNA, 508 bp, Homo sapiens
agagataaaaaacaacaaccaaaagaggcgggggttggggctgggtacggggggggagctaggtactagggacaaggcaggggacagggtccaagaagcataggatgcttggcttacccttaaagagatgagacataagccacatggcttcctgtcccaatctgtccttccccaccaccacccacaacttacgtagggtgttttataataaataaccatagtgcggggagtgggaaaagttcggatctagaaacagcagaattcggagtgggcactaaatatatcccatatgatggtcgtggttcaggtcgtgtcaaagctacttacagagtgtggacgggtccaattccttctccacggagtctgcattcctcgccctccagcagctggcggtaaggggcgatctccaggtccagggccagttggtgtgtcatgagctctgggtactcacgcagcagccgggccatgtccggctgggccttctggagggcctcctccagctcggcca

SEQ ID NO: 538610 - DNA, 468 bp, Homo sapiens
aagaattgaagctcagacaaaatttttattgtgattttaacaaacctcgggtcctcccgcgggcctctgggataattttaagccaggtaacgacctgggcagggcagggaggcggaaaaaacctctgttattcacaagatgcgctgggatgggcctccaggaaagcttataaggaaaaccaatgggcccaacccccaccgggtgggaactgcatctacacctaacacgaaggaccagcatcagagttgcacaacattccaacaaaggctgaaatccagtagaaagaaagggcaatctccccaggacaggacccggaggtcaggtcaccgacactctaagggggcaggcttatcctgatgacaagagccatggacctaaccaggcgtatgaaaaccggaatggtgaacttaaatgctaaaccttaatggtgcagtaacagatggctacagcgcaaattaggaggccaaa

SEQ ID NO: 538611 - DNA, 444 bp, Homo sapiens
gtcacatactcgtcctgagccggcttcagctgtccgcgcataagtctcccggagccatggcctagtactcttatgtgaagtctagcaagctcgtgctcaagggaaccgagtaagaagaaaaagagcaaagataagaggagaaaaagagaagatgaagaaacccagcttgatacgttggatctggtgaacagtaacaaactttggtgaaatttcaggaccatagccattaaaatggatgagggacctatatacatgcactcgacaatggtctttttacctggggagctcacacaaagaagaatcgcctcaatctggctatggaaatatcttggtataattcagatgaactttttgggcattcagatgcatttggcccagacacatggcaccagtttttcaaagggaaaggctttttggctaaatagctctttttagatcaatagg

SEQ ID NO: 538612 - DNA, 243 bp, Homo sapiens
tggggggggggggttgggttgggcccccccgggcccccccccccccggggcccccaaaatggggggtttccctttttgggaagaaatttcccttccgccccctttcccaagggggggggggggtttggggcgggacccttgggggcggcccccccccggggcccccccccggggggaaaaaccccccccccccttccctttaaaatgggggggttttttaaaaaagttttacctcccggggga

SEQ ID NO: 538613 - DNA, 312 bp, Homo sapiens
  misc_feature (307)..(307): n is a, c, g, or t
tccaagggtgcacctgatttccatattggtccaaacacatgttttacaatttgtacagttaacacaattatcacagtggtcctgaggtgacgtatatccctcagcttacgaagataacaggattaagagattaaagtaaagacaggcataagaaattataaaagtattatttgggaactgataaatgtccatgaaatcttcacaatttatgttcctctgctgtgctccagccagtcccttcattcagggtccctgacttcccgcaatggatatgtctttgcctctaaaattttagtaaaggtttctnctgaa

SEQ ID NO: 538614 - DNA, 909 bp, Homo sapiens
  misc_feature (88)..(88): n is a, c, g, or t
  misc_feature (92)..(94): n is a, c, g, or t
  misc_feature (97)..(97): n is a, c, g, or t
  misc_feature (178)..(178): n is a, c, g, or t
ccagggagcaacatgagcaaaaataggagtgtgtcagagtttggtgtattagaggaactgccagttgttcatactggctaggcagggntcannnganggagaagggtgagagattgagctgggtggaggaggacatgaaggcctttgggtgccatgatgggaggtggtggaaggtttngacctgtccaccttcctgtttcctccttgaagctgaggcatacgtcagtgggatgctcttttgcctgggtatatttctctccttttacctgctgaccgtcctcctggcctgctgggagaactggaggcagaagaagaagacactgacatggtggacattgagcgagcctgcccagaaagcggtcaccctcgagtccatggctgattcttttcctggcagttccccttatgagggttacaacatatggctcctgtgagaatgtcactggatcgtagcgatggatctggatgacagcgctggacactggggaccatcatcgtatacggtagccagggaccgcgtccagttgaaccgtgtagggtactcggacaccagaactggaagtccagtgagactctgatgggaggaggatgactacgagcacaaggacgcgagactcgagataccgacaagcacagtcgaaccgacaaccagacaaagaacgactaaatgtggccagacacctggccacggaagggaccaagacggtgatacgatgcgcggaaacgaagcaggacaccaacaatcgtaggagcgcagggacacagaatgggcacaacgcaatacgagaagacagcaaaaaaagggaacgatacatgcgggcgacgcagacggaaaaggagcaacccagacccagaacaggcgggcagacgagggaagcgagggcaggccaggaagaatccggacgaaca

SEQ ID NO: 538615 - DNA, 142 bp, Homo sapiens
aggcaagcataaggaaagttacatcatcttggtcatcagttcaggtatatgtgaaaacgcacctgtaggcagagcctacacaagagttacatcacctagttgattactgcagagatatttcacaataccctgaactgaaatg

SEQ ID NO: 538616 - DNA, 823 bp, Homo sapiens
  misc_feature (88)..(88): n is a, c, g, or t
  misc_feature (92)..(94): n is a, c, g, or t
  misc_feature (97)..(97): n is a, c, g, or t
  misc_feature (178)..(178): n is a, c, g, or t
ccagggagcaacatgagcaaaaataggagtgtgtcagagtttggtgtattagaggaactgccagttgttcatactggctaggcagggntcannnganggagaagggtgagagattgagctgggtggaggaggacatgaaggcctttgggtgccatgatgggaggtggtggaaggtttngacctgtccaccttcctgtttcctccttgaagctgaggcatacgtcagtgggatgctcttttgcctgggtatatttctctccttttacctgctgaccgtcctcctggcctgctgggagaactggaggtaaagtggaactgctgggcctcccctggtctgggtggtttgggcaggtgtgtggggcagatcacctggcaggatctgagccagcctagggtaatctacaccatccatagcagatgatggtggggctgttagagtctgtggcccatgagcctctctagaaaccatcccctcccctcaaccttcttcccaagcagggagatcccatgttgctccccagcctgtgaggaaccctgggacaaagggtggaggacagggtcatagcgatgagagttgagcagagaggtagaaggaaagtcagccccatacagagtgatccttgtcctgtcccatctgggtggcctgtgggttctgtccatgcaggcagaagaagaagaccctgctggtggccattgaccgagcctgcccagaaagcggtacctccagggggcctgggtggggcgggcacagtgtgctttgtgttttggggggtggtggtggatggttccctagggggttggaggagaagggctgggggttctg

SEQ ID NO: 538617 - DNA, 256 bp, Homo sapiens
ctgtggaggcgcagtgcaagctgtcagtagatctaccattctggggtctgaaggatggtggcccatattctcacagtgtccatgaggcagtgccccagatagggactctgtagtgtgggctccaactccacatttctttaactgcactgcccatagcgagaggttctcacatgagagcccctacccctgctagcaaactgtctgcctgtaatatcgcaggcgttttcatacatcctcgtgaaatattgacttcttg

SEQ ID NO: 538618 - DNA, 408 bp, Homo sapiens
acagacctgttatcgacaagaccttgaatgaggctgactgtgccaccgtacctcctgctatccgctcctactgatgaaacctgacagctacaggaccagcttatgtgattatatagcatagcttacctgcgtttcccctcatacttgtcttggtaaaattctgctctcatgaacaaggagtcacttcatagattgtgatcaacagcttggtagtacttgctgtaagggattgagttgcgccagactttgtctctttattcttgtgcagtgataaaactggcataattcttaagtgaagtacaaatgagcaatcttttatttccaaataaaaccatgtagtagtgggattttagttctatctattgggtctgaaacagcaaatataatttttcttccgctgtctagctg

SEQ ID NO: 538619 - DNA, 279 bp, Homo sapiens
ggcggaagatggcggcgtccaagggaggttgagggctctgaggaggcgttgagaggtttccgtacagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctgga

SEQ ID NO: 538620 - DNA, 1348 bp, Homo sapiens
  misc_feature (79)..(79): n is a, c, g, or t
  misc_feature (103)..(103): n is a, c, g, or t
  misc_feature (1106)..(1106): n is a, c, g, or t
gcccctggcctattgcacgtggctactgacagtgggattcccacgccaggatacccatcaagtactacgaccatgcacnctgaccacagttgtgcaacacatncattggacaaccccaccccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaaatgtgctgagccctgttttcacgtatgcctctgcacttctccattcttcctgttttgtctaggttccagagggttaaacagcttatctcccatggcgtgtttggatatctgctgcctgtggtcaggaaccttgcactggggaaacaatcatgtaatccacagacaactctatttgtgttcttcagccntcacctgaaggcttttttttggctggcttttaatcaaacaatcttttgaaacaattgtggtctaagctggttgtttctatttgttcctactgttctaaaacaaatgatttactctagaaagtagaaaatagaagttgtttctgggctaaaagcctggacaggcttgacaaggtcacctgatgtgcatgtttccgctcatctcccacccaggagtcctaagggtcctccagacaagaaccaca

SEQ ID NO: 538621 - DNA, 900 bp, Homo sapiens
ctgcacagaactagatactgcgagttgaattgtgctccttgccagtcgtcctcatcgcggggtccgtcttctctcctgctgctgtctgggaccttctgcgggcgatgagaagacagaaggggcccagagtcgaccgtcaaggtgtattgggacctacgaattggagatgaaggatgtaaggccgggtgatctgttggtctctctcgtgaacagactgtaccaaaaacagtggataaattttgtggccttagctacaggagataaaggatttggctacaaaaacagcaaattccgatctgtgtaatcaaatgacttcatgatccagggcggagacttcaccagggcagatggcacaggaccgcacagagcatctacggtgagctgcttcccctgatgagaacttcaaacgtgaagcactacgggcctggctgggtgagcatggccaacgcaggcaaagacaccaactggtcccagttcttcatcacgacagtcaagacagcctggctagatggcaacgcatgtggtgtatggcaaagttctagagggcatggacggtggtgcggaacggtggcagagcacccaaggacaaaacagccgagaataaacccctgaacacgcactgtgatcattcgcagaacctgcggcaagactccgagtgcacgcaaagccctttgccatcgcagaggagtatggcaaagggacatcatatctatagaggtgaccgactgtgcacggaccttgtaaatcccgcacacgggctctgagctgcaaatggccccaggtgctaggattctggtggagctggacccattacactcacattcacaggcccatagaactcactattagtaacaaatcctacaagcactgaccaataaacacactgtagactaacatatt

SEQ ID NO: 538622 - DNA, 643 bp, Homo sapiens
aggcagtcgcttcaagacttgtagagaacatgatcccaacgataagggttcaaactcccctccagggaatactccttctgaagtgactgcccatgaaaccagccctcatgctagctcatgtgcagagtgagccccccatcaggagtccactaccccgtaggccacacagcctgggcttccagctcacacctcgtcctcagccctctgcaggccaggtccctctcactcagcaccctcctccctccagccctcccagggacagaggagagacagcagagcttctcagtggtggcagcgtccccaggccacactctaagaaacggcctgtggccagcccgccgggtgttggaggagcactccacactcttcatggctaccatgtgcatggcccatgtggacctcctgagaactaggcgacatagagatgaggcagttttcccaggtttacagacaggataacagtcctacagagattaaatgcagttcagctgtgaagtgggaactggaatctaggagggctgtctgctagagaatttatagggctgtcgtgtacagcttcacaggttgcgtacggcacaactccaggagacacaattcattatagtctgggataggagtagagtcccttgaggctataatacag

SEQ ID NO: 538623 - DNA, 697 bp, Homo sapiens
gcacagcatagcaagactgcatctcgtacagagagtaaaaaaaattacccgagtgtggtgatgtgcatctgtgatctcagctacttgggaggctgaggtgagaggatcgctggagcttgggtgaggtgaggctgcagtgagtcctgatcatgctgctgcactcaatcttggacaacagagcagagacccgggtctcaaaaaaaaaaacaagatatatatagtagtatatatgtacattctaattgaggctgaaggtgcatcaaactgtggggtaaagatcagcgacgcgcaggctggggaaccttcacgggggacacaaccaaatcctgtggcacagagaagataagggagaagaccattgcaggacagtgggatacccaggcagtcgcaaacaagggaggggtgagaatacacacaagtcaccgttcaaaccaaagatgccccatctcccacgcggccagagggggatccaaatagggtctccaacgggacgtaagagtacgccacaatagattgggacactggagggaatccgatggggcacaagtgggcaccactggcgtgacggcacagggggaacagcacgcagcgccgcgaaaagcaactggggaacaaagttacaacgacagcaaacagggcgcatgccgcgtggcccgtacaaacgacagcaacaacagagaggaaaccaacaaagaca

SEQ ID NO: 538624 - DNA, 916 bp, Homo sapiens
  misc_feature (79)..(79): n is a, c, g, or t
  misc_feature (103)..(103): n is a, c, g, or t
gcccctggcctattgcacgtggctactgacagtgggattcccacgccaggatacccatcaagtactacgaccatgcacnctgaccacagttgtgcaacacatncattggacaaccccaccccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctgga

SEQ ID NO: 538625 - DNA, 1497 bp, Homo sapiens
  misc_feature (1255)..(1255): n is a, c, g, or t
ctcttggtcaaacaaatggcacagcctgacctctagcttggtcccatcaggtctggcatctgtgccagcagctgcatctgtagccaggagctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaaggtcctgtgagtggagaggcacagagtgttctgggctagctgagtgtggaggctgggtggctctgatgctagccaatcactctacgctctaggctcacacctttccacctccgacttcgccagcagaagtcttgagttcaatctcattgccctggcttgggtcacatgtccatccatgaaccaatcactagactgggtgcggaaagctctgatttgccaagttcgggtcatgtgtctcactagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaaatgtgctgagccctgttttcacgtatgcctctgcacttctccattcttcctgttttgtctaggttccagagggttaaacagcttatctcccatggcgtgtttggatatctgctgcctgtggtcaggaaccttgcactggggaaacaatcatgtaatccacagacaactctatttgtgttcttcagccntcacctgaaggcttttttttggctggcttttaatcaaacaatcttttgaaacaattgtggtctaagctggttgtttctatttgttcctactgttctaaaacaaatgatttactctagaaagtagaaaatagaagttgtttctgggctaaaagcctggacaggcttgacaaggtcacctgatgtgcatgtttccgctcatctcccacccaggagtcctaagggtcctccagacaagaaccaca

SEQ ID NO: 538626 - DNA, 133 bp, Homo sapiens
tagaaatacacaaaatagagttgagatgctggcttgtgttggacattgacacaggcagttaaaaatcttatctactctagggtgtttcaactgtcacttttgtttcagatctcttaagaatccgtatctctag

SEQ ID NO: 538627 - DNA, 764 bp, Homo sapiens
  misc_feature (79)..(79): n is a, c, g, or t
  misc_feature (103)..(103): n is a, c, g, or t
gcccctggcctattgcacgtggctactgacagtgggattcccacgccaggatacccatcaagtactacgaccatgcacnctgaccacagttgtgcaacacatncattggacaaccccaccccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaaggtcctgtgagtggagaggcacagagtgttctgggctagctgagtgtggaggctgggtggctctgatgctagccaatcactctacgctctaggctcacacctttccacctccgacttcgccagcagaagtcttgagttcaatctcattgccctggcttgggtcacatgtccatccatgaaccaatcactagactgggtgcggaaagctctgatttgccaagttcgggtcatgtgtctcactaggtaagagcagaggaggatcacccccaggaagaccagagtgctctttcagaagagtgggacaatcgctggatggctctttgcaccactcactcctgttctctgctagggctgctgggactcacaaggggtaggttgtggcagctgc

SEQ ID NO: 538628 - DNA, 555 bp, Homo sapiens
tattatatatgactcccataagtttaacccttataacagcacttgaagataattctgcctaattctcacgtcattcttgggcaacaattatcaatactgattaaattttgaatttgtaaaatggtcaacccacatgtagatttcgttgccaagcacatgttaaagtatatatccctatatctaacacctgaatgtgtggtgggaaggggcaatgatcagtaaagtggcgttggttcaaatgtgtattgtgtcacataatgggcccttctccacggaagtttgcacaaaccctgtcagtaacccataatgcacaaaactgtgtttaccttgcaattaaaaccacagtgaaagtttgggttttccttttgtgctaatcaaatcaggtgtaaaatcagagcttcttatatattcctactgggataactgcatcttccactcagtcactactaaaaagcataggcttcagtttcgcaagaaattttttttattttcttcaatggttgtgcagataaggatccatttctgggataacaccggagatttaagtcatcttct

SEQ ID NO: 538629 - DNA, 104 bp, Homo sapiens
acgggctgcgactgaataagaggatcaaccctgataagggtgtggcctatgttagcggcggtgcaggcgaacatcctgatgggggacaagtccgagaacgtgca

SEQ ID NO: 538630 - DNA, 215 bp, Homo sapiens
  misc_feature (178)..(178): n is a, c, g, or t
acacaacaaatgagatattccatgctcatggataggaggatcaatatccgaaaatggcatactgccaagcaattcaagattcaatggcatcccatcaagctccatgactttcttcaaagattggaaaagctactttaagtcatggaccaaaaagcccaaattccaagcaatcttacgnaaagacaagctggggcatcacgctcctcctcaactat

SEQ ID NO: 538631 - DNA, 153 bp, Homo sapiens
ggatctcctatcgtagttcgctttgactggtgaagtctagcatgtactgtcggaggtagggtctgctccgaggtcgccccaaccgaaattttaatgcaggttggtagtataggacctgtgggtatgtaaggtactgtttgcattaataaatta

SEQ ID NO: 538632 - DNA, 214 bp, Homo sapiens
cacatcatacttatattatccttactactacctgtcattccttctactccccttatactccaacaccactaccctactactatctcccacctgaaacaagcttacattacttacaccgctttattccattcaccctcctctcccttggaagacagtccccgcttcccggcgctgtgcccaaattggccatttatcgaataattcactaaattag

SEQ ID NO: 538633 - DNA, 388 bp, Homo sapiens
gctcggtccctgtgggtggcaacaacaacagaacgaaacaaagcatgctcagctattgagacactgtcaagattacgttataccatccaaagtgcattattgtcacttttttcctgtcaagtatatagagacttctatatcataatcatccttttttaaaaaaaagaatttcaaaaaagatggatttgacacactcaccatttaatcatttccagtcataatatatatttggctgaaattatgtcacatggatgtaatatagggtttgtttgctgcttttgatggctacgtattcggagagagcaatcttgctgtgaaacagtgtggatgcaaattttataaggctgactcttactaaccatcatttccccctttgttagttgtatct

SEQ ID NO: 538634 - DNA, 146 bp, Homo sapiens
  misc_feature (1)..(1): n is a, c, g, or t
  misc_feature (14)..(14): n is a, c, g, or t
ncttctctaggagngtgggtttttaaaaacaacgaattactctggtgaaccatacgtgattaataaagatttcctttaaggcagaggctggtcgagatgctgcggttatcttctggcctcacgccactctccacgtccgggtaccg

SEQ ID NO: 538635 - DNA, 220 bp, Homo sapiens
aagcctccatttccttaaggaagggtttttgtctctctccctcccccacaccgtagcggcgcgcgagggcgcccgtgccgggcataccgtaggttttccaagagatagcttcaccaacattctccacctgattaggcaaaggatccgagtgatgagagccccaggcgccagcagtggcagttcagagtacggaccaagcgagggccaggcccgtgcagag

SEQ ID NO: 538636 - DNA, 123 bp, Homo sapiens
acacttccctcagtttactctttcactgcctcttcatcttccacgttactcttcttttgacacagatccaataatcttgtctgagggcagtcacacatattcagtgccatggagtaaatggca

SEQ ID NO: 538637 - DNA, 1341 bp, Homo sapiens
  misc_feature (382)..(382): n is a, c, g, or t
tccattaaggaaaacgatgaattacctgtggaggttgaggctctccaggttagggacagggccgtggtcgtgcatgaaggccacaggaagcaaagtggcccccagtccaccttatctgtcccgtgccagtgaagggccatatacacgtggggtggggaggtcctcaggaggggtgtcacactattagcctttaggcaaatagcaagctcttctccatatttcagctctcgtgctccagccttccaattgtgaggagggactaagtgggggttgaggcacagggttgtgggggtgtgaagtgtggccaccagaaccgccgggcaaagagtgtgaggcagctatccaatcttgtgttcgtgaaaggttaagcaattctatcccnctctcgaggttattaagagccttcctgtccttcgacaattcgactttgggttaacaccagtctctaggtgaacgaggcctgtgtgggccaagctgtgaaaaactgtgtgggcgaaaaaacctgtggaacggagtgtgcccaccggggaaagcctatctattccttagacttcgtggtcgctttccaaagtgcttgagaagtctcacattgtttcgccccaagggggcaattccctatcatccgtgagactcggcatagtgttgttgtgtgaacgccagggccaggcccgtgttgccatcagattttccttcaatcttctccagagtcggggataccgagccaacagagagccaatcttcaacaggggctctcagggagaaaaattctgccccagttactcgaggaccaggcacgctgggccagtgcagccatgtggtgtggctctcaattgaggaacccccaccgtgtaaagggtttaacaaacattgatggtcccaggggggaacccagaaacttttcctcttttcctcagaaggtggcgggttgaaataagccaaaaactttgaattcgcccagaggtcccctggtgagggccctctgaggatctggccaaaggcgtgggcccccaagtagaagttgtgtgaataaccaaagccaggggtgacggagagggaaaaaaacccgcaagggggacatccccaacgggcaacaatttcggtacacgagcataataagactgtctctgggaacacccacaaaacgctgatgtaccttaaccgaagacacgacgtaataatatagaatcaccacacagtcatgatgaagcccacgcagagaatatgcgcgaagagacagtccccgttggtagacccttacacaagatgagataacacatacaaaaagcgactccaactgtggtttattggtcgtgtcgtgcgttgttttacactcgcatgacc

SEQ ID NO: 538638 - DNA, 575 bp, Homo sapiens
  misc_feature (30)..(30): n is a, c, g, or t
  misc_feature (108)..(108): n is a, c, g, or t
  misc_feature (118)..(118): n is a, c, g, or t
  misc_feature (121)..(121): n is a, c, g, or t
  misc_feature (146)..(146): n is a, c, g, or t
  misc_feature (172)..(172): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (273)..(273): n is a, c, g, or t
  misc_feature (287)..(287): n is a, c, g, or t
  misc_feature (323)..(323): n is a, c, g, or t
  misc_feature (353)..(353): n is a, c, g, or t
attaggcaaggtactccttgctcgatcttnaacagtctccaaccctgttcactggacatatcacaagcacctcttgttttataggaatttgatagatggttcattccnttctgactanccnataagtgcatgctgttgccgcgacncctcattgcaacctggtcttagattnttcaaaatttctgatcctttgccacagcctctatcatcactcatcacgaagaagtcctcgatgatgcaactacacttgcctatccatggttcntnantntnttccgacatggcanaaccaacaatgctgtgtccttccggagtccagtgcncttcggcacttctgcaaccaggcagtggtnaaaggggtgctctccaaaaccatcttctagcagatctttttcagttaagattacttgttcttccatgtattcatatttagccagctccttgatcagccgcagtatgtcactgcagtcggcggcagtggctgggcggatcacgaatttagccattttcgtcttttgcttttcttccctttgcggaccaggcccctgtacttgaacagtaggaggagaggagga

SEQ ID NO: 538639 - DNA, 462 bp, Homo sapiens
atttatgcacgtgcttcatgatggactttaggtcagtctattaatgagctctctgcagatacacattcagtagcttatttggtgatgggatactgtatcatatgctcaatctgaaaaacttgaacacgggcaacatccataaagattataaaagcaaactaagttgtgaagctatagtacatgtaggcatatagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagcgcaggaggccctttattattgctgcagaaaacaaaagcctggctt

SEQ ID NO: 538640 - DNA, 104 bp, Homo sapiens
gtgctctgcacagccagtgtggtggtggctgtatgcatgggccctctactatcttgcagatccatcctcagtgagctccggcagatcagccacacagagatgtg

SEQ ID NO: 538641 - DNA, 260 bp, Homo sapiens
cctgtcaccgcgaggtgttggtgggggacttgatgtcccccttcgacccgtcgggtttgggggctgaagacaagcctaagtctcttagatgattacctggaggtggcccacagcacttcaaacctcatgggttctccagacgacaaagctaacagcgggctcctaccgaatagagctagggctgtaagatagaggtataggtacaataccctacacaacaaacaagacaaaagagagatagcctaactacccggggacag

SEQ ID NO: 538642 - DNA, 191 bp, Homo sapiens
ggaaacctgtactattagcctagtcaacccaccgtgtcttcggcatagccgtcggcaggagccctttgccaggtcttcccttgagctgtttgcagacaaagtccccagaccggccgaaaattttcgtgctctgagcgctggagagacaggtataggtataaggttccctctttcacagagttattcccggg

SEQ ID NO: 538643 - DNA, 377 bp, Homo sapiens
gaatcatagaaggctcccccaccgtacaactatcctgatacgtgtggctattggtcacttcgtggctaaaggtaagaacgtgctatgatggaagacaagtctgtggactatggtgagtctgtgtaggccagcagcctctgatctgtgcagggtattaacgtgtcaggactgaatgtactgggatttctctagaggctggcaagaaccagttgttttgtcttgcgggtctagtcagggttggaaagtccaagccgtaggacccagttacctttcttagctgatgtctttggccagaacaccgtgggctgttacttgctttgagttggaagcggtttgcatttacgcctgtaaatgtattcattcttaatatatgtaag

SEQ ID NO: 538644 - DNA, 238 bp, Homo sapiens
cacacagagaccgaccaattggcacgcaggcaatcccagaggagagtgtcattcagacagaggaaagtctccgtacccctcatgccttgcaagatgagaaaaacttacccccactcgcgaacattgatctcagggacatgagaggaagaagtgggaaatttccgttcccattacccgcaagaacgtctgagccttcaatgttgaatcctttcattattcaacgtctttttatcttata

SEQ ID NO: 538645 - DNA, 848 bp, Homo sapiens
caattgttccgcaggacccgtggttcccgaagcgccggttcttgcgaagtgaggcccttgctcccggcagactcacggtccccggggcctagtccttcgggattctcccccggtgtatgctatggccacattccccgcgctcaatatatggacctgtgtgtcccccgggaatgtgcccgctgttactctcctctccgcgggtcccaacacagcttttttttcttgggccccacatttaaaaaacagccgcttgcgagactcctagaaatgtccttaataatggccccacccccgccgtttactctttcccacccctcaaatttcctctttttcaaggcggcacccagcttctttcttcggctccaaaaaacacgcctcctggacatattccacccagatctgggcaactccttccttccgccccaataaattactttttggggcgccacccaggaacccttcccaccacgtgttctctgtcaattttgtgaagaaaataacaccccaacaagctattaatcttcttaaccccaccacaaattacaacaagtgtcttccacagacacccctgccaactttatgaaacgtctgcccccaccccttcggacaccccaattatctacatcttgcgttttatacttaagccccacctcatctgtgcgtttacatagagcgccccgtacctggctatgacaactttttgagtatccaaaatcaacaaattcccccccacttttatcaccccctcctctacccctaggacttagcggatctactctatcgtgagacactgaaatcaccctttttcccccctttccccaaaaacccaattcccccccacaaaaaca

SEQ ID NO: 538646 - DNA, 147 bp, Homo sapiens
catagtcacgtagaacttacgaacttgtgaagatagtaagtgacgagggaaggattcatggttagatattagctagggtggcgcttcctattaggtgcataagtaggtacgacctagcagtaatgttagctagttaggcgtacggac

SEQ ID NO: 538647 - DNA, 305 bp, Homo sapiens
cgacttgtgcacatctgttcccatccgtactcagcctctcttgcccgatccccgacttttctactcgaggccaggtaaggcttccaagcgtgatggtgcggcacggtaacgagtcattgcctctcatgccacctggagatttggactacttcctcctcccaactgcgggttcccagaaaccctcgggtcccacgtggctagacttacatatattcaattcactcgtcaccagaacttcctaatgagacaatccacggtgcgccatcaattgaacacagtacaaggcagtagtacaggaaacctgg

SEQ ID NO: 538648 - DNA, 323 bp, Homo sapiens
tgatatagagtctcaccctgttgcccaggctggagtgcaatggtgcgatctcggttcactgcaacatccgcctccggggttcaaaagattctcctgcctcagcctcctgagtagctggggttacagccgcccgccaccacacccagctaatttttgtatttttagtagagacggggcttcaccatgttggccagcctggtcttgaaatcctgacctcgtgatccacccatctcggcctcccaaagtggtgggattacaggcatgagccaccgcgcccggcccaaatatagaaaatgttaaaatacgtcgacgcggccggaaat

SEQ ID NO: 538649 - DNA, 135 bp, Homo sapiens
gattcgtgccccgtacagctgagaatgtagaccagggtaggaagtgagaggagtaatatgcaatatgagagtaaggggaagtggtaaagtaggctgagagttgggagaggtcagatcatatggcacggaagatca

SEQ ID NO: 538650 - DNA, 310 bp, Homo sapiens
caccccagcactttgggaggccggggcggccagatccactggggtcgccagttcgagaccagcctgacccacatggagaaatgccgtctctactaacaatacaaaatcagctgggtgtggtggctcctccctgtaatcccagctactcaggaggctgaggcaggagaatcgcttgaacgcgggaggtggaggttgcggtgagccgagatgtgccactgcactccagcgtgggcaccaagagtgaaactccgtccgaagggaaaaaaaaaaattaattaagtgctgtattctgttatttttgcttcctacc

SEQ ID NO: 538651 - DNA, 371 bp, Homo sapiens
  misc_feature (228)..(228): n is a, c, g, or t
  misc_feature (318)..(318): n is a, c, g, or t
taatttgtagcaaaagctaaatgttataatacttcagaggagttattaataatttaatttattagctctagtcttctttagtctttctttcctccttctttgcttttctcctttgtgaagaaaatctcattacctacccataacccatatgaacatgagtgcaaacatttgcagtttcaactattggtgaatggactcgtataaaatataccaatacacaattttggncaggggggttgtttgtttgagacagggtcttgctctgtcatccagggatgtagtacagtcgcacagccatagcttactgtaacctcgganctctcctgggggcttcaagcgaggcttcctgccgcatcctcccaagtaggcta

SEQ ID NO: 538652 - DNA, 425 bp, Homo sapiens
gagcatttgtctggggctcctcgctgttgagtccaggttgcacattcgccccagccccttaagcctcgttattgtcacggacccgcagcgctcccgtgcgttattgccaccccgtcgctccttctcccgctcggccttctgctatggggggagaagttcgtcctcgtcctcgtctggttagtgtttagtattccgtttggggcccagaggaagacagtgaggttgggggaagagcgtgggccccccgacggcctcccagtgtgggtgcggtgtgcgtgtgccctgtacacatgtccgtcctgatggggtgagggtggggagttccgaggggtggttgcacacctggttccgcgcggggggccttcagctccttcttctcctcctccgagtggtcagccgctgacgtgttctcctcgtcctccttc

SEQ ID NO: 538653 - DNA, 82 bp, Homo sapiens
gtgatctggactgtcccgactgggtcctggcagaaatcagcacgctggccaagatgtcctctgtgaagttgcggctgctctg

SEQ ID NO: 538654 - DNA, 419 bp, Homo sapiens
  misc_feature (123)..(123): n is a, c, g, or t
  misc_feature (284)..(284): n is a, c, g, or t
ctcggggatgtccactggccataaccctctcctttgggcatgggataagctggcaatggatctcctaattaaataagcctcagtctccagactctaagccatcactccacattatgccctcgnggatgcggctactggagttcatttactggaaaatgggtatctttaatctatactcgtccacagtatcaaactaatttctgtcactggcccggtcactgtccagcactaaatccatggtcctactggtgaaacctgtttttggacaatctgtccatggccangatgccaaatggacaatctcctcttcctgggtggctggtcatgggcccatcacacacatgacgttctggccataagccccgagagtggtctgggctaggcgggtaccggatgcttcggaatcctgtaagctcatg

SEQ ID NO: 538655 - DNA, 397 bp, Homo sapiens
acctcgggcggcatacctggactctgtgagattacatttgaagtagttcttataattgtattatatatagtatagtcttttttttttcccagtcaggatcagattttctatcacagtacttttggtaagaaaataaaatatgactggggtcccatttagaaggactttggtttagttctcatctcctcaaaaaggttaagtttaagtatttagttaaaacatgtaaatgagttccttggtgaacggtcttggtttaagtaacttacacttggggcttgcaaaagcggctcttctgacccagcactaccaggtaacctttaaggggaaactgatcatgagattggatgacccaaatcctgaacaagaaaaggaacgattttgagaaggtccaggtttg

SEQ ID NO: 538656 - DNA, 1096 bp, Homo sapiens
gttttcctgcgcagtgagcctgcagggtctgtaggcagccatggctgcccagcctggaatggcatggtcttgaatgccccactttccacaatggacgtggcatgctgtgctgctgtggccactgtggttcaaccatgcctggccctgtaatgatcctgcagactgtaagtgccctgtgcaaatgccatatggctgctgcctgcatctgcccctgctgcccctgcgtctgggtcccatcctggcccatctgttgctgcttgcccctactgtgttctgtgtaccacaacgaagtggtgctgctgcctgtgctctgctgtgctttcaggcctttggatggaagctcatgtggtttggcctggcatttcacaatgacatgtgtgtgccctggaccatcggggcattctcttgttgcgctcctgagtggaggtgctggaacaaatgtccactgtgatgtcccttgcagaaccaaactgttgcatgcgggctttgacatggatgttacctggttccaaagatcttcagttcctacttccctcagtgaaatgcccttctgggccccccaagagaactggggaggaacagtttcctggcttagaatgacaccttgacaaccttggtccaaccccaaggtctttgaccctgggcacacaggtgtcaattgcccccggtcccgggcaaacccggtccctcattacagcgcaacgcgcaggcaaacagccttcgaggtccatcgcccgttgatgtgcacagcgcagagaggacactcttcccactcatgccctttccgccgtaacgctccttcccgggttcattcgcgccccctgtttgcccaacccgcacccgggcgtcctttccgggcgatttcactgggcgccacaacgcatcaggaatggcccaactgcgcacatggcccgggcagcgaatctctccttgaatatgtgtccggaccagcacctggacagcgacgcgtttcgatggcccctttccctttgggttcgacttttcgcgaattccctgtgtccgcggccaggtccatttgccttgatgtgctcccaccggtggtcgttggtaccggtggggcaccaactctgcggcc

SEQ ID NO: 538657 - DNA, 336 bp, Homo sapiens
caaaaagcttcttgcttatgtataaagctaaatgtgataatctcaaaaaacggttcaaaataataattactttccagtttaaaaactttaatcctaaattaaaaaaaaaaatctatacacaaaccacggattggcccagaccaaagaaagaaagaaaagaaagaaagaaagaaagaaagaaagaaagaaagaaagaaaaaagaatctcagcggtagggtaagcaggacccagaggagctgatatccacagtttcttacatggacaactctttcaggcattattccataaagtactttattttacaaccgtgctttccttataaaactaaatgtgcg

SEQ ID NO: 538658 - DNA, 544 bp, Homo sapiens
tagagatagtaaagacagggatttatcatgttgcccagactggacccgaacttctgggctcaagccacctgtctaccttggccactcaaatcactgggggtacacgtgggaatcactgggattacaggtgagaaccaacatgcctggccaacctctgatggttacaagttacccagcctaaggcatttgggaaaacagcctatggtcactaaaacacacacaaatactcgtagaggtaaagaagatatagctataaagctaggtgaccgacatgtgctatgagtatgaaacattatactaatgtcattatgactagaactgcctctgcccaaaagatacggagaagtgctcacctccagtagctaacagataatctgattgggaaattaagctgttacagacgtcatcaagttacaatgagatcattaccgggggccataatccatatgtgtactatgaaaaagggaaatttggatgctgagccagacaagcatacacgtaagaggatgttatgcatgcttgacaagatgaccaccatgctgag

SEQ ID NO: 538659 - DNA, 334 bp, Homo sapiens
aatgtcgaccctatgtgtgtcagtcacgtgtgagacaggtctctcgacagaccagcatcccatcaggtcagcttgaacaatactctcctggccactactgtgccttttaagtggggctatctatttatattcacgattggtatcgatatgtgtggatttgctcctgtcattctgttgttacactggttatacatgttgacttgttagtgtagtacgctttaaagttatactggtctgtctgtgtatgtgtgtacggatgccacacacaaaccccagagtcctgctctgtgtgtgtgtgtgtgtgtgtgtgtgtaggatgacacaaacaaacccc

SEQ ID NO: 538660 - DNA, 316 bp, Homo sapiens
aagtacatcatcactaccttctgaatctacatctaatgtgttatccttagctcctatcgttctctattatacacgtatccagcaaaatccatatcatcctttccagagctgaaacagttatcatcttcaaatgtgtcaatcagctcttcaaattcttcatcatccacgtcttctatactttcttcatctgcatcccgtattcgtatctctataacagcaacttttttataatacctgtggaaaaacacttcatccactggtatttggctttcttctttagcaaggaactccttactgttcacaggaagatgacgaa

SEQ ID NO: 538661 - DNA, 538 bp, Homo sapiens
tctttatttccaaagatttttgtttcattattttgggaaatgaaaatgcaggaaaatcaagacacagctaaaactctttatattacattttaccgaaaaaagaaatattataacccaactccaatgtgaggaatttctcattttccttcttggcttttgaagctactgaggtcatgtctctgatatcctccatcagagctctctgctggcaactgtacagatctagtctaggtgtacacaagggacaccacgctctcctggttttgctcactcctcattcaacaaccttgctcagtgtgactcattttctaaattttgtcttcctatcttctctcagcaaaatgtatcccagtaaagaaattttagacttggagtctaaagactagtagaatatgactcttaggaacggggcccccagagtccctaaacagatgcccctgaagataagtgcctgaggactgtcattgaaagcttttcaggctacctctgtgtccctgcaggataggatggggccaatcagtagagctcaggaggcaga

SEQ ID NO: 538662 - DNA, 449 bp, Homo sapiens
ttagaggatccccgcacccaggcgcacttctgacagcctggaacagtacccgtgtcaagccccagtgatggaacagtacatgccctggagcatgcatcccacactccaggtgagcatctgacagcctgaagcagcacccacaccaacaggtgaggcatctgacagcctggaacagcacccacacccccgggtgagcatctgacagcctggaacagctctcacaaacccaggtgaacatcttacagtctggaacagcaccctggacccccgatgtgagcatctgacagcctggagcagcaaccatcgacccctggtgagcatcctacagtctggaacagcaccgactgccccctggtgagcatccgacagactggagcagcatccataagccctggtgagcatcttatatcctggaacagcacccatacgcccagaattgcgcctgggtg

SEQ ID NO: 538663 - DNA, 119 bp, Homo sapiens
aggcagccatgctcgctcttctccgacgcctctatctcttcctatgagctgctccagaattatgcctattttactgtatccaagctggcccatctcagccattctgtatgagactccac

SEQ ID NO: 538664 - DNA, 352 bp, Homo sapiens
tgtgtatgtgaggagaagcaggtgaaagaggagcgctcagctggtcagacagtgcaggtctatagttctcatcgtgtaagctgagacagcgctgtgtggactgagatgcaggattcttcacactctcgttgtgacttcaagagctctgcatctctttctgcaaggcatctgaatgtgtctgccgtcctgttagcataatgtgaggaggtggagagacagcccacccccgtgtccaccgtgacccctgtccctacactgacctgtgttccgtccccgatcatctttcctgttccagagaagtgggctggatgtctccatctctgtctcaactacatggcacgcgacatcgcca

SEQ ID NO: 538665 - DNA, 1505 bp, Homo sapiens
cgggacgacgacgaactacgtctcgacgttttattatttattttatcggtttggttttcccggtaataaaaaaggaccccacaatataacagggtaggagaaccgggaccaaaacggagacccatcccccttagaggtcccacaccaagggagacacgagaacaacggaacacacgcctcacacgggcacacgggcggagcggcggaagcgaacataacagcggcacgcctcagcacacctcgagacaaacaaagaaggacgagcacggacccctcacaatacccccacgacactcaacgagggcaacacgtattagcgcgctcctactcacaagagtgttatcgacaacaagggcaacatgaggaacgaataataactattcacacctatacacaagagagcagcagcacacctcacacatagagcaaaccacaccccagggattatacacctctaaaatcccttaaatcgtacacatcccacaaaagagggacgaggccaagaagccaccgacaaaagggcaaacagaaaaagccggaacaaagaaaatagggggaaccaacacagtccacaaacaaaaaccaacaaacacaccaacgcaacgaagaggacaaccacccacaaccacccacaccagaacccccacgaggagaaacccacaacccggaacaagaaggaccaaagtgggatcacgagaataaaccacacaaaatgagagagggaaaacaacgggacccacaacagaagagacagggcgaaacaccaaacccaccaagaggaacagagcaaaaatccccacgcgaagagagcaacgcacaaaaccaaggagaacaacacaaaacatataagcgccacaacagagacacgcaaccactcacaaagaacaaccacaaagcaaaaagccaggacaaacagaacaaaaaaaccagacacccggacaaaaagcaaaacaagaccaaaaaccccccaacaagagatcacaacagggaacaagacaaaacgagagaacacggccacaaacaacacacgcaacaccccgaaacaagaaatgaataaaacacccagcgacggaacaatcacaccacgagaaacaccggcgaacacagggcaccagccacaccagcaccgcagagagacagaacacccacgtggcgccacaaaaagaaccaccggccaccaaccacccaggggccaaaggagggccaagggccgaccacgacacacaggacccctgcaaacagcgagcccccaaaccaccaaacagaccggcaggaacacccaagaggagagccagaagacaataactacaaagagcgccaagagacaaacagagaaactgtactcacgcagacgagcggaaaagaacaagaggaaacaagaagcagcacaacggaaatagagaagcaatcacagaacgcacacaccaagggacacaaagagacaggtgaaggccctatgcacaagcgcacagaacacacgggacggcccgcgccatcgatgccac

SEQ ID NO: 538666 - DNA, 752 bp, Homo sapiens
gcgggggaggagggaacagcggcgcagtaagactgcgcagatgaggaggtcgctgagagctgggacgaggcggcagacagcgggcaggaaatccaaatctcctcccaaagtgcccattgtgacttcaggacgatacgccttcccgcgggacccccatccaaagatccggcatacctcaagaggcccactcagcaaacggatgtggtcacgcaagacccaaatccacaccagacagggcccacaccaattccaggtcaacgtcccatagacaacaagagaaagaagcgccagaagttacacgcccagaagggcccccggaaagcacaggactccattgggagccaagccagcccaaagaccccacgcaagacaggcgcaccaaggggagaaaaacccaccaatcccctcccaaacaggagacccaaaacccccagagccactattcgcaccaaaagcaccagaacaagcactcaggcgtaggtggaaaggcccccaaatactaaactagctcaacctcccaggaacacgagcaccattacggggcgtatcccctcagcattacaagcatacatcaaaaaggggcccctttgccgaaaaaaccacagccaggacctagcaacatacacaccacctgccaaagagaccactacccaaacacacaccaacaatgccagagaccggagcaaaactgcgcatacgacgccgcaaccaaaccacggaccatatccgattgagaagaatccgaatacgcg

SEQ ID NO: 538667 - DNA, 650 bp, Homo sapiens
gccaagagggagcagtagccaacatgtcagggtgggagtcatattacaaaaccgagggccgactgagagaagcagaggaagaacaagaagagaagcattgtagagcaagtggagacgtatagagataattgcaggaacgcagactaggtttgacttttgtctggttgatgcctccaagggctactgtgttgaatcgtcagagctgagagatgagtgtgacacctgttttgacagtgagcgatccaggtgtactcgcaagagctgttgttacaatcgaggtgaacgtactctatgagagcccaggtgtactactggagaatcatctgtgggactagttcgggtggttcctaagtcgtgcttacctgagccaacagaccaaatgacatctctaagtgtacatgtgttatagagagattgagttagttacgggttcttttaacaaagggaaaggcttagggtaagtaagagtcgcgagggggtggccgaaaaaagcgggagaaatgtcctgagcaggcctatgggtaccccgagtctcttttacaggggtgtggcaagggcctagggggtcaccgaaagaaaagacggcttatctaccaaaaagaaaccattggcagtggggggcccaacgggagtccgttgaaccttacgtc

SEQ ID NO: 538668 - DNA, 150 bp, Homo sapiens
caacgcagcacaagttgctggatcatatagtaagagtatgtttagttttgtaagaaaccaccaaactatcttccaaagtgactataccatttgcattcccaccagcaatgaataagtgcaggtacacatccttgccagcatttgtttttg

SEQ ID NO: 538669 - DNA, 211 bp, Homo sapiens
tgtaaacgagagaggaaggatcgagaagcatacctggatggatggatgctgagcaggttgtgtagcccacaatgccctgtgagtgtgcacgagccatctacgcctacgccctgcaggtgttccccagacaagaaagagtgtgtgtgctgcgctgccgcgttacttcagagaagaaccatgtgcactcggtgagtccctgtgaagcactcct

SEQ ID NO: 538670 - DNA, 551 bp, Homo sapiens
gggtatgcagtgcattggttcatgcctgtaatcccagcactgtggaaggctgaggtggagcagatcacctgaggtcaggagttcgagatcagcctgactaacatggtagagaactccaagtctactaaagatagaagattagccaggtgtggctggtcatgcccgtgatggcagctactcgggaggttgaagcaggagaatcacttgaacccggaggcagaggttgcggtgagctgagatcgcgccattacactccagcctgggcaacaagagtgaaactctatctcaaaaaaaaaaaaaaaatttagggtatggttatttcacaaaactttaaaaccccattttttctaaatttcctttaaattctaaaaatctcttgtttcccattccatttcatttttttatgaggatgcaattactgaccaagagtattccaggttaagaaaggttagatccggtggacgttaacacaggcaaaaaattttttaccatttaggaaacaccactgcaaaacaattaggtagatcatcacgtgtatctccaggcattta

SEQ ID NO: 538671 - DNA, 1000 bp, Homo sapiens
gaagctcttgatgcgggcgggtgtagtaagcatggtccgaccagattctgtgcgcggctggtgactgccaagacatagccacaaatgtgcacagtttggctgacactacacagctttggaggcgaattagccacgaatactgactcttgagtcacattcttgctagccttcctggaagtatacacatatttggaggaacaagggaatgaataacaaacgtcagtctcgcataaccactcgtcctgtgacagactagcttgtctcacgcaatcatcgtgactggtaatgagggaggaggtctccagtacgtcgtcgagtgacagtagattgaatggagacttgattcttggatcgtgttaacgagtggttctctttggtggcttttgtccaaatccggtggatattgcatacttgattgtgttcctattgtccactagtagggaccaagatgggtgtcgcatatatgaagtaaacctatttgtcagacatgttgagaagatagatcagctgctgcgtccagatgtgtatcacgccgagcattccaaaactgtcatcagtcctgggtattgatatcactcctacagatatagtaatgggtagtgtccaggggactcaggatgatgaaatcgcccatctgtgttcttgaaggcctcaaaagtcgaattttcgtgcagaacttaccaggggtgcattaaaggaagccacgataggcgctgagagatgctcgctatgtggactagacaccaaatggtatcgttcatcattgcgtgttccgagactcatgcgttggccggtccagtgaacaaaacgcttggggatggagaaggcgatcccaggatttcacacatatgagtggaagtatgcccatgctggagaggaatgtccacaaggaagcggcagtccaccgtgtcgaaatccggaacggaagagaattgcgcaggaattggtccaaattaaaaggaagtcacgtccccacagggagcaatggcactataaacta

SEQ ID NO: 538672 - DNA, 264 bp, Homo sapiens
ggtcgacggtgtggtggcatgtacctgtggtcccctctacttgggaggctgaggtgggaggattgcttgagcctgggaggtggaggttgtagtgagctgagatcacatcactgcactccagccctgggcgacagagtgagactctgtttcgaaaaaataaaacgaaataaaaacttagctgtaagggtaaaaaattagaaactggctgggcacagtggctcatgcctgtaatcccagcactttgggaggctgaggcagtcgacg

SEQ ID NO: 538673 - DNA, 684 bp, Homo sapiens
  misc_feature (357)..(357): n is a, c, g, or t
  misc_feature (367)..(367): n is a, c, g, or t
  misc_feature (377)..(377): n is a, c, g, or t
  misc_feature (384)..(384): n is a, c, g, or t
  misc_feature (386)..(387): n is a, c, g, or t
  misc_feature (392)..(392): n is a, c, g, or t
  misc_feature (400)..(400): n is a, c, g, or t
  misc_feature (439)..(439): n is a, c, g, or t
  misc_feature (497)..(497): n is a, c, g, or t
  misc_feature (499)..(499): n is a, c, g, or t
  misc_feature (503)..(503): n is a, c, g, or t
  misc_feature (506)..(506): n is a, c, g, or t
  misc_feature (510)..(510): n is a, c, g, or t
  misc_feature (512)..(512): n is a, c, g, or t
  misc_feature (519)..(519): n is a, c, g, or t
  misc_feature (524)..(524): n is a, c, g, or t
  misc_feature (545)..(545): n is a, c, g, or t
  misc_feature (547)..(549): n is a, c, g, or t
  misc_feature (551)..(554): n is a, c, g, or t
  misc_feature (561)..(561): n is a, c, g, or t
  misc_feature (563)..(563): n is a, c, g, or t
  misc_feature (565)..(569): n is a, c, g, or t
  misc_feature (571)..(571): n is a, c, g, or t
  misc_feature (574)..(574): n is a, c, g, or t
  misc_feature (576)..(576): n is a, c, g, or t
agattcggaacgaggtaaaacccccgggggtaatggggggcagaaaccgtgaggctgctgccccgtttagtctgccttcacgggtacgtgtccccattccccgcagctccgtccctgacccacagtgggccaggccatcagaccgttccaggctaaccggcttccgcatgagccacgtactctgtatgtcagccgtataaccaagaggagcgatggggggtccaggccatggtgaccaaccgtttctcagcccacttcaatcgagggtgctccccaccgtgcaggcaggtaggcaacacctctatctgctaccatcagccccttccagagcccatctgccccgcccagccctgcccngcccagccanaccctgctcngccccancnnggggngccctgcncagggatgggctggcagggctgtacccagcctccctggnaagcagagactcaagaaacctctggggtcctgttttctggtcgtgtgatcccaggggngnacanggncccntngggtgtntgaanagaagggcatgggagggaggnannnannnntgcagtntnannnnncnggngnagcgggcagctgcccactcccaccccaccctgcaccgcgggctcctgagtcggcagattaagcattttataaattgtattttaaatacatgttttaaacttgtcaaaa

SEQ ID NO: 538674 - DNA, 279 bp, Homo sapiens
cgagatccgcaacggcgcgcgccgtacgatcaccagggtgtacttgcctggttacgtgctggtgcgatggacctcactgacgactcgtggggtatctgcgccacaccccgtcggtgaccgggttcgtcgggcaatccaccactccgatcccgttaacttttgatgaggtcatcaagatgttgacgccgtcggttctcgccagggttagtcgtgagaacgctgacaaggctccctcaccgaaggctaagccaaaggttgaggttgccgactacgaggtcg

SEQ ID NO: 538675 - DNA, 171 bp, Homo sapiens
ttttttcttggccctaggggctaggtggcttttatttcctctcttggtgttttttggggagggagctttcccaagcacatcaacctaaggaaggggtggttgcgcccccagcagcgaggggctggaactgctgatcattcggaaggaagggttcgttcttggtcgacgcgg

SEQ ID NO: 538676 - DNA, 348 bp, Homo sapiens
  misc_feature (192)..(192): n is a, c, g, or t
tgtagtaaatcatggatgtggtggctttccagttagaggctctgattaaacagtgctctcatgatggacgtcgtcagagcagcaaactgaagacactgagtaaaaaggctcttttaacctcttttctttgtcttaacattgattgatgatgggcaataggggccaacttgccagttcttcactggctccaanctttctttttcccttagacgacaggtttatacctgtctgtttgagaatagggtattttcctgttccttgattttgtgtgtctctctctaagctagagtagtttatttttgttcgcttctttttttttaaccacgaaattggaaaaatttagattaa

SEQ ID NO: 538677 - DNA, 1609 bp, Homo sapiens
tgggttgagcacaggttactttatggatggtacatgacaaggggcggctccctaggcccctcccctcttcaaggggtctactgtggcaacgtggtgaggaggggagattcaggtggtggggggggactgaggtttggcagggactccccagcaggtgagggtctctctcttcctcttgtgctctgtgctggggctggtggctccaggggttctatacctccttgtggaggccatgtgtgtgggccattgaggctccaccacccgtgtgtgtgctgatagccaaatctcgtggctcaataccaggaaattgagcttgacaaaggtggctcgtgtgagggcaagtgccagcccccaaggcgttcaagagggtggaggaagagtggggtgactacgcgtgagttgaaaatctcaggaggaagaacacaaccgtgggtgcctcaggtgttagccccgaggaagtgtccctttggagggggggtcccttcgcgaaagcgcccgctgtgtgcatataccacccaacacttatctttgagaagtgttcaaatcagatatatggggggcaaggggatttattctctatagaaagcggtacgaggtctacaagggtttcacaacacagtgttgacccacctgttgggccagggcgagggtgaaccagcggggaagtgtctcaatttggcccaagtgtgaacagcatttcccacaggatttaccacgcactacaaggggggaattagaacctttttgccccccaaaaaagacgccttatggagaatagggcctggccaaatgttaatagaagcagccaatgggggaaattaacatagctaccctatagtgaaagaaggcccccccaaggtgtgacccattacaaacgggcccaacaaagtatttcccccgcggagagaggtgcggccccacatccacaaacaaagatagtcacatacgcgagaggactgagcaccgagactggcaatggacgcacgatgttgaaaacacgtgtgttgtggcacaattagaagagtagtcaccactattgcaccaacgagaaaatcaacccacacaaggtttgtgtgctcgcatgggagaagtataaacacccttggtagcaccacgcgtggtgttgtgcacaaaccacacaaatttgatactgagtgtgctacccaacacaaaccagactactacaggaggagaagaaaaaaaccacacagaagaggcaggagagatgaccacacgtgaaaccaccacgaatcgatgtagtgatcaacaccgcccgaaggtgggcaacccgcggagagaacccaatcggcgacctatggacgaaagaggcaacaccacgaaagacagatgccaaccaccgccgaggagagagaccccatcaaaagacgtccggtgttggaaagcaccccacttaagagaaaccgggaaagagagacaaaaaaaaaaacaacaaaaagagataaagaacacaacgaagagaaaaacaaaacagtgggcgaaaaagatcgtccaagaaggaataagagcaaccaaccaaagagacagaggaagacaaaagaaacagcagaagacgacgaaaaccaccaaaacagagcaaaacgaaatacag

SEQ ID NO: 538678 - DNA, 236 bp, Homo sapiens
gacatgcgttgtcggctccctgaagctttccacagtatgagcagcggtcagaagacagtgttcataaagtagcgatcctccagggcatgggctgtcaaataagtcatctctgtggcagtgtttaagacaagcatcgaatgccacagtgagcgactgtctttcctcagagggttctcgaaggtcttgacagtatggtccacagtgcacaagtacagggccgagcgcgtaaatcacct

SEQ ID NO: 538679 - DNA, 583 bp, Homo sapiens
  misc_feature (374)..(374): n is a, c, g, or t
  misc_feature (378)..(378): n is a, c, g, or t
  misc_feature (380)..(380): n is a, c, g, or t
  misc_feature (454)..(454): n is a, c, g, or t
  misc_feature (463)..(464): n is a, c, g, or t
  misc_feature (471)..(471): n is a, c, g, or t
  misc_feature (492)..(493): n is a, c, g, or t
  misc_feature (496)..(497): n is a, c, g, or t
  misc_feature (499)..(499): n is a, c, g, or t
  misc_feature (502)..(502): n is a, c, g, or t
  misc_feature (508)..(508): n is a, c, g, or t
  misc_feature (510)..(510): n is a, c, g, or t
gagctccttctggccatgttatatgaaatgtaattcttattttataaataatgtgatgtaaatgtaactggtgccccctccccgatgtgactgagggtgagtgagtggtggcggggctgctccttcccacccctcagaacagctctgatcctcgttaatacctggctgcgtgtgcagctgaggagggagtgaacctcaagcctaaatacctgttaggattggagggtctgggtgggcctgggcctagcaatcaagcttctacctgtaccttatgtaaggtagaccctcctagctcaggtactgacactaggagcttctacctgtaccttatgtaaggtagaccctcctagtgtcagtacctgagctagtttacntagntncgcaggcaggacagccggtccgggaaccctgagtgagaatgagtgtggatgtgtacagtacacgcactggacgnagcgggagnntgggacnttccattacaaatagagatcnncannantgnagtctngntacaatggctattatgtaactagtgagccgtcgtttgacaatgcagtcgggatacactgccgtcgttacacgc

SEQ ID NO: 538680 - DNA, 1371 bp, Homo sapiens
cgcattccgttctacctttggtgtcgtgttttgtctttccctgtttgggtgtgcctcccttctcttgtcactctcttcgtttctcgtctcgttctttttagccgcctgcgtggtgttctcttgcacaatccttctgtgttcgttccctcggcccctctttttcaccccacatttgtgctccctttggtctgtgcatatcctattctcgtgtttgagatcctccccccgggcttctcgttttccattttgcggtcgtctctggttttggtcggtgtgtccccctttggtggtcctattgtctctagattgttggtcctgtcatcccctttgctgtatgatttctcgcccccagtcccccggcgaaaatcctctcgtggccaggtccacaggtagggccccacaaatcgccaggcgtcttcttcgcttgggtccgttatccacttcggtcccctgtgttaccctttctaccccccacgtacttgtctcggatagactcttcattggcgtccccgctatgacatgcccggtaccatgccttcctctgggcgactttcctcgcttcaggatcgggttcctctggatatccaagtccttcgagtccgtccgaggcctatcatggttcagtggccctgtatccttgccaaggttgtccactccacgaaagttcccgaggcacagtgacgtgtgtcgagtacatgacttgtccccgtacgagcctacacagagttccctctagatgatttctgtcagcgctccaagccggagttgccccctgcgcggtaccaaccactccctgctccggaagcattcgtggtgttcccggttttctagaacgatcccatcgtacagcgactgcccccatcagatgaatgaaactgggtacggacacgcatacaccataatcaaaagcagacgagaagccaagagactggagtgcgaatgaggagacagacggaagaagaaagagcaacggcggccctggtatggtacacaggaacaagaagcagctaaagccggcgcaagactgaagattcccccgcagtgagatgcttcttgtcacgcaagccgatcaccatactccaagtttgactgtctatgtaagcaatagcgatctgcccagcatcatgacagtggacgggcaaagagctcagctaagggcaagccaagaagctgaagaagctcttcgaggctcaggagaagctctcacaaggaatatctgcacgatggcccagaatggaagcttccagtgagggggcacaggactgactttttacaaccattgtggactagctggcctgctgtctgcctccaacgtgacaacctgtcccaagcgcatcctactcatttgtttacacgtcaccccttgggtcc

SEQ ID NO: 538681 - DNA, 566 bp, Homo sapiens
gaattatgtcataggctactatgcatcagaatcacatggagggctttctaaaacagactgctcagcccacccccagggtttctgagttcataggttataagaggtaagttgaacaattccccagatgatgctgatgctcctggtccacaatgtgagaaccactaagttggagtactgactcatagagataaaattctttgaaagaaatgtactgttttaagatactgtaaaatgtggaggcagggcaaacgtttataagggctgttatgtatgggatgtgtctttgacccaaatcgacggcctatagagaaatcgccatggggactttgcattaagttcaaagtacaatacgacctgggccctgttccgtatttagtcagtatgtgcacgtgggacactttagtgcaatatcgcctccttattgagacaagtttgaacatatggccttaagcctctgtttcacaggagaagtgaagttgtttgccattatattattttataatttggaatcatggcaagcagtcttagagcaaagttataattaaaaagttttgatcctagtcaaa

SEQ ID NO: 538682 - DNA, 421 bp, Homo sapiens
ggctcccggaggactgcaggcaggatgacgcaaatcacggtgattgtgaatggagttgttatggcctttggggcatcccatcccacccacgtcaacgtccacatccaccaggagtcagttttgacacaactgttgaaagctggaggttctctgagtttctttttcaccctggggacactgtgccttccacagtcagtattggttatgagcacttggctctaggggtgactcaaatattgttgggggttgtgagttgtgttcttggagtgtgtctaagcttggggccctggactgtgctgagtgcctcaggctgcgccttttgggcggggtctgtggtgatcgcagcaggagctggggccattgtccatggctttgctacagctatggctgctgttgtcctctgcgtgtagcttttctggtt

SEQ ID NO: 538683 - DNA, 474 bp, Homo sapiens
cgacctaggcgcacttctctagcgctgcctttgaaagagctgaaataatcccagcgagtggctgggtggagggtgtcataagatttggtctcccaggacagatattggacaactggcgaagagaccctgccttgagattcgagacgaggtgaaatacgagcatgagtgagggcagaccgtgaatcgagagagccttgcatgaggcaccggataagcagaggctgccgagaagatccaatagatctttcataaaagttctgtttacatggaagtctcttgctgctggcgctattgccattcagctgcaaaattccgtcatctatttggactattgatattgtacgattgtgctatgtgtggattccagcatagattattcattaatatacactatctgacaagctcaaagctaaacagaattgctgacttggagctcagaatgggggtggggctctccgtgtgactgtgagctca

SEQ ID NO: 538684 - DNA, 452 bp, Homo sapiens
  misc_feature (243)..(243): n is a, c, g, or t
  misc_feature (278)..(278): n is a, c, g, or t
gtttagaggagatcccagttggtagcctgcaaatacaggcatttattaaatttcatggagcgtgataaatgagaaaatactaatagggacatttttaggaatttttgaaagatagaaagcagatgagctcagaactgtggagaaacaagtcagccagaatgcctgctatcacctctgcaatgtatttgtcctggagagcccagccaatgtattataagaaacagaaatgggatatgcaaatantggaaaggcagagatacacttggattacttacgantgtcactaagaaaatcaaagggaattttattagtcaagagttttgattgccaacaaaagaaaccagccctaatgtaagtagaaaataaattacaaggatatgaagtctcttgtcatgtttacagaagattggaggacatggttgagaaaatgtcctgatgggtatgagctgaga

SEQ ID NO: 538685 - DNA, 930 bp, Homo sapiens
tggaatattcacttcggtttaaggggcttaaagccaaggaaaggacagttccgaattcaatagaaattattctggtgacaattcatattggtgggggttggagggggagggggacaaggcttgtaagaacccacacccgaactatgtacaaaaataaccttatacagcaacccccactctgcaaggatgatgcagtctctgcccagccaccggggcgggggggcacactggcaagacagggtaccggggggagccaaccagtatggggccccaaatgcaggtgggagatgtgacggagggcaccagtccggagggagagggcagctataaggaggccttgcaacggttgctgggccagagcgtgtgagagcatcagcagttatggtcacacacatatgtggcggggcagtacgcgcgggacgccaggatgggccaagcctcctctggaaagacacgccggaaacctccttcccagggacaaacctccaaggcgggtcaattgtgcgccgagaaatgtacaccagatatctacggtacagaatggtaagtgtccccggggtgtggcccaatccagtggggcgcacccacaacagaatcgagctctcgggagcgtgtgagactcccctgggagacaacaactgttgaggaccatcagacccacactgaggccgggatccggaaaaaaaggtgagcaaagagaattagaattgagccagcatcgaacgagtgattggaagaaaaacccaagagagtcccgcaataaaggatcaggggaacaagacccacgggacaaaagccatcaacaaaccccatacgaggcagcaggactgcgacaaactgaggagccccacatgcgccatcacagaacaacaggtcggcccacagccacagatgaaacataggcaggaaacatattaaaacagaaagagg

SEQ ID NO: 538686 - DNA, 1172 bp, Homo sapiens
ctagatcgcgagcgggccgccctattttttattttttttcgtgttcacatgaattaacttatgggatccaataattattcatctcactcatttttaagttttgtgctcagatgtggaagacactgtacagctttcctccatctttccagtggtcatctacatcgtggtgttaaaccagcattcttcttcgtacatcttctcataggtgtccgtggcattctctttcgatatactcgtggtgaatttcctcaacaagtggacgcgcattacgtgctcaagtttgtgggaatatactcgtgtgcccctatctcctcttgtggtgtgtcacaaattcttcacgatttaaaactccgttttaaagtgttcgtggtacaattaactcataaattcttctccaggtgcttatacacaagataaatttttcacacatttaccatttgacccaagtttaagtgcattcttcatataattcttttccacctctatacaataaaactttcaaaacatttctatatatatatagtggccaagaagatatcatcaaagaatgtgataagccggggcattccccacctggtcttcacaaaaaaagtggctttatacatatagcgtgggttctccaacacacaaaaacattttataccaatctaatgttacggcgggtgtgctaaaaacatgtccattccttataaaactcccaaataaatcctatccccttttcaacaaacagagaagagggccacattacagtgccccacgaaaagagccagttgtctctacaaagggcccattaagagaaccttaacacactattcttccgggaaagagaattatccctattaatctccacataactggtagcaccctctataacggctgggatcagcgcatatttgggtatcgcctctcaccgacacaaaaagagttgtttacacccacattgccccagacataccaaggtgtcgcccacacaagcgatgcaggaccaagtccttgcaacaaaagacaaacctaacaccacagccatgagcacaccagaggagggaccatcgggcacaacacaaacagaagcgaagcgacaacgcacggtcataataagggcctcatataaaacaaaaagaccccaaaaaatagccacacaccacgccacatcgggaagaacaacaacaaag

SEQ ID NO: 538687 - DNA, 401 bp, Homo sapiens
caggctggtttttgaactcctgtactccgtgatcccaaccggctcaggctcccaaagtgctgggattacaggcgtgagccaacgcgcccggcaagaatccaagttaaaacaggttaacactttcacctattaccatcaggttgcttatttaaggataatgtttctcataagtatgcatgtttactttatgtttccgtttactaaccccctaaggcagcaagagagcaggaagataagcaaaatagagatgtttttgacaacttggcactgagagactatcctaagggaataatctgaaatacataaaaacattttattcacaaaattggtcatcacagcattatttacaatactgaaaatctggaaatagcctaaatttctaacaattgaaagaaggtcag

SEQ ID NO: 538688 - DNA, 993 bp, Homo sapiens
ggggcgaaaaaaagttttttgccccctacagggcggttttgggacgccccatatttgtagactttaagagagggagagaggccccagcagtttctctgggaccacaactctttaaagagcgcttggaatggaagaaacgctctctcctcagggtgatgggctcgtcgtgagataaacactgcgcacattttttggcgcaaagaggtgctcaaatatagagagagagagaggagagggatttacatttctctgtggggagaaaaaagagagggtctcacacaagagaggtgccccccccaccctctgtgtgatgtgacaccacacaagagtgttcttgctgtctggagagggagaggtttaaaattttatgtgggaagtttttcccccggcacccctccgtctgtgtggaacacacacacttgtgagaggagagccctctgaggtgggcaccacgaaactattccccttgcccacgcggtcccacagtgatattctcaaagggtggcggagagacctctgtgaaaagttcttgagaataaagagaggcgtggaaataatctcacccttcctgtcccaggggcacaaattgtgtccacccccaaagccacatggtatgctcctcttttgagcatatctcacacgaatgttgcacaggaggaccacggtgtcttctcactgtgtgtgttgttctcagacacacccgtgcgcgagaggccccacatcacaaggggtggccctgcacactggaccaccaatgggctatttttgtgtagcccacgaaggttttcataatgcaccatggaggtgcaaaatggtcccccacgaggaagtgcacgacacaagttgaggactcctttcaaccttcaatgggggccctgctgtttgtccactccctggcactgatggcccggccagagtgtcgcccattttttgcaagttttggttttgggcccttttgggccccccataaaggggggggtttttttttgccca

SEQ ID NO: 538689 - DNA, 417 bp, Homo sapiens
  misc_feature (188)..(188): n is a, c, g, or t
tgccccgagtgtggtaagggcttcggttggagtgttaatctccgtgtccaccagagggtccacacggttgagaagccatacaaatgtggggagtgtggaaagggcttcaagtggagttgaaccttgacatgcatcagagggtgcacacaggagagaagccttatgagtgtaatgattgtggcaagccnttcagtcgggtctccaacctcattaagcaccacagggttcacacaggcgaaaagccatataaatgtggggagtgtggtaagtacttcagtcaggcctcaagtcttcaacttcatcagagtgtccatacaggcgagaagccatacaaatgtgatgtgtgtggtaaagtcttcagtcggttttcacaactacagtctcatcagagagttcacacgggagagaagccaatca

SEQ ID NO: 538690 - DNA, 236 bp, Homo sapiens
ggacggtactgacagagagactctttctttttacaaaaaaaaaaaaaaaaaaaaaatttaaaacagcctacccagttagctatacgccctatgtcctattcttgggtaggagggatagatttaatagtctagaaatagtctacttgcaattggggcataagacagaaaaatcagttaaaaggctgtcctttcctatggggttagcacccaacctgttttctgttacagcaggggtc

SEQ ID NO: 538691 - DNA, 241 bp, Homo sapiens
  misc_feature (97)..(97): n is a, c, g, or t
tgcgagatgagctcatggggaattagaagaactagaacaggaggaactagatcagaatttgctggaaatcagtggaccccgaaacagtccctctacncaatagtttcctctataagcctaccatcaaaaaccgcccagaagaaagaagaggaggacgacgacctgaaggaattggagaactgggctggatccctgtaatggggtccagcgctggctgggcccagacagattgcggtgtttg

SEQ ID NO: 538692 - DNA, 248 bp, Homo sapiens
tacactcatgacattaactgccattcttgtgagcgtgggcttctgagaaggataaatttggcccctaacttgtgtcccttgtcttgagtaccgcatggtatgacccagcaagaaggtcctcaccagatgccagcaccaggctcttggacttcccagcctccagaagtgtgagccaaatacatcttttattctttataaattacccagtctgtggtattctgtaatagcagccagaaaacaaactaaga

SEQ ID NO: 538693 - DNA, 162 bp, Homo sapiens
  misc_feature (52)..(52): n is a, c, g, or t
  misc_feature (123)..(124): n is a, c, g, or t
ttctatttggaacttgatagtggacttcacctcatccacttgccaccatgtnttcgtggtgtgtgagcagggaagggaactttcctgccttattaaaacctgggccgaggattcgtggaatcnntgcttgatcagagactctgagtgccaaagaacgcatca

SEQ ID NO: 538694 - DNA, 125 bp, Homo sapiens
tagaagagaagaagaaggaggttcctagctgtgccaagaaacccttaaagaaaaagcgaaggaatttcgcagagctgaagatcaagcgccttagaaagaagttttcccaaaagaatgcttcgaaa

SEQ ID NO: 538695 - DNA, 1761 bp, Homo sapiens
  misc_feature (1487)..(1487): n is a, c, g, or t
  misc_feature (1599)..(1599): n is a, c, g, or t
gccgaagaggagctgggggaggacggtggccctgtgaggctcgctcgcagcacaatggcggcggcggattgtccgcgtaggcctaggcgagctgcctgtcggcgagactatgccggggagggctcttgtcgcgcgtgctggggcggcctggtggcttgcgagccttctcctccgcgttccctgtgagaggcgggtcgctcgtggaccatgctgcctgtgggaggcagacatgccacgaacgagtcaggagagggcatctcaagcaggcgatcattcgtacttcacttcgcacacctaacaagtgcttgaagtcgcgtgagagtggaagaccaagggtcgaggctccggcggtggtacttgggctggagggagagtggggtccggatagcacacaggaaggaaatggggggacaaattagctacctagttcgacatagagacaagatacattgtgcaagaaagctagggtgcctaaacttccgacgctaaggtgtaaggccaatcaaaggaggtttggagtcccaatatggggtccgtggagtgatttggggatttgacattgggccaagggaggggcataataacagcttaaaactcgaattggtacttggtataccacaaagacttttttggtggcattaaattggaaaacgtttggaacacggtttgtgagatttaggccaattgacaacatgttttctttggcccttttgaaacaaaaatttgaaggtcgcaaaaggggcgttaaagtgggttgaggacaacaacgctgaagaggaaatttgacggggtgggcactttgtggagcattttcgagaagatttgaatgcacaaggacggtgctattttaatttgcccacttagaacagatgggctttttggcggagcgaaaactctatctgttggagggctgccgtagggatgggacccaccagaagaggcagaaagagttagcctgtgacccgtaataggggcggaatgagcgttcatatgattatccacccgtggatgggcaaaaagacttgggacacttgtttttttaagagcccgttagaacgatataacggtcgttttgaaatatgatgcccaaacacttgacgatgtaacggcgctcctatggaggtggtttgtaaacacaaatttagaggagactcatgagggtgtggataggcattaggccgcatcacacacaaatgatgctttcaggcactgaagaaaagaacacgacgcagggaaggtataaacgcagaagagagggcacattttaattcgctgttgggctttcacagactcattaagaagcgaacagcgttcaattggcgaacgacacttgtgtccttatgtaatgattagggataaagaaagttaggattatatgtcgcgacgcccggttcctaatagtttgtggaagggagcgaattaccccaatataggaggtgataagaaatcaacacggagctctaggggggtgattatttaggggtggngttggagaaattaattgtggtagggcgggataattaagaagttaataaagttaatgcccagaagacggacaagctttgtgtttattatacagcgagggacagaacaaaatgngagctcaaatttgtgggacaactctggtgttaagtaaggggcgtccacagagcaaaagaatggagttttttggtgtcccccccataggggatggatgtgtattcttggacaaagagtagtctgtgtaggagagcatttgcttctctattatatgttttacac

SEQ ID NO: 538696 - DNA, 148 bp, Homo sapiens
tacatgatacaattcagcttgtacccgccatttccgggggtgtgcccactggaggccgcaggaatcctcgggtcggtttcgcgaatcagcaccccgcgatccagcagcccctggccacacggctgtggcggtccgtgaagcgcccgaa

SEQ ID NO: 538697 - DNA, 441 bp, Homo sapiens
ctcggggtgtcaggtaccaaaatggttttgaagttagggagctgctttctctcttcattcctgtgggtgccccaattctccataatatttgcagctgagaagtatgtctttttattcatttttaaattttcatttaagtgacaatcagttgggagcaaattaaatcctcccttaaggtgaaaaaaaaaaaaacaaacaaaaaccaccaaaaaacagaaacctcaaaccacttctgagtgacttcagactatctttcggctcctgaatgctgctttggcatacggttactatggtaacacactaaaatgatgcctatcataaagtaaggatggcccaatcggttgacaatctaatctaatctaatctaatcaagatgacccaatctaatgaccgtatgggatggcaggtacttctgaagtcagttaatagtaatactttaaa

SEQ ID NO: 538698 - DNA, 247 bp, Homo sapiens
gagatcatgccattatactccaacctgggcaacaagaacaaaattccgtctcaaaaaaaaaaaaaaaatcccaaaaccttaaaaagtctaccttggggtgactagaaccttcaaaaattatgccacggaaatagtggcactgctcttactagtgtacctctcatcatggcagcttatctaagtacgccgattgggctggattatctttcccaaggacccatttgcatggaagctcccttaaggtctg

SEQ ID NO: 538699 - DNA, 143 bp, Homo sapiens
ctcgtatcatgtgtcactcctcacacagagagcttcaaagaggtgggcattgagttcatggatctgtatagccagctcgttccagtatatgatgttgagcccctaggagaagataacgtgatgcttaccttgggacccagtac

SEQ ID NO: 538700 - DNA, 1417 bp, Homo sapiens
tgcggtggctcacgcctgtaatcccagctctcagggaggctaagaggcgggaggatagcttgagcccaggagttcgagacctgcctgtggccaatatagcgagaacccgtactccagaaacaaggaaccaaaaaaaaacaaagatgacaaaaaaaaaaaaaaaaaaaaaacaaacacaccacactatttcgcggcgcacgatcctgcgacccacctcagagcaaacagcccctgcacaacagccactatatcagtctgataggcacactacggagggcccccacgagaatagagcatcaacctgtacaccacacacttgtgcacacagcacgaggtgcacccctcagagggcaaaccccggtgacactcaacaccacagggtagctggggataccaccacccacggcacgtcatacaacaacacacgcgcaccgtgggtcggcacacacaccaagaccgcgacgtacacagaaaacaaccaacacacaaagagaagaaggcacactacggagaggcaccaaccaacagagggggcacacctaacacaaaaccagaggaataccacacagccgcagacaccccaccgaacacacaacacaatagaaagcgacccacgccacacgaggagggagtacacacagcacaaacaaaaacaaaagaagacgcaaaaaacaatagcaacaaaccaacacgagcacgacaacaaaagacaaaaagacaaaagcacacaaagaacgaaagacgcaaagacaacaccagcaaagaccagaaaaagaaagcacaaaagcataaaaaacaaaaagaaaaaacaaaggaggcaaagcgaaagatcaaagagaagcggagccagtgagaagaagaaagacaaggccgataccgcacggaaaatacgcacgacagatcaaccagagaataagaacgagaccagaagagaacgaagcgactaaaatacgcgacaagagggagcagagagatcagcgctgacgcagaaacgagaacatagcagcaggcaacacggacgtagaagataggtgcacaacagagaaggaggcgcgcgaaagagggatgataggtgggagacgggcagcggagaggcgagtacgacgggtcgagcagcagaaagaaagaagccgggccacgcaggcaggcacaaggggaagagacggaaaggaggcgatcggcagagaaagacgaagcaccaaggaacgagtcaccagaaagagcgagcggcaagaggaaagtagcaacctcgacaataaaaatcgaagaacatgaccaggcagagcagaagaagtgtgagaggacaggaggagtagtaccgatgagcagccgacacagacgaggcagacagagcaagagatagtgagaaggcaagaccgagcgagagagctaaggaggagtaggagatatgaacagc

SEQ ID NO: 538701 - DNA, 160 bp, Homo sapiens
  misc_feature (65)..(65): n is a, c, g, or t
cccgataggggctttttaactatattgaacattttttcctttgcctttggccctatggatagttncgatgccagattagatttatagcagccccaagttggattaaatgatattttgcttcctggaaaactattataaaataaagtttgttttttttcta

SEQ ID NO: 538702 - DNA, 157 bp, Homo sapiens
cgcagaggacgccagaggacaaggaggctgggcactggctaaatatcacccgagagctgatcaaggctcggggcagggactgggaccccaggatgaagcccagcggagcagaaaagctctgtgcacaggatgcagcaatcaagataataaaaatcaa

SEQ ID NO: 538703 - DNA, 150 bp, Homo sapiens
tacgaggtttttttttacaacgcttataagtactttttattgcagacattttcacagacaacgttagtgaaatcgagacccccccccatggttaagacatacattcctatcttatccaaacattcaagtaaccctgtgcgttttcatgtc

SEQ ID NO: 538704 - DNA, 842 bp, Homo sapiens
  misc_feature (260)..(260): n is a, c, g, or t
  misc_feature (524)..(524): n is a, c, g, or t
  misc_feature (540)..(540): n is a, c, g, or t
  misc_feature (545)..(545): n is a, c, g, or t
  misc_feature (562)..(562): n is a, c, g, or t
  misc_feature (571)..(571): n is a, c, g, or t
  misc_feature (575)..(575): n is a, c, g, or t
  misc_feature (586)..(586): n is a, c, g, or t
  misc_feature (592)..(592): n is a, c, g, or t
  misc_feature (595)..(595): n is a, c, g, or t
  misc_feature (598)..(598): n is a, c, g, or t
  misc_feature (600)..(600): n is a, c, g, or t
  misc_feature (610)..(610): n is a, c, g, or t
  misc_feature (612)..(612): n is a, c, g, or t
  misc_feature (615)..(615): n is a, c, g, or t
  misc_feature (620)..(620): n is a, c, g, or t
  misc_feature (625)..(625): n is a, c, g, or t
  misc_feature (638)..(640): n is a, c, g, or t
  misc_feature (651)..(651): n is a, c, g, or t
  misc_feature (661)..(661): n is a, c, g, or t
  misc_feature (663)..(663): n is a, c, g, or t
  misc_feature (667)..(667): n is a, c, g, or t
  misc_feature (670)..(670): n is a, c, g, or t
  misc_feature (672)..(672): n is a, c, g, or t
  misc_feature (679)..(679): n is a, c, g, or t
  misc_feature (686)..(687): n is a, c, g, or t
  misc_feature (689)..(689): n is a, c, g, or t
  misc_feature (696)..(696): n is a, c, g, or t
  misc_feature (711)..(711): n is a, c, g, or t
  misc_feature (719)..(719): n is a, c, g, or t
  misc_feature (725)..(725): n is a, c, g, or t
  misc_feature (728)..(728): n is a, c, g, or t
  misc_feature (733)..(733): n is a, c, g, or t
  misc_feature (736)..(736): n is a, c, g, or t
  misc_feature (746)..(746): n is a, c, g, or t
  misc_feature (750)..(750): n is a, c, g, or t
  misc_feature (756)..(756): n is a, c, g, or t
  misc_feature (841)..(842): n is a, c, g, or t
ggacccagaccatcaggattctgatgctccaaggcatttgatggcgctggacgaagtggcacagtcagctttccctgggggccggtgtcatgtgtggctcttgggatcgagcgcatggcctggcatttcacgcattgctgccaccccagatccacctgtctccactttcacagcctccaagtctgtggctcttcccttctgtcctccgagggcttgccttctctcgtgtccagtgaggtgctcagtgatcggcttaactnagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgcncaggggcaggcgatcnctcangatagccggtgaacccngataccagnagcnctgggccttcntgaacnccntgncntccagccatntnatnggccngcctncttcctggacctnnnggcccccagcnccttccccananagcnccnanaagggtncccaagnntnaccccantccaggacctaggcnagcccctnagcctnatntgganccncgaagaccancccncccacntttggggcttatataaaactgaacggggccccaatcctggggggggggcccggtcctgtccggggtccaccacccttttggggann

SEQ ID NO: 538705 - DNA, 612 bp, Homo sapiens
  misc_feature (260)..(260): n is a, c, g, or t
  misc_feature (524)..(524): n is a, c, g, or t
  misc_feature (540)..(540): n is a, c, g, or t
  misc_feature (545)..(545): n is a, c, g, or t
ggacccagaccatcaggattctgatgctccaaggcatttgatggcgctggacgaagtggcacagtcagctttccctgggggccggtgtcatgtgtggctcttgggatcgagcgcatggcctggcatttcacgcattgctgccaccccagatccacctgtctccactttcacagcctccaagtctgtggctcttcccttctgtcctccgagggcttgccttctctcgtgtccagtgaggtgctcagtgatcggcttaactnagagaagcccgccccctccccttctccgtctgtcccaagagggtctgctctgagcctgcgttcctaggtggctcggcctcagctgcctgggttgtggccgccctagcatcctgtatgcccacagctactggaatccccgctgctgctccaggccaagcttctggttgattaatgagggcatggggtggtccctcaagaccttcccctaccttttgtggaaccagtgatgcctcaaagacagtgtcccctccacagctgggtgcncaggggcaggcgatcnctcangatagccggtgaaccactatcttcacgagccagacctaagttcagaacacggcactaagtgtcaagc

SEQ ID NO: 538706 - DNA, 250 bp, Homo sapiens
  misc_feature (42)..(42): n is a, c, g, or t
  misc_feature (70)..(70): n is a, c, g, or t
  misc_feature (97)..(97): n is a, c, g, or t
  misc_feature (244)..(244): n is a, c, g, or t
agaagcctgagtttaaggacttagcgagagtttgccactgtnaggaattcagactttggttctgcctctnactctgtgtccctgaatcagttacttnagttccctgttcctcactttgtccagttgagaggcagtggcagccgagaacagggacacttgtcttctccatccttcatcaggcctaatgtggaaaggaagctctagcctttcccttttcctgccccactcctaggaaaagtcactnttgaca

SEQ ID NO: 538707 - DNA, 403 bp, Homo sapiens
gagggtattggcgattactgaagtagttcagaataagataaaacttgtctgtctctcacactatacaccagcataaaaagcaaatgaatctacaacaattacaaaaaattagccaggtgtggtggtgggtgcctgtggtcccagctactcgggaggctgaggcgggagagtcgcttggacctgggaggtggaggttgcagtgagccatcgcaccactgcactccagcctgggcgacagagtgagaccccatctcaaaaaaatgataataattgattctaaactggggaatagagagattcccaatttaaaatcttcacagtggttctcaaacgttagccaacaccagaatcaatagggctagttaaaacagattgctatgatctctaccacggtgctataacg

SEQ ID NO: 538708 - DNA, 135 bp, Homo sapiens
  misc_feature (20)..(20): n is a, c, g, or t
  misc_feature (67)..(67): n is a, c, g, or t
  misc_feature (89)..(89): n is a, c, g, or t
acggccaggccactgcaacngtgagagacccggggagcccctctgctatctcagccaggtggaaggngagacccaggccccgagccttnacccagccatcctctcccggcctcccatcccaaagccctggcccct

SEQ ID NO: 538709 - DNA, 168 bp, Homo sapiens
gaggttatataatagtgttagacaccccaccttcagcttgtacctgaaagcttatctcgataataaagtaagttcacatgtaatttaggggaagtatgtcctgatgctaaaaggatactcaaacctgacatccccaaggaaaatcatgtattagtattgctaaatgaa

SEQ ID NO: 538710 - DNA, 278 bp, Homo sapiens
tcctataacctaatgcatacaacagctctgataactgtacggatattgcgttgaacagaatttgggatggggaaacagaggaagatgtgaactttcaaccctggttaccgtgtggcttggggccgattattaggtgaatttatctaattcatcttcaagcttgtctaagggccaactccacagcagaccccagcagtccgaggagggtccaccaaggaaactcggggaggggttggctcccagcgggacggcggaacagggccaagaaggggaaacgc

SEQ ID NO: 538711 - DNA, 295 bp, Homo sapiens
cataataaagctatgaaaagttcctttggagacatcacgacatccaacataagcaccgcaacccaaacaaaggagagaaaacactctctgagcactaactattcacacaagtagtactatagcaccacgaagattccatcaagttgctctaccttcaccttaggttggtggtcatgcgcctagaattaaaaaagcctataagcttacgaatctggcattttccaggtaatacttttttttaatatagccttatagaatatatgtaataatttttcctcttagcaaacagaataca

SEQ ID NO: 538712 - DNA, 808 bp, Homo sapiens
gcttatactataccacatggcaggttctagtgatgcaccactcgatctactatttatgcaaataattgagtctgcaattcaccgaattgcagtaggtgcacgacaggatgatccatcctatacaggcttgggcagaaccagtatgcacagtattattcagcatcagcgtatggagcgtatatgacatcgaataacacagccgatggcgcacacctcttcaaggctctacttatcagtcgcaggaatgctctcccaggactgactaaccaaccaggtacaggatcttcaaccaggagagttgctgataccatgcagagtccctccacacccagtcaaaagatctggatgagagaacctgtaggagttctgggtcaaagtccagaggaagaggccggaaaaataatccctccccgctcctgatagtgacctggagcgtgtgtgagtacttgggatttggatgaaagcacttcatcgtttggttcactcactgctcaccgggtcttgaatgcacagaagtatggaaggatccccgctcgatggctgtaagccttggagctccgcatggaagaaatgatttgttaatcttgcggatactcattgtttgttaatgatttagaggagtgtgatcaagttcatatagatgatgtgtcctctgatgataatgggcaggacttaagtacctacagttttgcaattgatggttccatgcagtggaagtagtgcaacctttgtgtgcaacggtgtaagagagggttgactggatgaaggaagtgggttttgtaagaaagttagcatcttaactaagaaa

SEQ ID NO: 538713 - DNA, 136 bp, Homo sapiens
  misc_feature (92)..(92): n is a, c, g, or t
agcaccctgcaggcttcagtgaccaaggaagaatcagagaaagagcaacccgcgtggagacaaagaagcagctgtgcccctatgctgcagtngggagagtgccgataccggggagacactgtgtgtatctcccacg

SEQ ID NO: 538714 - DNA, 966 bp, Homo sapiens
  misc_feature (1)..(1): n is a, c, g, or t
  misc_feature (64)..(64): n is a, c, g, or t
  misc_feature (183)..(183): n is a, c, g, or t
  misc_feature (220)..(220): n is a, c, g, or t
  misc_feature (263)..(263): n is a, c, g, or t
  misc_feature (273)..(273): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (441)..(441): n is a, c, g, or t
  misc_feature (460)..(460): n is a, c, g, or t
  misc_feature (684)..(684): n is a, c, g, or t
  misc_feature (713)..(713): n is a, c, g, or t
  misc_feature (822)..(822): n is a, c, g, or t
  misc_feature (881)..(881): n is a, c, g, or t
  misc_feature (951)..(951): n is a, c, g, or t
ngacagggtccactttgcttttctcaataaatatgccatcctgcccacctaagacttgaaaggnaattatctgggggtgggattctaacaccagggtccacgaaggtgattctaaacagagccgcagccccagcgcctggtcaggggcagtccgccccaggggccggtggggtcagtcctgcngtgggatgaggttttccagtccacctgcagagcgcanaggaaggcagccgactcccggtagcccgcgatgagccgccgcncggcgctganctccgtggggctgagccgagcggtgggcacgggcctcccggngcnggtgcnggagggggtgggcgtgggggtggtggagggggtagaggccccgcctttcatgccgaggtccgtgggcccattactgtggtttcctgtttggagggaggcagggggctgcaggttgcngcccaaggccccgtacccncggtaactgtagtggaggccgccgtgggcgtacacagggtcctgggagttggaggaggctggcagtgagtgggtggagtgggttagggctgcggagtcccgcgagttccgcctgtccagggctatgggctcatcctgtgaggactgggagacctctagacgcatccgcttggctgcctttcttgtctcgctctcacaggcagccgccaggatgttttctgccanggccgaggtcagaaggggtggcgtgggtntggtcatctccatgccgttcttcttcatgcgacggcagggcttgagggacgtgcggatgcgctttcgggcccgcccctggaactcagggaactgccggctgcaggactngatgatggcctggatcttctccttgggctgcttggagaagggcacatggcggtccaggntctcgtccacaaagagacgcacaaacatgttgaaggcctttagacgctcagggtccatgccttcagagtngtccatcttgtcatt

SEQ ID NO: 538715 - DNA, 1320 bp, Homo sapiens
  misc_feature (421)..(421): n is a, c, g, or t
  misc_feature (494)..(494): n is a, c, g, or t
cctcgcgtccgcactataggcgaaggacgctaagatatctaccaggcgttttgagaggagatacacagggcagctatcgagaatggagtttaaacacgcataggtcagagctccgtggccaagtgttggggcgccaggcattaagtggcctctaggagtgcgaagtcatcgtcgatgtaagttattgtcggacattgtattatgatcgactatagagcagcttcagtcacaatggactcacaatacccagacaaggaaatgcaaggactagagcaatagtaatgggcctgctcatttttctatggatcctaccagatgggccgtaccatatagatagtgacaatacatgtcgtaagagagatacatgggcgataagcaggatacttgtggttgggtgagatgttagcgtgtataccctatncaactgcgatcctttgtcgagaggacatatgtcttgctggggaaatagcgtatccgtcgacataatagcattngtgcgcttgattgctatatggtttattgatagccaaagctgtatatgaccaacgaaaagaatcaccgtaggaatagtgcacagagttggtatggtgtctaactctaagtagtctgggcaccctagtagagctaagacgtacctacttggatactagtggccaatggtatcctaatggctagagctcccaaaggatggccatttcacaaggaggataattatacaataggcttttaaaaaggcattgcatatgggtcccagccaagcatcgtgcacccaggaggcatcgctattcgggtgctatgtgattggcgtggagatacggtttaggttgggatccctttaagttagtggagtcgccttttgtaggttggatgcccctttgtgttggccttcatttctaggtgggccgcctaccttttggttaaggcttgccaatggcttcacatgggttaattccctctttggtggcttttaattctaaggcgcctattgtttctacagccgagggggtgcgccacttggattggggcgactcggctggggccaacctttttcatgtttaacttattttctctttagacggcttctttgcaactaacgcgcccttaggagttaaaagcgctacaaagtcgtcgcaaagggggtaaaatgagcagttcgtgacatgtggagccactagctgggggccaaagaaccgcttctatgatacaagagttattcttataagccgacttcgggggtgagacgcgagttgagacactacacgttatgccccagtatacgcgccgttgttgacaaagtattacacttctataacaccgacc

SEQ ID NO: 538716 - DNA, 1646 bp, Homo sapiens
ggatccagtgtctgacggtgcataataaacggcggctagatcctacatttactctgggagccatcggactggacacagttaacttactgggaattcagatgactgggggagaaatcgaggtccttcgactggtgaataggccaccagcgaaccaggtgatccacggagtgaccgtgcgattgagttcgggggctagtctcactcgagctgcatgtcaatgggacgatcagccgttgccggttacaaccatgcacctcagttgctgcgagtgacgtacagacggtacacaggtacgtttgtcgataacgtgggaccgttcaagccagaaagtgtcgtagcacagtcggtcccccggggagataacggcctgttgagtctgattgtgcgattaggcacacggagttgtccgtgcatgcaaaggtgtccaggaagtgaaagtgcatctctaggtggatctgaccaaaactccctgggtctacgaagctcccgcagagcttgctggcaatgtagcaaacgccctcgagacgtgcgtgaacaaaccgtggtgcgtcctagatttgcgtgggtggttggcttggggaatcgggggcgtaaacccgttttccctggagttcctcgcctaagtttgccacgagttcccctttggggggtccaacccgatccgcgccatggcagatggggacttggacagcgggcccacaatgccctaccctttcagggaggttgccaccaatacggggggagcgcccccacggaattgatagcctcggagccagcgttaggggccacccttagaactatacgcgccaaacagggagaaccgagggcggaccccctttaacccattgccggccttgcggattgtgtatggcatggaaacccggcctctagaaggcggagcactgtggattgcggggatccaacgcccaagagggtagcgtgtacacacgggacgggaatatagggccactcgaacacacgcggggcgttaaaccattgccgggtgtagagacaacaaccaaagattcgaggtctacccaacttcaaatggatggggactccatacgcacaagttgttgtccaggacacacaagagttccggttaccgtcagggccatggggtgtcgccttggcggatgccgccccaaggcagcttcagtttgaaaacccgaggtttattaagaccactttccacgaggttgaggccaatttgtggaacacatctcagattgagggtgggtcattgtgatttggggaacgccccttggaaatgttagacacccgggggaccaacagcacaagcaaaggtcacaaggaaatcaccaaaggaaatgtcacaaaccacgagcattgtcgacgccatgggctacacgacagagcccgtggacacctgggctatgggaaacacgaagacaaacagagctgtagggtcgagaggcacactaccccctagggtatagacctctccttggagcaaaggggaagtggggcacaaccacatcatacgaggaagggggagagccgccccacgcaccgcgatatcagaaaatgagaacaataccagaagccaaagacgaaaaagaaggaggggacaagatacgatagaggcaatacaaggggaaacggacaccacaggcgcgccagaa

SEQ ID NO: 538717 - DNA, 400 bp, Homo sapiens
tgagatggagtcttgcactccagcctgggcgacagagcgagactccttctcaaaaagaacaaaacaacaaaacaaacaaacaggattttcctaacctctttctgacctgatttaaggtctctctggtaactatcatagcctaaactgctgtattctgggacttaccattagagcttcccaaggcaatctggagaattaaaaaggaaagtaaagtgcttgtagtaactagaagaatctgtatatcaaaattccatttaactattaaaacttaaagtaaaattatggttacatgttcaaaattaaacctgaatacttcagtgaaaaaaataaacatttctttttgagggaatactttaggaaaggtttcttcttcagaagaaattatcaaaaacaaattctc

SEQ ID NO: 538718 - DNA, 137 bp, Homo sapiens
acctcaccttctcatcaagagggtctttggcttcaggatcaacccttccctcaccttctctcaccactctctagaagcttctttccggtaccttccttcagctttcttcttggctctcaacattctctggctatatt

SEQ ID NO: 538719 - DNA, 369 bp, Homo sapiens
gccgagtgcaccaacctggcaccagcagcgccgttggcccagaagccctaacagcgggcggaggccaagacgccatcaggctgggcctgggggaaaccacaactactgcaagaaacccaggaatcgaagactcaaagcccttggtgctacgtcttttaaggcgggggaagtacagctccagagttcttgcagcaccccctagcttgctctgagggacacagtgactgctactatagggacatgggtcacgcctaccgtgggcacgcacagcctacaccgagtcgggatgctcctgactacccgtgaattccatgatcctgatagggcacggttacacagcacagaacccagggccaggcctgggctagg

SEQ ID NO: 538720 - DNA, 326 bp, Homo sapiens
ctggccctctgtgcttccgactcgccgcttgcgagctggagggacagtcacctcgacctggtgggctgggtgggtctggctgtgctgtgggctgtgcctcactcctgcaagtgggcactcagcggggttggggtcacgaggctgaggtcggcttaaagcaggagtgggcagttggcacatcatgtttctcctgcatcagggctgtggcaggaatgccgggtgactaccgtagacacttgtcaaggttgaggttcagagaaaggtgtggggtatcccggaggtcaccacagtgtgccaggaggttcaggttggccttccagagcccg

SEQ ID NO: 538721 - DNA, 358 bp, Homo sapiens
  misc_feature (34)..(34): n is a, c, g, or t
  misc_feature (103)..(103): n is a, c, g, or t
  misc_feature (113)..(113): n is a, c, g, or t
  misc_feature (172)..(172): n is a, c, g, or t
ggtcgaccgaatttaaatttaccagctgtaacanaccatccagctcagagtctgttaaaacaaattgcaggccgggcgtggtggctcacacctgtaatcctancactttgggnggctgaggtgggcagatcacttgaggccaggagttcaagaccagcctggccaacatggngaaaccctgtctctactaaaaatacaaaaattagccgggtgtggtggtgggtgcctataataccagctactcaggaggctgaggcaggagttttgctcttttgcccaggctggagtgaagtggcatgatttcagctcactgcaacctccaccccccagggcccaagtgattctccgtcgacgcggc

SEQ ID NO: 538722 - DNA, 81 bp, Homo sapiens
  misc_feature (66)..(66): n is a, c, g, or t
  misc_feature (73)..(73): n is a, c, g, or t
tttaatatacaaacttttattcaaagttaattcaagaaagacatgttttggtcatttttaaagtgngattaantgaagatc

SEQ ID NO: 538723 - DNA, 120 bp, Homo sapiens
  misc_feature (9)..(9): n is a, c, g, or t
  misc_feature (45)..(45): n is a, c, g, or t
  misc_feature (76)..(76): n is a, c, g, or t
  misc_feature (86)..(86): n is a, c, g, or t
cattagacncctacactagagttagataacgttttctcacattgngtttagaagatctgccttgtcagggaagccnaggttttgtntgtgagagtttaaatctgatgtgaagctccaaaa

SEQ ID NO: 538724 - DNA, 890 bp, Homo sapiens
ggtgctctccgtattctttatgataatgaccagtcatcatgtgacaaactagaccacgtggattgatgaaccaactaatggaagtacccatgagacgatgactctagcgaggcgtcaactcaccaactcttgtgcatgtagatgtgtcttagtcgtccgtctagactggccaggttctgcccatctcaagctccatggtgcatgagaatccgtggcgtcgcagtctgggatctcaacgaagtgggtcgaccatatcaaaacgcgtgcatgtatgctgtgggccatataccacctgggagtgtgcgtggagtgtaggccatgtctcctcgatgacatagcggacagcattgttctctgtgaatctcagagaatacaaagaccagtcgaaagcatagtgcgatactacacctgtggatgatgatgcagagactatctacatgtgccagtgagtgcagaagcgcacctcagcatgtgagagcttgctcatgtgatgatcgcaggacattcgttcgaccccatatcgatgacagcgacacgcactctcttcagtctgttctccctgttaggctaggagaacaatgcgtaggtcgaacgcgctacttggaaaccctgtgctttaacttagccaatgcatgaaggaccaaacgcgaacaatttgtgcccacaacaaggcctatcgtgacacagtggttagaactgtcgtctcgcaggcattggactcctctcttgtgactttcttggagggcaagtgattggcccatgggccagtgtatcatgtgggattctcaaaacgaaaggggccaaacgatgcattataccgaacgacttagatatgggataggaggaccatccatcaaactgaccccttgatgctttcagggcccttaccc

SEQ ID NO: 538725 - DNA, 363 bp, Homo sapiens
  misc_feature (36)..(36): n is a, c, g, or t
  misc_feature (168)..(168): n is a, c, g, or t
  misc_feature (175)..(175): n is a, c, g, or t
  misc_feature (203)..(203): n is a, c, g, or t
ggtcgacttgaaaaactctccgccaagacgaagagnttttgactgttaaaattagaacttatttacctggtttagtagcaaccgtaatcttgccgtcgatgatttgcgtacgagctttttgtacggcttgcatgccttgcgggcccttagtgatggaaaccccatcgntctttanaccataaacgaggtgcttgccgccaggnaatttgcctttgtaagcattatcagcgatgctcttagtagcaacgttcaagccttttaagacagaagtcaaagtgaagttggctttagtgccacctttggcggtgtaattaccaagacttgcttgattaacgtcaacaccgattacccagaccttcgtcg

SEQ ID NO: 538726 - DNA, 483 bp, Homo sapiens
agctctaagatccgcgtggtctgcaatcaggtcacatctggaagacatcttagactctgaagtgatctcagcattaacttcgggctttcaattccttcaggtcttcaagctcaatctgagcatatatctattttgtgcagaaatgtcacattcgctttgacagggtcacatcaaatctggccctctccttgaggctggcatgctaaaatttggggcatttaatctttggatcttcaagtttcagtcaggaccctgcatttcaacatctggggcactgacatctacttttgggcctttcaggtccccttccagctttggcactgtcatatcatattctccctttactttaggacctttcatatgcaagtccacatcaggcatggagatcttgggggccttgatattcatctctggcatcttgaacttgggccctttcaactttccctctggtccttcaatgttaacatcagggccttcaacgtc

SEQ ID NO: 538727 - DNA, 398 bp, Homo sapiens
atatgtagatgcgtccagccatgcatgcgaccactagccatggcacacagtcccagtcccggataatcagctgggtctgtctggtatcagcagaggttctgccccagaagagttgctcgaagatgtcctcacagctgtcccaatgcatcatggcatagtgttcatactcatatgtcagggagttgccgtgtcactcttcctgactgggctggtactggaattggtacttacagtactgtttccccatgaagaagtatacccgctattgagcatatgtagctatgggcagggaggtgacaaggttgtatactcgttgtactggatgccatgggagccgtcaaagatatttatattgtaatcatggttcagggcaccatcctctaagcgccagatgtgac

SEQ ID NO: 538728 - DNA, 337 bp, Homo sapiens
  misc_feature (26)..(26): n is a, c, g, or t
  misc_feature (47)..(47): n is a, c, g, or t
  misc_feature (83)..(84): n is a, c, g, or t
  misc_feature (90)..(90): n is a, c, g, or t
  misc_feature (94)..(94): n is a, c, g, or t
  misc_feature (101)..(101): n is a, c, g, or t
  misc_feature (105)..(105): n is a, c, g, or t
  misc_feature (148)..(148): n is a, c, g, or t
  misc_feature (167)..(167): n is a, c, g, or t
  misc_feature (241)..(242): n is a, c, g, or t
  misc_feature (248)..(248): n is a, c, g, or t
  misc_feature (271)..(271): n is a, c, g, or t
  misc_feature (287)..(287): n is a, c, g, or t
ctgatcattcccagtgaccccttctnggtgccactactgaggaggantacttgcactttggggagaaggctgactctcagagnngaaggngggngtacatnaacncactactaaagcggaaggggctttatgtggaagaaaagattgnggagcatgcagaaaagcanaggacactcagcaaaaataagtagctacctactactggtggattcttttccttatagtgaatttaaaagtacannaggggntaatattgggaaatttctttttnccacattatctctgtntattcactttcaataaaggtgatccatataaatattttaaagaggatgtt

SEQ ID NO: 538729 - DNA, 170 bp, Homo sapiens
  misc_feature (39)..(39): n is a, c, g, or t
  misc_feature (48)..(48): n is a, c, g, or t
  misc_feature (102)..(102): n is a, c, g, or t
  misc_feature (120)..(120): n is a, c, g, or t
  misc_feature (129)..(131): n is a, c, g, or t
  misc_feature (134)..(134): n is a, c, g, or t
  misc_feature (137)..(138): n is a, c, g, or t
  misc_feature (142)..(142): n is a, c, g, or t
  misc_feature (145)..(146): n is a, c, g, or t
tgcaccttgatgctgtggtcgtatctagagtatccccgngcatacctngaccttctggcataccttgaccttctggcataccttgaccttctggcatacctngaccttctggcatacctngaccttctnnnatnccnnaagngtnnaggtatgccagatggcccaggtat

SEQ ID NO: 538730 - DNA, 371 bp, Homo sapiens
ccaccggcaggttgtactcacacttaactcatgttaagaagaagtgtcaaggattgttaaaacatattttgaactacaagtgcaaaatgtaccagaatatgtgagatgcagtaaaagcagtgtttagagggaaatttatatcattaaatgcatatattagaaaagaagaaccacttgaaaatcaatacactactatactctttttttagcaggatctaaagaaagaaagcaccattcaaccctgaagcaaatagaaaactgaacgctgtacacataaacctaagaaattgagcactgaagaaagaaggcattcaagatcaagatcacgttctaggaggaggaggactccctcatcttctagacacaggcgg

SEQ ID NO: 538731 - DNA, 380 bp, Homo sapiens
aaaaggaaaatttttccccccccccaaaaaaatttttggcccccccccccccccgcggtttttttaaaaatttggtgggggggaaggggcccaaaaacccaaacccccccccccccctttttggccccccccccccctttggtggggggtttaaaccccccccggggggaagggttttccccccccctaagggttttgttttttgggcccccccccccggttgtgtttgttttttataaaaattttggggggggggttttccccccccccgcggggcccccccccccccccccacgggagggttttttttttggggggggggccccccccccccccggggggttttttgtgtttggggggaaaaattttttttgggggta

SEQ ID NO: 538732 - DNA, 896 bp, Homo sapiens
  misc_feature (287)..(288): n is a, c, g, or t
agcgggagagcgaaagtaagtcagaacctcccaaggatggataagcaaaatggcgccggaggcccaagtggaggaggctggaactgacgccgtgatctggcttcaatggagcatgtgcgccatctggtgctcagagatgccgatcctgaccaggagcatatgatttatcctcgttggttgcacgagatcctcatgcaggcaataaagtgacgtaaatgagcgagagagcttcctgacaggggtcatgcgcaacaagccgtcgtcctgcattgtgccatcatccgagnngtctggaggagtacatgcgccgtccaggacaagtcgacattcagtggggttcaaggtagacatcgattgtggtgggattataagaacagagagctgctgtgctcggctgtaccctgtcatcaaaggcaaagattgaagctctggcctgtttgctccaaagtgactttgtactgtggatatcactaggaggccgcgagatgacggaagtgtggtggtgtggagcatagccaagagagatgccatactgtggcaggccgtgcagctcggcctcaagtgttggcaatgccaccaatgtgatcttctccaggtgccgggatgagatgtttatgactgccatggaagtgggacaattcgagtatgggaattggatcttccagattgaaaaatctgggcaacgtgagagccaaactgggacagttgagaagaatagtcatgagtattggagtggatgatgactgatagccttatgctagccttggaagcaagcaatggagatgtgctgaaaaatgaagcgccaggacgtaaacgtggtgacagatggttgggcctgcggaacggacaaattgcaggttggggagtgtcaggtatcatgtggctgaaaatggggg

SEQ ID NO: 538733 - DNA, 544 bp, Homo sapiens
  misc_feature (336)..(336): n is a, c, g, or t
  misc_feature (544)..(544): n is a, c, g, or t
gactgcagctgctgctgcctgctggttgccgcgtcttcccggaggcgactgctggaagctgcagggaacagctgcggtgctctgccatattgtgtcttccccggccggtccctcgcctcccggccgagctgacgatatacacttcagataactacaccgaggaaatgggctcaggggactatgactccatgaaggaaccctgtttccgtgaagaaaatgctaattcaattctcctgcccaccatctatccatcatcttcttaatggcatgtgggcaatggatggtcatcctggtcagggttaccagaagaaatgagaagcatgacggacaatacangctgcactgtcatggccgactcctcttgtcatcacgttccctctggggcattgatgccgtggcaaatggtatttgggaattcctatgcaaagcagtccatgtcatctacacagtcaaacttctgcagtgtctcatcctggccttcatcatctgggacgctaactgggccatgttccaggccaacaacatcagaggccaggctgttggn

SEQ ID NO: 538734 - DNA, 261 bp, Homo sapiens
ggcatacaaggtacagcagcagtatatgggcaagcatataaaattgagtatctctccaagccatgttagagcaaaagatgaaattccagaaaatagagataccatcaaaaaggggctgaaatacagggaagcacagcagcattgtccctcagatgtaatgcatacatatctgtgcaattacaggcgtccttgggcctctcccacatgtgctcgacagcaatgcaggcaggggcaactttccccagggaaaagctcccttta

SEQ ID NO: 538735 - DNA, 791 bp, Homo sapiens
agcggacggctcgcctcgagcttctgcaacgggtcctctctatctagctccagacttctcgcctgcgccccagtccccgtcgtcccgcgtcctagtccgaccatggccgggcccctgcgcgccacgtctgactccttgctggtcatcctggccggtggtccgtggaatgtgagccgccgacgggctggcgtccagtcccgggcgaagtcgcgcgcgccgtggtggtgacgtgtcccattggatgccaggcgtggaagacgcgagtgcctgtgcgggatgcacttggacttttgccgtcaggatgggtacaacgaaagccaagcgaacagacatgttaccaacagctcggcgctgctgaaaggctggtgcgtcgacccggcaagcagagtcgtagctgggggtgaactagatcttggaccagtggagctggtgccgaaacacagtgtaccaagaaccagtcccaattaggacaatgtgcacccttgtccatgacacaagccagcgatctgaacaaggggaaagcattctgcctcttaccagatctacgactgtgcctttggcagggggcacgattgaacctggtctgataatacaaccatggtcagggaaccgccgtaagagaggatctggtacccggggtctgtgccttgtgacgctaattaagacatacttaagtgcaaaactatcacaaaacacaacaagagtatccatgaaaaacagagaaaattgatggacagatgacaatagagagaatggatcaccagaagaagcatagaacaaggaaacaaaac

SEQ ID NO: 538736 - DNA, 615 bp, Homo sapiens
caccctaaccctggacaatgtgagtgttgagatagttattagaaatggatgatttaggccacgctgaggtcagcataaactaccatagtaacttgctgccaagaatccacggcctcagtaggaggtgccccggaacgagctacgtagaacttgtgatgagtgtacatgactatgctgagctatgtacaaggctcctgtggcagatgccatctctattgcccagtggaacactggatggtgatcccaacactctcgctcgtgcaacattcaaatgcgagctggttgtactccacagcatcatcttcattcaaagagtcaaagttgatgagctcaggccggaagacggtggatgatggcacacagggccaacccactgcgccaaggatgtggtcaggtacggagacgtagacatgctggtaagccctctgtatgctgctggaaccaggacatggagcttgctgaggcggatatctgactccttcctgtagagtttacagatatcctcaccgaacccagtctctcgagagggtagtgcaccagatacttagtgataacaaaatgcttacctgatgggggctgaaacagtgtagataagggtaaaggccccggggtacg

SEQ ID NO: 538737 - DNA, 1197 bp, Homo sapiens
cacaccgggctttccttaacctcgcgtgttcccttatgtattacccgtgcattccactgtatgtcactcgggatctctttcggtgcatctctattgtgcacacatattggttaatatgtcatctgttgtccctgatctataggccacttcccggctgggctctcacgtggcacttggctacaggttttgaactgccgtgtgctgctttccgaagtggccccatacctcttgtctacactttcaacgcatattgtcaacttctttcctctcccatctcgatcctgctctatagttcctagggcatcatcgctatggggcttgcactatgccacccgtcccaccgtggtcaattccaacaattgtggatggtcaatcctgtgcctactcttggttgctgcagctaatgagcctcggagacctaaggcccctagggcaccgtatccgcgagtgagcactatcacagatggtagacatcctcgtgaccgaggcatctgccacttgtctcagaagccagctatggctacagatctcgaggcggcatctcatagatgtcggacactgggggaccttggtgtctgcgcactacacgccaccgtagacctctccccatcatcgagcacagtcgtctccatctaaagtcccaggggtaacacaggtcccagatgacatccctttgaccacatcgctctaggacaactggcacccagagaaaaggactccgtcagtaaaaacatggccccgcatgctgcactctccctcgggacaaccaacgacgtcgtagtaactgcaccacccaccaccaagacacacacacacaaacagaaacagcaatcaaaacacgagaaagcagagaaatctaccaagaacagacgtctcaggactagaaccactgagtcttttggaggctcacaagcctgcaaagtgccacgcagagcccaccattgaggcttttgctagttggttctgttttgcgttttacagaccgtgtggggaatagcacaagtaatcccgccacgagggcccactagcatccactgattggaccttatggtcacccaactcaaggacagccactcaagaagtggctcggccaaagagaactgggcgcagtggctcatgcccataatcccagcactttgggagatggaggcgggaaatcatttgaggtcagaagttatacgccagcgggacacatag

SEQ ID NO: 538738 - DNA, 725 bp, Homo sapiens
tggtcaaccgtgagcatggtgtgatccatggatgccgaggaatgtgacgggctgggagtgtgtgtgcacctgccagggcgtcatgctgtgccgtgatcgggattgggatcgaggaggaagatcggaagcatacctggatggaggatgcttgagatgttgtgtagcccacaattgccctggagttgttgcactggagccatctactgcctactgccctgcatggtgttccccagcaagaagagtgttggttggctgcgcgccgcgtacttcgaggaagaaccatggcactctgggagtccctggaagcactcctgcagaagggctgtggccacctgcccaaagcagaggtgcttgtggctcatgggcgccaagtccaatgtgggctgtgcagggtgatgtgcctgcagcaaggagcatcctgggccctggccttccaggccaaaccccaacagtgaggagatctggctggccagccgtgaaatgctggagtccgagaatgatgagtacgagcggtggccctggaaggcttgcttgggccaagggcgctggaagcatttgcacccagctgtcccgggtgtcatgaacgtcctgtgaagctggagtgggtgcaagacaacattcaggacagccaagtatctgtgcgcatgaggcctgcggcgcctatgaggacttccccaactgtggctgatgagggtgcacatcgagtaggcacacggcacatcatg

SEQ ID NO: 538739 - DNA, 220 bp, Homo sapiens
cccccccttttgcccccggaattttaaaaggcccccggggtttgggtttttaaaaaaaaaaggttccccaaattccttttcccccccccccccccctttaaaaaggggggggggggggaaggggctttttttaccccaaaatttttttaaagcccgggggggcccttttttttttttttccccggggggccccccaaaaaaaattttttccctttgggga

SEQ ID NO: 538740 - DNA, 1102 bp, Homo sapiens
tccccccccccccctcccaccaacaatcgagagagcaggagagccagtgactcgcagggggggacgctaagcatcgtagaggttttatagctggatagtgtggttgtaggtgtatgtcgatgtactcagagcatatatcttttctggctttgggagatagtgtttttctcctcccggtgagtggtgcctgttctggagaaaagtttgctgcaccgtttgagagagtgttcgccgcctctcctttttatctcctcagatgggggcaactctttctggaaataaaatcgggggggttgttgcccggctaatattgttgtgtttgaaagatgtgtgggtcttaaaacaaataattttgccccgggtcttttcttttgaaacaaggggtgtttaacccccgacgtggggtgtttcaaaagctcccctgtgtaaatcccctgcccccccgggtgggaaccttgtcgccataaagttaacacgcgtctgtacacgccgcttttgtccttacccctcgtccgcatattgtgagagacaacctatatctggggagagttctgaaagggggcaagacccccttcttgggtgagaaatataaaaatcctgttgactactggtgagaaccctctgtgatagaccccactcggttcgctccgcgagagagggcccgtagaattaataacgagctcaatagagcagaatattgcgagtgaatctatacacatacacgatcagcacactcaacctctcttcgttaagagagtacaaagagcgcatagaacatgcttgaccaccgtgcgtaagttagggtggaccacgcagacgtgataataatgggccccctcgctctgggctaccccacaaggcaacaaggggcccaacatttctccctcccctctagaagtaaaaagtgtgagaaataagaggaaccaccacgagatatatgaaataagaatattattcccgaatctttcaagaagagaaaatgaacactcactgcgtttccacctattgtggcggacatacaaagaaagaagcagaaaaaacatatagacgcccccaactttgcggagtaaataaaagccgcctcgtcaatagtacagaaaat

SEQ ID NO: 538741 - DNA, 161 bp, Homo sapiens
tccccaaggcaacagggaagaccgtcagtttctcccaggcccacgtcaagcctggcataatgtcagaccctgcttgggatagggaatgtgaccaggggtgctcctgtggtcaccctgtcttggtgcatgattttggaagaataaaattgcctgtctcttta

SEQ ID NO: 538742 - DNA, 541 bp, Homo sapiens
gaggatcaccgacgtggttatacctacacccctgagctctcaggcctggcaccatgctgctgtcctcagagtgtcatcagtctcttctagcccatgtctcaggcccctggccagcttgctgctgtccctcagagtgtcatcttgtcgtcttctagcccacgggagggatgcaggtctccgttttctggaaaacgctcgtctccttctagggaagggggaattttgaggtagctactacagttgacatgttctgttctaattttagaactactctatgtcttagggatgttagtggcaggggtagtttcgacgtccagtgaaccggctgtcatctctagctcatgctgactttggcctttcatccattcctctcattcagaataaatttacccagctccctctgctacagagacaaacatggacttgatactctcttaactgaaatacaaatattcccaaagtcaatgctttagttggcccagtcttggtacctcagtgcctctccctactagtacagttgtgctggtctagtgaaagtacg

SEQ ID NO: 538743 - DNA, 426 bp, Homo sapiens
  misc_feature (297)..(297): n is a, c, g, or t
  misc_feature (404)..(404): n is a, c, g, or t
  misc_feature (410)..(410): n is a, c, g, or t
gggatttaatgtttaatggttacagagtctcaacttgagaaatgacaattgttctaaggatagatgctggcaatggttacataacagtgtgaatgtacttaatgctgctgaactgtgtacttaaaaatggctgagatggtagattttatgtacattgcagtggctcatgcctataaccccagcacttagagaggcagagatgggaggacagctcgagcccagggaactcaggaccagcctgggcagcaaagtgtggagaccccgttctccacaaaaggaaaacgttttgttgggaantttttttaaaaccatgttttttaaattttgaaaacaaaatcccaaaacaatgccaaaggcccacttttgaacacggcagcctgaggttctccattaggaaacccagnccgggnagtggctttattttcc

SEQ ID NO: 538744 - DNA, 161 bp, Homo sapiens
cactctagagttatccccggccactctagtgacagataacctcttaccaacaaccacaccccaggaagctcagcagtggttgcatcgaaatcgtttttctacgttgacaaggcttttcacaaacttctcaggggcagatttattgaaattaactagagtgg

SEQ ID NO: 538745 - DNA, 330 bp, Homo sapiens
tgacctggtctctagcactttgggaggtgggtggattgcttgagcccaggagtcaaaaccagccttgtgcaacatggtgaatggcaacatggtgaaatcccagctctacaaaaaataccaaaaaaaaaatttagccaggcatggtggcagcatgcctgtagtcccagctatttgggaggctgaggtgggaggatcacctgagcccaggaagggaggctgcagtgagtcgtgactgcaccactgtacttcaggccgtgggtgacgggatgagaccccgtctcaaaaaagcagagaaagctgaaagggttagagactcagcaaatgttacta

SEQ ID NO: 538746 - DNA, 127 bp, Homo sapiens
tacttctgttacatgttttctcgtacattctacttatgagacttatacgcaccaccctcaggacccaaatgccatttttctgtcccatatcttcctgtgatctgccatcagtggctcttttttcctg

SEQ ID NO: 538747 - DNA, 105 bp, Homo sapiens
agtccgttaggggctcctctttgcagagcacaggcagtaacctgaaactctgggtaggactagctattcctccgcccattggagacataaaagtagacctggact

SEQ ID NO: 538748 - DNA, 180 bp, Homo sapiens
caatttttttttcccccgggggggaaaaaaaaaaaagcccccccctttttgtaagggggggattttggccccccggggggccccctcccccgggtttttttaaaaattaaattagggggttccccccgtttttttttttagggggggggggttttaaccgggcccggtttccctttttta

SEQ ID NO: 538749 - DNA, 886 bp, Homo sapiens
  misc_feature (36)..(36): n is a, c, g, or t
  misc_feature (154)..(154): n is a, c, g, or t
  misc_feature (186)..(186): n is a, c, g, or t
  misc_feature (246)..(246): n is a, c, g, or t
  misc_feature (251)..(251): n is a, c, g, or t
  misc_feature (263)..(263): n is a, c, g, or t
  misc_feature (265)..(265): n is a, c, g, or t
  misc_feature (269)..(269): n is a, c, g, or t
  misc_feature (280)..(280): n is a, c, g, or t
  misc_feature (352)..(352): n is a, c, g, or t
  misc_feature (373)..(373): n is a, c, g, or t
  misc_feature (377)..(377): n is a, c, g, or t
  misc_feature (394)..(394): n is a, c, g, or t
  misc_feature (527)..(527): n is a, c, g, or t
  misc_feature (557)..(557): n is a, c, g, or t
  misc_feature (566)..(566): n is a, c, g, or t
  misc_feature (581)..(581): n is a, c, g, or t
  misc_feature (590)..(590): n is a, c, g, or t
  misc_feature (606)..(606): n is a, c, g, or t
  misc_feature (620)..(620): n is a, c, g, or t
  misc_feature (630)..(630): n is a, c, g, or t
  misc_feature (632)..(632): n is a, c, g, or t
  misc_feature (678)..(678): n is a, c, g, or t
  misc_feature (691)..(691): n is a, c, g, or t
  misc_feature (706)..(706): n is a, c, g, or t
  misc_feature (737)..(737): n is a, c, g, or t
  misc_feature (751)..(751): n is a, c, g, or t
  misc_feature (764)..(764): n is a, c, g, or t
  misc_feature (779)..(779): n is a, c, g, or t
  misc_feature (789)..(789): n is a, c, g, or t
  misc_feature (823)..(823): n is a, c, g, or t
  misc_feature (857)..(857): n is a, c, g, or t
aggtcacaggtcaagtcattcacaagtccccactangaggggtggcagggacagggctgggaggtgagctgcggcgctagtcaccaaagtggggggcccaagggaggagcaatgtcatcctttacccatctttggatggtctgtatggggcctnggaatgtggaccagccccgcctgggccccagngcagggcacgaagccccacaaaggtctcgtgctcgccacaggagcgtatgtggcaacagngccanaggcaggcccanangggngggtggacggnactgcagcgggctggcttcatggccttctatgtacggttcgtctgcggcccatccagctagatctcgtcatngtcgtcttcggtgggtgcttnaggnggtggctccgggcaggnggctggcgtcatcatgctcccatgaggtcactcgcagcgactgcgcgctctgtggtgctgggtcaccatggtctctttcccgcacaggaggcgcacggtggtggagcggttggggccctgccagcagcccgtncctttctcatacttcatggcactgaacttntcgtggtcngggccaatccatganccccaggtnccaaggctggtggganaccccccgagtttnggtttctgcnanacaagcttgaaggggcagaggcggtagacgtattcgttggtggtgngctcgtagcactngctgtacaggtaagnaaactccccgttggggccaaagtcaaaaganatctcttgctccangttcctgatggantcctccatgtccttnagcgaccgcncggcctcctcgaacttgttgcgggcctcctgggnagcatcgatgaaggcctgcgtctgctcgtcgtanggcggcattttgtcttcctcagcagggct

SEQ ID NO: 538750 - DNA, 919 bp, Homo sapiens
gtctcaaaaaaaaaaaaaagaaaaaaagaaaaaaaaattattacagcctgagctgaatcagtgtaacttccagggaggagcacttgaactaggcctacagaataaccaggatgaaatgaacttgtgagcccaagcttcagaaatgaaacaaaagtagctgaagtgttgtggaaccgtaccaatgaatgtggctattggtttggcttctaccaaacatggtgacctggggcaaagtcccttgacttctctgagtccatttcctctcctgtaaattagaatttgaataccaccaattacaccaggccattgtgaagaaaaataatattacttgattatgccttatcaactataaaacggtatctacactttacggtttataactagtatctccatgttatttctcactgaacacaactgattatttgcagagcaaattccttttaaaattccctgacctatggttagatgtgactaacttactttagaactttgacgacccctggttgtgtgagttctctcataaaatgttgccccggggcctgggacaaatatctggattcaccatacactttgcggactcactcactaactgaattttcacactgaataactgtcagctacaggttttccatgtttggtcattgcgcctgcctaaggagaccgatgttcaccccttgctgtgtcaccacatctgcggttttttaacctgcaggtcgctcacccagggaaatggaatatgcgctctaattaacatcttggggtagcccagatatattaatatcccaaaagcgctaatcaaaaagataaccggcgtctgacaacaacgggggcggacaatcacccgtaatataacagcgtggtcaaaaaatggcggccaaggggggagtgtgtacccactcatcgaatgtctaggaaaaga

SEQ ID NO: 538751 - DNA, 257 bp, Homo sapiens
  misc_feature (21)..(21): n is a, c, g, or t
  misc_feature (28)..(28): n is a, c, g, or t
  misc_feature (30)..(31): n is a, c, g, or t
  misc_feature (36)..(36): n is a, c, g, or t
  misc_feature (38)..(38): n is a, c, g, or t
  misc_feature (78)..(78): n is a, c, g, or t
  misc_feature (107)..(107): n is a, c, g, or t
  misc_feature (110)..(111): n is a, c, g, or t
  misc_feature (127)..(127): n is a, c, g, or t
  misc_feature (134)..(134): n is a, c, g, or t
  misc_feature (137)..(137): n is a, c, g, or t
  misc_feature (143)..(143): n is a, c, g, or t
  misc_feature (150)..(150): n is a, c, g, or t
  misc_feature (155)..(155): n is a, c, g, or t
cataggcactttcccttcctngattcangnnttggngnctccgttgacctatgtactgctataagttagtgtcctcangcaggaaggctcaagatctcctgtacgtngcnntgcagacaccccagtnccttcancancactgntccccangccancaccatttgggtggctgtttttaaaaagtaaagttcttagaggatcataggtcttggacactccatccttgccaaacctctacccagaagtgcgcctgggtg

SEQ ID NO: 538752 - DNA, 597 bp, Homo sapiens
gacattgacactttaattaacgccaacgtgtgatttatttatttttttaaaacatgtgctcaaaactgcggatggaggttgtttcacattttgatgaccttctgaaatagcggtaaggccacaccaaatccgagcatcaggcaagaacacataatatttttttaagaaaaaaagaaaaaaaacggtgggaacgaagaagggaatgagatgtacatttaaaactcattgcattaaataggagaggcttagtaggacatactgttgccgcaaacagcggcacacacagtcttacagtaattgtttttgaaaccagttaccactaatgtattaagccctgcagcgggtaccactgacttgtcctacgcataaaatgaacccggcgaagccagtgttgatactgttgtgaagaggttgaggagctcattttcaagacagcttagaccatatttagcagaatatctcgtttagaaaggcctggctgaagatagttttatgtggattgtctaacctataaaaataacagggttcctattagtccatctttaaaaggaaatagatgccgaataccatgattcggttaccaaatgtgggtatgac

SEQ ID NO: 538753 - DNA, 632 bp, Homo sapiens
  misc_feature (86)..(86): n is a, c, g, or t
  misc_feature (98)..(98): n is a, c, g, or t
  misc_feature (247)..(247): n is a, c, g, or t
  misc_feature (259)..(259): n is a, c, g, or t
agaactggcagcatggcatgatggaaatggaatagaatcaggaatggtttgtacctgtgtgtgtgtgacttgggtgttctgactcngcacatatttgngaggtagagaggggagaagagggttgccacattatgtaacagaaaggagcccactgcttaaacacttaccttgtgccagacattgcactaggactttattacctgcaacccatcctgcaaaactgtgaagatttgatatgatcattctnattttatggttnagaaacaagggttaaggacattaaaaatttactcaatgtttaaacatttgcctgtcttattctaaagccccttctcttttcacaatccctttaagaaatggacatccaatatttgagtggcagaggcaaaaacatggcctaccaaaaccattatgatagctttacaatatgcccaccaattttttgatagtccttctgccaaatggtgaatgctaattaccctcctacagaatgtgactcacttctaatgaataaaatatggcacacgtaaaagtgtgcgatttcagagactagggcataaagaccccatggtcttcttccctgctctctctctcctaggcactctctctgggtgaatccatttgacatgttg

SEQ ID NO: 538754 - DNA, 156 bp, Homo sapiens
aggatgaatcaggcaagaccacatttaatatcgtgtcagttatatgttatgtgtcattataaagactagcacatgtacaacatacatggctttgaatgacataagaatatataaaacagtaactgtatgtttatatatgtgtagtaattctgccca

SEQ ID NO: 538755 - DNA, 680 bp, Homo sapiens
  misc_feature (86)..(86): n is a, c, g, or t
  misc_feature (98)..(98): n is a, c, g, or t
  misc_feature (247)..(247): n is a, c, g, or t
  misc_feature (259)..(259): n is a, c, g, or t
agaactggcagcatggcatgatggaaatggaatagaatcaggaatggtttgtacctgtgtgtgtgtgacttgggtgttctgactcngcacatatttgngaggtagagaggggagaagagggttgccacattatgtaacagaaaggagcccactgcttaaacacttaccttgtgccagacattgcactaggactttattacctgcaacccatcctgcaaaactgtgaagatttgatatgatcattctnattttatggttnagaaacaagggttaaggacaaaaaaaaaaaaaaaaaaaaaaaaaaaaaaaaaaaaaaaaaaaaaaaaattaaaaatttactcaatgtttaaacatttgcctgtcttattctaaagccccttctcttttcacaatccctttaagaaatggacatccaatatttgagtggcagaggcaaaaacatggcctaccaaaaccattatgatagctttacaatatgcccaccaattttttgatagtccttctgccaaatggtgaatgctaattaccctcctacagaatgtgactcacttctaatgaataaaatatggcacacgtaaaagtgtgcgatttcagagactagggcataaagaccccatggtcttcttccctgctctctctctcctaggcactctctctgggtgaatccatttgacatgttg

SEQ ID NO: 538756 - DNA, 153 bp, Homo sapiens
aaataggggatgattttagcttgtcctaaatcttgctgtccacccttccaggaaaggggcattgttaatgaataaaacattttcaactccttttgaatttatcccccaaggaaccattttatccctgtaattaatcaggatggattttttgga

SEQ ID NO: 538757 - DNA, 945 bp, Homo sapiens
  misc_feature (123)..(123): n is a, c, g, or t
  misc_feature (135)..(135): n is a, c, g, or t
  misc_feature (286)..(286): n is a, c, g, or t
  misc_feature (290)..(290): n is a, c, g, or t
  misc_feature (349)..(349): n is a, c, g, or t
  misc_feature (364)..(364): n is a, c, g, or t
  misc_feature (370)..(370): n is a, c, g, or t
  misc_feature (583)..(583): n is a, c, g, or t
  misc_feature (913)..(913): n is a, c, g, or t
gcaaccgcgccggcaacgccaaaccgctcacgcggcgcgcaggcagggcagcaggctctcggctgcagcgcgggggggatcgaggatgccggcttaccaacataggggcagcactggggcctnccctactggctngcctggctgggtggttgggccaatagcccggagcaggcccaactaaaccatacccacaggtacggatagagctaggtacaactaatagtacaacaaacagagaataccacgaggcaggccgggcacaacttctacaacgtggacaagagcnactngaagaggcaaagaggaaccataacacatgggtgggcccaagccacacccagagagttangtttaccgaggaccngaagcngcctgcaagcttcgaagcacgggaacaatagagccacagtgtcccaccatcaaagagatcagagaccagggctcctgtggctcctgctgggccttcggggcggaggaagccaacactgaccggatctgcatcacacaccaatagcgcacgtcagcgtggaggtgtcggcggaggacctgctcacatgctgtggcagcatgtgtggggacggcngtaatggtggctatcctgctgaagcttggaacttctggacaagaaaaggcctggtttctggtggcctctatgaatcccatgtagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggatacaattcctacagcgtctccaatagcgagaaggacatcatggccgagatctacaaaaacggccccgtggagggagctttctctgtgtattcggacttcngctctacaagtcaggagtgtaccacacgtcac

SEQ ID NO: 538758 - DNA, 1056 bp, Homo sapiens
  misc_feature (99)..(99): n is a, c, g, or t
  misc_feature (800)..(800): n is a, c, g, or t
  misc_feature (905)..(905): n is a, c, g, or t
  misc_feature (971)..(971): n is a, c, g, or t
  misc_feature (990)..(990): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttatccctcttgtcttgcgtgntatttttgggaccttttatccctcaaaggacccttcttggggttttggaatgggaagccctttattccggtaaagagtgttttcttctattttaccactctccantcttttttgggggccctcgatcctatttttccctgacctccaggcttgggtgggcccttataaaantggtgcccaaaagattggnggttaagactttccgaggacttacctgtcctaggggagataggcaagcccttccactagggagggg

SEQ ID NO: 538759 - DNA, 393 bp, Homo sapiens
ctgaggagtagacatggattcattagccaaggctgttccagagcccttgaagaagtatactacatagtagagagctcggctgaaagactcggaactagaagccacttatgaatcagtgttgttccatcaactacaagaaataaagggagttcacgcaagatgaagctctccaaactgccaacaagaccctacgattactttgacctatcagggatgtgtcttcgtctcactgaagttcgagacgaaactacattttagtcgtccccacgaccgatcggggctgctcgtcgcctacccggaggaaaaaaacctgacagccatcatcaatctgctgagatttgtgaagaccactcaacgaagacagtcggctatgaatgaatcatccacagactg

SEQ ID NO: 538760 - DNA, 728 bp, Homo sapiens
  misc_feature (99)..(99): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactgga

SEQ ID NO: 538761 - DNA, 112 bp, Homo sapiens
  misc_feature (10)..(10): n is a, c, g, or t
  misc_feature (20)..(20): n is a, c, g, or t
  misc_feature (32)..(32): n is a, c, g, or t
cggtaccganttggcgccanggtttcgtagcnggtacttggcgcaggcgatatcggtggtggtgtagagatagccgccatcctttttctggatgatgacgcccatcggatcg

SEQ ID NO: 538762 - DNA, 736 bp, Homo sapiens
ggctaggtacgaggcctgggtgttgaccctttgcccctgctgcgatgaccctgatcgcccttctgctgttcctgccaccgtctgctgctgctgctggacgtccccacggcggcggtgcaggcgtcccctctgcaagcgttcacgacttctttgggcacatgggccaccagttatagctacaagacaggcaatctatacctgcgggggccccttaagaagtccaatgcaccgcttagtctatgtggaccctcttactatgaagcactgtgcggtggctcgccgcatccttcctgatccgggcagctcttccctaacatggctgttggtctatggagtatcctcatactgtctacgctggctgcccatacggatacacgcagcatggaacaatacagtgtcagatgggcagagtgcgtgcatgcttcaacgcttgcctagcatgcgtagaatgcagtgagtgcaaattcaacaaggtggaggcctgcgtgttggatgaacttgacatggagctagccttcctgaccattgtctgcttggatagcagttttgagcgacatggagagcaagtctgccaatatgcctgctgactctacgccccagggtctgtcgccagaacactatcatggagctgtgcaatggtgggaccgcggtatgacagctcatgtcactgccgaaagcccagcggaccagatgctctccaggctacacacgagtatgtgcccagagtcaccgtcag

SEQ ID NO: 538763 - DNA, 801 bp, Homo sapiens
  misc_feature (99)..(99): n is a, c, g, or t
  misc_feature (754)..(754): n is a, c, g, or t
  misc_feature (758)..(758): n is a, c, g, or t
  misc_feature (781)..(781): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactgnaaanaaaaaaaaaaaatggcctccttnggcctaatcggggtactttt

SEQ ID NO: 538764 - DNA, 1216 bp, Homo sapiens
  misc_feature (99)..(99): n is a, c, g, or t
  misc_feature (1061)..(1061): n is a, c, g, or t
  misc_feature (1127)..(1127): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaaaaaaagaaaagaacaaaaccaacgaataaaaaataaataaagagagataagatataaaaaaaacaacctaagagtacaagcgattcaatcattgcaagtgtcctccctagagaggtacggtatgcttatctagcttattccgaccgcgtatgctgccgttgcagacgtgcccgtcgcacacgctgctttgccgcgccggacgaggccctcgccaactttgtattcctcccgcccctcccataaacagaaagccctaaatagatcacgatatgctagacgatccacgagagaaaagctcctgccgctgttgnctagtttcgtccgcagttcctatttgtgcccagtcccgctcgagtatgtccgccgcctcaaccctnttccttggagctgagccagtatccccgcccgatgaacgctagactttggctggtgtcgcgtctagattcggctatttgctgagggacgg

SEQ ID NO: 538765 - DNA, 924 bp, Homo sapiens
tccgcttgctgtttgtgatgtggactaatactcgtctccgccggctcttttttgttggctctagatggctgggttcctcactctgtgtggcgccagaatcccccccggtctatcgtgctcctttttcccccggttctctgcgggtgtgaccctctcacatgttcccccgcacgtctgtgtaatcttggccccggtatattgtggctctttcgagagcgttgcccgacaaagtgttgttcccccctttctctagggaggggggtcaccctcttgtgtgtcttcatgtgtgcgtctgcgtcccccaccggggtggcggcggattttctttccaggagggttgttcgaacacccccccggcttgtgttgtgggggaggcgcggtctgataatcccatctcgaggggtgcgttcactaccacctcttgcgtggaacaaaatattgttgagtcccttctcctctttcttgggtgtagctccccacatttggcgcccctcgggtccatcatgatgctccccccctttgtggggtgctttcttctttggtgccacccttcctcgtctgatggcccggggtggacccccccactcaaagatgttggggtcgcaccctcgcccacttcgtgccaaggatggtggcgggcccccgaatttctgttttggtcggcgtattttttttgttggtgagacgacccccctggtggggcgttcattattatgttgtaacttaacgtcggcgtggtggaatttctctccctacgccgccgtgggggtggcttcttccctgtgtttcccagagtcccgctgacagatctcgttgggggtgtttctctttcctttctcttccttttttaaagggccccccaaccccccttatttttttttttttttcccctccttccaaaaaaaaaaattggggccccccaca

SEQ ID NO: 538766 - DNA, 779 bp, Homo sapiens
  misc_feature (99)..(99): n is a, c, g, or t
  misc_feature (732)..(732): n is a, c, g, or t
  misc_feature (736)..(736): n is a, c, g, or t
  misc_feature (759)..(759): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttttttggttttttttttttggctcatgaatttttctgtttgtcatggaaatgtaagagtggaatattaatacatttcagtttagttctgtaatgtcaggaatttttcaaaaaaattaaaagatggactggactgnaaanaaaaaaaaaaaatggcctccttnggcctaatcggggtactttt

SEQ ID NO: 538767 - DNA, 507 bp, Homo sapiens
ttttcattgtaaaataccatcatcagtgagagtcttgagttcactaacatgtcaccttctggagagagagttaatggggggcatgaggatgatatttttttacatgtgttggtttctgattcaagtgacacggcaaaaaaaaaaaaaaaaacaaaaaaaaaaaaactggtctcggggccggcgccctcggcgccctctcggaaagggttttcttaagacaccatatccggttggggcgcgcggccgggcgcccaggttggggaaaggtgcgaccctgggcgcaaataacgcgtggttcccaacagggaagaccccggcgccattagactaggtggcttgggggttttcttcaacaaattaaaaaaaacgcgccggggggggcacaccggagcgggtctttggacacaatcccagaatggaggggctcaggagggccactaccggggctctactcaaccggggaggcccaaggagagccgagatttaaaatacgcgcgcggggggagc

SEQ ID NO: 538768 - DNA, 784 bp, Homo sapiens
  misc_feature (99)..(99): n is a, c, g, or t
atgccattccacagccagatttgaccaagctgcaccagtgtggcaatgcaacagtctcattttcccatgacgcatggaaacaccggattcagtgcaggnttgggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgccaagttttcctcctctgacacccatattcactcttaccagcctctccctggctctcagcccgccccccctcactcacccaccgctcccgctcctccatgccatgtctccagggtagggggcctgccccccccccccccccccccggcccgccccccccccgcgccactgccaaagcccagtccaccctacccgcccctccccccgcttcccccgcccccaccacccccacccgcccacccaccgccc

SEQ ID NO: 538769 - DNA, 412 bp, Homo sapiens
cacgaggcaggtagcacaggctggaacgcattcctttggaagaacgtctgctcagatggaccctgagatgtctccacggactttatttgggactttgtttggaaagaaagccgactgtaacttgggcagatgtcgacaaggaagaggggagagccagatgccaccatgccctctgcctctgcatatccgtgtgctctgtgtgttgtgtaggctcatctacagcttacctggcttggagttcaggtaatggtggccatcctgacattctctgttggagtttagagagatgtaagacgtccagttaatgtcttatttactttatgttgatcagtctttaatacatgtgctgaatcagaaaaacctaaataaaaataattttttaaaatgtaaaaaaaacccccccaattgagag

SEQ ID NO: 538770 - DNA, 244 bp, Homo sapiens
  misc_feature (3)..(3): n is a, c, g, or t
  misc_feature (43)..(43): n is a, c, g, or t
  misc_feature (45)..(45): n is a, c, g, or t
  misc_feature (53)..(53): n is a, c, g, or t
  misc_feature (60)..(60): n is a, c, g, or t
  misc_feature (62)..(62): n is a, c, g, or t
  misc_feature (70)..(71): n is a, c, g, or t
  misc_feature (82)..(82): n is a, c, g, or t
  misc_feature (94)..(94): n is a, c, g, or t
  misc_feature (101)..(104): n is a, c, g, or t
  misc_feature (119)..(120): n is a, c, g, or t
  misc_feature (138)..(138): n is a, c, g, or t
  misc_feature (147)..(147): n is a, c, g, or t
  misc_feature (154)..(154): n is a, c, g, or t
  misc_feature (164)..(164): n is a, c, g, or t
  misc_feature (182)..(182): n is a, c, g, or t
  misc_feature (197)..(197): n is a, c, g, or t
  misc_feature (200)..(200): n is a, c, g, or t
  misc_feature (202)..(202): n is a, c, g, or t
  misc_feature (213)..(213): n is a, c, g, or t
  misc_feature (215)..(215): n is a, c, g, or t
  misc_feature (228)..(228): n is a, c, g, or t
tcnctggcattaacatacccgagtgaacaaagcaccgaagatncnccgccggncctacananctcatggnnggattaaccgntacatgagctcnccctgcnnnnttgagatgatcttanngaaaaggaacagattgtncctaaaccngaagagnaggttgcccngaagaaaaagatatcccngaagaaactgaaganacntnaacttatgccncngagtaaattcagnttaaataaatgtaatt

SEQ ID NO: 538771 - DNA, 286 bp, Homo sapiens
  misc_feature (25)..(25): n is a, c, g, or t
  misc_feature (48)..(48): n is a, c, g, or t
  misc_feature (63)..(63): n is a, c, g, or t
  misc_feature (68)..(68): n is a, c, g, or t
  misc_feature (74)..(74): n is a, c, g, or t
  misc_feature (113)..(113): n is a, c, g, or t
  misc_feature (160)..(160): n is a, c, g, or t
  misc_feature (171)..(171): n is a, c, g, or t
  misc_feature (223)..(223): n is a, c, g, or t
  misc_feature (270)..(270): n is a, c, g, or t
  misc_feature (274)..(274): n is a, c, g, or t
gtggatttggaacaaccctcatggntaaggatttgggattggcccaanactttgctaccagcncaaanagcccnatcctttttggcagtttggcccctcagatttacaggatnatgtgtgcaaagggctactcaaaaaaagacttttcatccgtgttccngttcctacganaggaggagaccttttgagtgtgccctttggccccggaccctgttgggaaccnaactttgttttggagcctccttttagctccctccccaagtaaatggntttnatcaaaggtcca

SEQ ID NO: 538772 - DNA, 130 bp, Homo sapiens
agaggatcccggtcggccagggcaacgtttgtagacgtgagcgtcagtctcctggcagatgttctgctccactgtgtcacactcgggtaggaatgcctgaaccttttttaccaagcctttccttttcaat

SEQ ID NO: 538773 - DNA, 96 bp, Homo sapiens
gggtttttttgcccctttccccccccccaggaaaaaaaagttcggggttaacagggacaggggtttcccatcttttgaataaattttttcctttta

SEQ ID NO: 538774 - DNA, 111 bp, Homo sapiens
tcacatctgaaataccacattggtgatgacatcctgcttagcggaggcatcgggctccttgattgacactcaccacattgtttttcaagctgacttccagcttgtcacctt

SEQ ID NO: 538775 - DNA, 355 bp, Homo sapiens
tatccgggacgggcagacccacagagaacacctgtgagatgggatggcacctatttggagagcactggtatgaggggctgtgctgaggcgcccccagataggactctgggctcatacagatgccactatcattatctgccggggtgtcttcctcctttatgcacagagggatcatggcaacgtaagacagtgtagtctggcttcctatctccttcagatgatatccacttcactgcccagatctacactaaaggaatgatctggagtgaaggacaggacccctggggcccggggaagaggttgtaagaaggtaaagggagcaaactgatcggattttgagaacctaactgggaga

SEQ ID NO: 538776 - DNA, 84 bp, Homo sapiens
tcatggttggctatgtgagctgacgattggtgcgtgagccatgtgctctccagcctggtgtgacagtatgtgagactctacctc

SEQ ID NO: 538777 - DNA, 422 bp, Homo sapiens
taatcattaactatgacctccttagtaccagagaattgtccatacccagaatggggagatcaggtcgatacggccgaaaggtggtgcccattaactttgtaaagaatgacgacatcggaatcctcagagatatcgagcagtactattccactcagatggatgagatgccgatgaacgttgctgacctaatctgaagcagcagatcagtggaatgaggaagactgttcacctgctgggtactccggtttgaaagaattaagatccagattctacttaagggggttaatagggactttccttctcataaagggcctgccgactcccttcctttgaagaggatatggggattcggctctcttttctaatttacatgtaattactccatggtcctaagcctttttaattaaaaatttaaaacttca

SEQ ID NO: 538778 - DNA, 647 bp, Homo sapiens
  misc_feature (300)..(300): n is a, c, g, or t
tacctcaataaacgctgctggaacaactggacatcctcatgaaagagaataaatgtggaccagaccgtataccctccgcgaacataaattcaaaatgaatcacaggcctggcacggtggctcacgcctgtaatcccagctttcaaggaggcagaggcaggaggattgcttgagcccaggagctcgagacctgcctgggcaatatagtgagaccccgttctccacaaaaagtgggggaaaaaaaagacaaaatgaatcacagacccaaatgtaaaatgcaaaactatgcaactcctagacngtacacaggagaaaacttagatcacctggggtttggcagactgtttagatacaaaaccaaaggcacagcccatgagagaattgattaagatggacttcacgaaaataataactttgtgctttgtgagagacactgtcaagagaaggaaaggacagccggacgtggtggctcatgcctgtgagcccagcacttttggaagccatttggcgggatggatcccttgaggccaggtgtttgagaccagcctgagtaacaatagtgagaccccatctctacaaaaaatgtaaagattagccagggatagtggcacgcacctgtagtcctagctactccagaggctgaggcag

SEQ ID NO: 538779 - DNA, 141 bp, Homo sapiens
tcctgtatgtctcatattttaatcctttaaagagctctccattgtcatctttttccaatgttgtttagatttagtcaatctccttttcctttcacgtcatgacatttaattccagactaccgtcttcattctctcgaagag

SEQ ID NO: 538780 - DNA, 1222 bp, Homo sapiens
  misc_feature (230)..(230): n is a, c, g, or t
  misc_feature (732)..(732): n is a, c, g, or t
gttagatcaacctaatcagggtgcttgatgaccgttcaagtggtctcattagtagggtggcctaagagactcaagtcccccgaagtcacttgggacaaagactcccagtgagtccctataaggcgacagcaggttactacgctttacttgtcagtaaccacgaagacgtcgcaaggtctcctgctactttgacgataccacggacgatcttcatgagaatgtcagccttntcctgtggtaccccaacagtggcatgttcgcttacgcattccatgtgattgtgactcccgagcgaaacggcagtatttcacgctttggaggcttaactcgctggagattattcatgaccatacatttacataaacaaaacatattacaaagaatcacatgttgctattgagactgccgcttggggcactctctaataacatggacgtataggttaagaaggcgcatacaggtctaggggagttccccccgagagggcactgggcggagcgtaaggggggccacgcccctagtggcacgaggacctttgattgactcactcacgcgaaggaaccttagcgcggataattgacatcaatttgcggatggtgagatcttacgcgacgcgagttgaaagtaaagaagccccctggtgcgtgcgtgtacctcctagagagtctttgtgtagcccgtacaaagtattccccctacaatggttggaaggctctgcgatgaaggggacanttgcagctgagagctccttttttccgaactcgggagtaccccgtttaatgaagattctcatgagtttgtgtaacatttgattcacatcccgcggtccccatggggaggggtgggcacgaattaagaggttacccttaggttgcaatttcttataccctttcctttgcttactttaatctagggaaattaaacaattgcaagaattccttttggtttctcaccttgaagaaaagccacacggaaacagttgttctcctagaacttcgggcccaagacaatcaaccgacagaatttggatcgcacgggaggttgatgagttcctcacaggagccgtggaattggaccccccgtacccaaggtgtccaggtggccttattaggacttacttgtgggcacggtccccttcccacatcgagggttacacaacgcccacgggacacgcgacggaggtgtgagaggaccaaccgtggagtacacagccaataccgcc

SEQ ID NO: 538781 - DNA, 393 bp, Homo sapiens
ccgggggggcgcacggggcgaacggcggggagggcgggctgcggctccggcccccatggtggggtactgcaacggagcacagggttccaccctttcctttccacctggggtccccgcccccacggcagtgtttcaacggccatccccctcagggccgccgccgcggtggtttgtccccggctgtccccatccgggccggtacgcttgcttccgcacaggccaggcactttgtagttttcagtgctaccgcatcaacctgcaaatgcggctggggggggccgagggtcctggatccccccttttgggtacgtaaggcccttaaaccggactttgggccccgtcccatggccgcttttgagtatcttcccccccctatttaattacatccggtga

SEQ ID NO: 538782 - DNA, 1664 bp, Homo sapiens
  misc_feature (446)..(446): n is a, c, g, or t
  misc_feature (545)..(545): n is a, c, g, or t
cggggggttgtgtgcgcgttgtagcgccctgggggcgggcgtgggtagtagcgagtgtgtttgtccccccgagtgacggccagcgttgttgtggcgcccgccgagttggtgcgcgcgccgacttgtttgtgggtggcggaggcacttattgtgtagtccacacgtggtggtggttcttctctgatatatatcgcccggcgggtggtgggtgtgtctccgcctgcgtccggccatagttttttctctccgccgggtgttgtatgtatgctaccgtcaggaagtttttgtttctctcttccgacgcgtgctgctaccgttgctgagtcacgggtgggcgttgtcagtcgtaaaggtggtactgccccttctagtctctgcccttgtgttttatttgactggtggcgggaaggaccagtcctggtgctggtttggttattgttggcgcntgcgggctcagccggcatcgttgtttacgtagttctgagctgggtgaaggtgtcctagcctgcgcgcggagggcgcgacgcgcagacatggttctaccnacgacagaggggggggggggttagctaatgtagaggtaggccacgcgcttgtttgtcggccaccacgatgtttgctcactcggcggggatgttttcttcttcttgtaagtggaggagagtcatctctgtttgtgaaggcagctcgggacgcaacatcagatgttgtggttttactgacagtagttgtggggttgtggctacaccgcatcagagggattgtgctcctctgctggagtggtgatgtaagtaggatagtcactcccttcttgttggttgcagtggaagcgcttgtttacagactcttttgttttgtggggccgcctgtttagaagagatgttttttggtaggagatacctcgccgggggggagatcgtccccaccgtggtgggtgcgcggcgcagagagaggagcgactccaagacacgcggtttgtgctgttctctctgtggcgcacataatcgtcgtgtgtctgataagagagagagagtatgttttctctgtgggaaagatagagaggagggagaggtgaggagtttagtgggcgcccaccctcctctgtggtggtgggtggagggacattctactcgggcgcccactactgggggggcgcacgccactcccttgtgtttcgactcccgcgcgggcggggggtatggaggaaacccgcgtggaggtagtcgtcgcttcacatttgttctttcgccggggggtgtgtttgttctcgccgacacgtgttggttgtatgtttggtgcgcacaagatatgtagcgcgcgcgcacgcgtctcgacaatatagagcgcgcggcgttattttctgttgttgaagaggatttataataaataggttggtgtttgtgtaataactgtgaatgatatggtcgttgtgaatatgttgcaagatagaaattgattgttgtgacatgatgtttgtaatggttcggggtttaaagaaggagatgtgcagatgatgccgctgttactcttgtggggagaagattgttttattgtgtgggttttttgtggtaacaacagttttattgttttttaacttgtggaaaaatgaggggttttaatcccccccttgttttccccaaacccaaaaaaggggtaaaccccca

SEQ ID NO: 538783 - DNA, 86 bp, Homo sapiens
gccagcaccaaccagacatctatgtacctctgtgccagcagcctcaatgagcagttcttcgggccagggacacggctcaccgtgct

SEQ ID NO: 538784 - DNA, 976 bp, Homo sapiens
  misc_feature (29)..(29): n is a, c, g, or t
cgtgaacgggtaggcggtgcttgctgttntgcgatcatgcttcgtggcgttcgcgtgtgcacgctcgcttcagagctcttcgtacggcgccatttttatgtgagagatgctcatccggctgagagcgctttttcctgtcggggcgggggtcgactttcctggccgtgtgaaatgcctcgcttggaggacaggaacccttcaaggagatatcaggacttttgcccgcgccgtgaacatcaccgccctgcgcgccctgtcgtgtctccccccccttggagggagtaggtggcacagcttgtataaccctgcgtccgcccgtggtggctggacaccctcgcctcccctgggaagaactatctgaattggtgaccttccggcagaaaaatctgcacggcggcccggcattttccgtgcgttctctttaggtcccggcctgcgctttaacgaggcctctgggtcctgaaggggagccttctgcccccacgtgttgatggacctttttccccaagccggccagcactatgggcgcagcgctctgccgtcccaccacggacttttctgggaagaatgccccctgcgccttggcgcccccccacccccgggtgcacttcaatcgtgaaccgccatgctcaccagagaaattttggggggggaccacccacacgaacacgcgccctctgtgttgaaggcggaaaacccggggtccttcagacagccccccctcgggtctgtgtacccatgcccccgccgggagacctttttttgttctatcatgcccggcaaggagagtgcaccacgcccgtgtctctcctctctcagggagcagccgacttttctctgaggtacccgggttacattgccggaagactacggaggccgcgtttatatcagacttgcacggcgccccctgacgcttacttttatgaggaagtattccgtttcaaaaaaaaaaacccggttccccccccacaagaca

SEQ ID NO: 538785 - DNA, 84 bp, Homo sapiens
gccagcaccaaccagacatctatgtacctctgtgccagcagcctccttcagcaagcgggaaaggcagatacgcagtattttggc

SEQ ID NO: 538786 - DNA, 172 bp, Homo sapiens
tgctttaaataccaaacagtaaatcagaaagcttatattctatttaaaatatatataagacacacttatatgataagaaaacaagaccctcctaacatgtgacattaccgttcgtggcaatatgttctcaacctattcactctaccttttgaccttaagcatataagctcct

SEQ ID NO: 538787 - DNA, 385 bp, Homo sapiens
atacaaacagcccagaccatagaaaaaaactcattcataaatactacttcaccaaaattgaaaatacctgctctttgaaagacacaattaagaaaatgaataggtaagctgggtgtggtgctcatgcctgtaatcccagcactttgggaggctgaggtgggtggatcacttgaggtcaggaatttgagaccagcgtgccaacatggcaaaaccccgtctctacaaaaaaacacaaaaaattagccgggtgtggtggtgcatgcctgtaatcccagctacttgggaggctgaggcaggagaatctcttgaacccgggaggtggaggttgcagtgagctgagatcacaccactgctctccagcctggacggagtgagattctttctc

SEQ ID NO: 538788 - DNA, 87 bp, Homo sapiens
  misc_feature (45)..(45): n is a, c, g, or t
  misc_feature (53)..(53): n is a, c, g, or t
  misc_feature (55)..(55): n is a, c, g, or t
  misc_feature (58)..(59): n is a, c, g, or t
  misc_feature (61)..(62): n is a, c, g, or t
  misc_feature (65)..(65): n is a, c, g, or t
  misc_feature (70)..(70): n is a, c, g, or t
  misc_feature (73)..(73): n is a, c, g, or t
  misc_feature (76)..(78): n is a, c, g, or t
ggatttgctggtgcagtacaactaggcttaatagggacatgccantgcactcngnctnngnnacnagagnaanacnnngtccaaaaa

SEQ ID NO: 538789 - DNA, 430 bp, Homo sapiens
tgtgttagctgcagttgtcgtgaggctgctcttctggcctacgtaggccttgatcagccccaggcctatggcacaacttgctagggtcaggaggcccaggacccggggccccatgctgtggggcacaggtaggccttggtcagagagtctacaaacactgatgatgtatcgtggaggatgtggttagctgacgagacgggagcctgtgactttggccttgaaggggtagcccccgatgtggtaagggagccgacagatacttaatggagatcaggtagctgccaggtgccatgcggataataggtgacgcggtagcccctacagggcactcctggaaatccatcttcaccttggaggggctgtcaatggtacaccgacaggtcaccagttcccgcatttgctcgtgctcacgaaaactgcagctaacgca

SEQ ID NO: 538790 - DNA, 694 bp, Homo sapiens
catccccatctcatcacccagcccctgtataaggtggtactggaggccatggccgggacccccaaacagagttccccccaccactgagggcacccgagggctcctcagctgcctgcagatgtggcaagggccacgctgacgcttctcctggaccacctgcgcctcgtctcctccttccatgcctacaacgatgacccaagaattggcgtgtgcttcgggcctgtgcgtgctgccggcacgccaggcgcccacaaggctcgtgcccgcagctccggccaggccttgccagtgcagtggacttcaagcaccacatcgaggtgctggactacctgctgagtctaggccagatccccgctgcccgacaatctccagatgtcgcgccttattgcgaccaaagacaggcactctgcacctgccgtggcagacccgaagtggtgactcggccagcggtcgaggaggcccgaaagccccccgagcaacgctacgccggcgactggagcgttgcgggcggacttcctggcctgtgggggggattcctgtcgggccagataacgaacacgtgacgcgaagggcacggaggaccagacgcggaggcgggaccaggtcacggggcttccaagagaatgggggctaacccgccgaatcaagagttgagcgcaccggtggaagagccagacacaggtgctcacccacg

SEQ ID NO: 538791 - DNA, 321 bp, Homo sapiens
ctgctggctttggggtaggcttcgatcagcacggcgcaggtggcggtgaagggctgcaggtgctcgaccaggtcttcgtcgtagccgcccgggcgattggcgacggcggccatgccgaccaactggtcgccgcggaagagcggcaggcccatgaaggcatccagcggcgcatggccgggcggcaggccgccgcggcgcgggtcgtgggctggatcgttcgacagcaccgactgcccgccgttcaggacatggccgaacagcgtcttcaggtaacggaattcgaagccgccgatgacatagctccgatggcgtcggcgcgag

SEQ ID NO: 538792 - DNA, 140 bp, Homo sapiens
ttcatggaagggtttcgtggctaatcactcggggaaaacagaggcaggtggggggagggataccaagtaacaaacatgggggagtgtgaaggtcccgggtgcctcagccaggtctagcaattaacccagttaagtctccc

SEQ ID NO: 538793 - DNA, 412 bp, Homo sapiens
  misc_feature (346)..(346): n is a, c, g, or t
  misc_feature (367)..(367): n is a, c, g, or t
gatggagtcttgctctgttgcccagactggagtgcagtggcgtgatctcggctcactgcaagctctgcctcctgggttcacgccattctcctgcctcagcctcccaagtagctggggctacaggcacccaccaccacgcctggctaatttttttgtatttttagtagagatggggtttcaccgtgttagccaggatggtctcgatctcctgacctcatgatccgcctgcctcggcctcccaaagtgctaggattacaggcgtgacactcacgcccgggccccaaagttctaaagtaacattctattggctaaaagaaatcctaaacctacttatgtaacatttttntcttagttaaaaatgtggaantattattaaacctcaattttttaggagggctccaatttttttaaa

SEQ ID NO: 538794 - DNA, 269 bp, Homo sapiens
ctatgtattggggaagacagtgcagcacccaggctttaccagctgcgtatggcagacgaaggcggtctgaggtgtggagagtcgcatcacgaagatacatgtgtttgactgtttaatctgaaagtctacattttgtatgctttgtgtcggtgtgtaattttggtactctctggtggctagtttttgtcaaatcttttgcggaatattgcttaaatgttttgattttatgatagtgaagcttgtatacagtgtttggccaatcaacatag

SEQ ID NO: 538795 - DNA, 556 bp, Homo sapiens
catgaacgacaccgtaactatccgcactagaaagttcatgagcaaccgactacttcagaggaaacaaatggtcattgatgtccttcaccccgggaaggcgacagtgcctaagacagaaattcgtgaaaaactagctcgaaatgtagcaagaccacatccggatgtcatcttggtatttggattcagaactcgattttgtgtgtgtgagcataggactaaactggcttatggttcatgatttatgattcccttgtgattatgccataagaaaaattggaatcgccaaacatagactatgcaagacatgggcgtgttatgagaaagtaataaagagctcaagaaagcaaagtaaaggaaccagcatagaaacatggaatgtaagaaagtcagggggactgcaatggagccaggagtgttggatggctggtcaacaagagaagtgagctgcagattggatcacagtcgaaggagtaggaggtgctcgtacatgatgtgtagctgtgggacagctgtggcatttttcgcatgatcatgtaatagattagaaacttcatgt

SEQ ID NO: 538796 - DNA, 316 bp, Homo sapiens
  misc_feature (13)..(13): n is a, c, g, or t
tactcagtgatcncgtgtgcttcagtaatgcttcgctctcctctaacaggctgtggtctgatgttgagtcatgtggccccagtctatgcggaggtactccccggctaacctaagaagcagttgtattagtcctttttcatgctgctatgaagaaacaccaagactggtaatttctaaagaaaagaggtttaatagactcacagttcttcacagggcagcaggagagagaatgagtgttagcaggagaaatgctgggcacttataaagccatcagatctcacgagactcactcactatcatgagaacagcatggggg

SEQ ID NO: 538797 - DNA, 243 bp, Homo sapiens
ttccgcccgttcaggctccctttccacctctgactgcttgacgggacgtactccaccagagtggctgccgggcctccccagctcagacagtacacagctgatagccccaagactgccccttgtcctggggactctgctgccacactcagagagcctgtgtaggcttggagacctttctcatgtgtctccccctctctccctacacccaggcattcccaagccctccctgtggacctctggagt

SEQ ID NO: 538798 - DNA, 151 bp, Homo sapiens
ctagcctcgcgtgtgggtgggacacacgcatgcatcaacatgcgtggtaattcctttggtactttttagtagagacggggtttctccacgttggccaggctggtctcgaagctccgtgacctcaatgtgatccacccaccgtcggtctccc

SEQ ID NO: 538799 - DNA, 402 bp, Homo sapiens
cgaggtctgtgctaagatagttctgataacacagatgctgtatactgtcaagtgctgaatgccttttgcacttaagccagccttgtgtatgatgccagattgtacatgttgacgtttgacattctagcatgccatgacgtcaactccagctcccgatgtgtgcgtagctctatactagatgcaatatagggactttttatgcttagaagtacgagttcactgtcttgacatgcattgtctactttatcagagagtagaatctcatgctattagcattgcttactgcagaatggtcccaatgcacatgctgtttaacagcagggctatgttatgccaattaatgatgtctggaacttagtatctgctttcccaatgacactagtgctgaattgctattactgg

SEQ ID NO: 538800 - DNA, 275 bp, Homo sapiens
catcatgtacagagcgtctgttccagaaaatgaggacaatcacacagctgactgtgagactcctgtggctattgacttggaccttctagggcacatggagttaaccaagagagatcagaaactgtttcatgcagttaaagagaccttggtgagacacagcatttagagagaaaagccccagacacattcagagaaactaatgggatggaccctatttgcagactgcaacggagtacatgtaacaactgatctgccaattctattatggctttcac

SEQ ID NO: 538801 - DNA, 245 bp, Homo sapiens
cccgcgtgtgtctccatctgtatgcatcgacgcactcagggtgcgggcctggcgggttggatgcctacgcaactggtaaacctggcgttgagcgaacaaggcttggcgtggctggtgccgtcggtgatgacgctggtcgtggccgtggtgattgaccgtatgctgggcaagcgcagcgaagcgatcgcttaaaacctctgacttatacgctgcaattaaaaagccccggatcaaatgatccgggg

SEQ ID NO: 538802 - DNA, 1602 bp, Homo sapiens
  misc_feature (4)..(4): n is a, c, g, or t
  misc_feature (49)..(49): n is a, c, g, or t
  misc_feature (57)..(57): n is a, c, g, or t
cccngaatggtccattaggggaagttgcccacggctgcattcccggaangcggtctncccttgccttgcgagctctgggctggggctccctgtatgcatggtgtggggttggtgtgattagcttcgcagtctggaaagctttaggagttcacagtatgaacgactttcgaagtaaaatgcaatcaatatttccaacaattcccaagaactccgaatcggctgttgagtgggaggaaacattgaaatccaaatgagatgagcatggatgaatttcaaaatgcttgttacagaaaggggtggctctggagacaccatgacagcaaaaggactgggactgatttctcccaggaacatgggcagattgctgactgaaccagtgcactggatagcattcagcctcatcacaggagagtatgtgtgtgcgtgctgggggagggtaaagttttcccacagttaagaagactatttaaaaatagtaattacaggaataacttccttatgtggaggggaccccataggaaatgattctgtttgtaacagttgaagcaaatttcatactaaaaaagtttataataaaagtatgataagaaaatatttataaaacagaccccctaatagcaatagtactgcaatgtgtctaattaaaggagtttcaagagcctttcttgtcaatatatgacagaacttggaagtcttattctgattagccagactacaaagtgacagtcacctggtaagtcctgtatggtaggaagtgggtgtggctctcgggtcctaaatgtggtctgtgctttacagccatcacacacatgctagttatttacctgatgcccttgcttgaaggccctataaattcttatacttaaaacaaaaagccagtaatgagttgtgatcaccccaaaaggcacagttgggctaaaataatgatgatatcaggggtaaacatatttttttgagaagttggtctggatctctgaacactgacaatttgtcattttgtctcagttgtcaaagtaaaaaaagcccagttgtcatccgtcttcaatatttttaaccagaaagtcacctgagtacggagtcccaatataaagtatttgggaccacctccctaacaaagctgttagggtaaattctgtgtgcacgcccaactccctcctgtcttccacagtctcctacaaaaaaaacagatggagaataatgtctacatgcaattgtttttactgcaattgtattttaaaatattttcaagaagagaaatactttaatatgtcaatatgtccagagaaaaaacctgtagttaaatatcagttgtgcaatttcttcctacttgcctaggctctaattagtcagcaatcaggtttaataaaggacatttgaaatttctgttatcatgaaaccttttattctaagggagatttttaaatgaaatgacaagaacttaatgtaatacttttctctagaccatgttaccctgttaaaattgctgtattgttaatgaaacaggtgtaatcagcatctggaattcatatgtaatctgttagaacattccaagaactgcaaagcgacaagccacaggcacaaaacaaacgacgaacacaaaag

SEQ ID NO: 538803 - DNA, 309 bp, Homo sapiens
gactgcatctgtcctcttggaagagggaggtaggtagggaacaggtgggctgcttggtgaccatgccttaaaagtcaggtactggggctggcgggttctaatggtcgcgaggtgagaggtgcacctgtggcgaacacccttcactctcagtttgtcgggatagaggatatgagtctagccctgaggatgggatgtagactacaagggcaagagagtcagcttaaagaaatctgtagaactatctgccaggactgaggtgaccatagcggagagatgttggaggtattctgttgggaacaagattgcagt

SEQ ID NO: 538804 - DNA, 426 bp, Homo sapiens
gtgaaccataacgatactacactcaatactcatcattaataatcattatggctctagcaataaaactaggaatagccccctttcacttctgagtcccaaaagttaaccaaggaacccctctgacatccggcctgctatacttctcacatgacaaacactagcccccatctcaatcatataccaaaactctccctcactaaacgtaagcctactcctcactctctcaatctatatccatcatagcaggcagatgaggtggacataaaccaaacccagctacgcaaaaacttagcatactcctcaattacccacataggatgaataatagcagttcgtaccgtacaaacctacacataaccattcttaatattacctatttctattatcctaccgactaccgcattcctactactcaacttaaactcc

SEQ ID NO: 538805 - DNA, 425 bp, Homo sapiens
acgtgttgtctagcgatccaggggagtaggtgggtaacctggctatatgcttggtattgcagatggactatattatgtctagtgggaagctaacccagcagttgcttggtggcccttgtagttgtgtataggcgtgaggttgtgcatcttagcagcatgtgtcaagtgagcgtatggaccttgggacaaactccggagaacaattgcaggcgtttaaatgtggctgcctggagtttacactctggagaacttaaccctgtccatgcccactgtggaggctggaggcaccgtcctgggcacccaccacttccaagttgccttccttcatctggtctacgtggtggagtgaaggtcaatgggacggacttgcagctggaaggctgggggaatgttgaaaagcccactagcggtggccttgaggctca

SEQ ID NO: 538806 - DNA, 541 bp, Homo sapiens
  misc_feature (137)..(137): n is a, c, g, or t
gtctagtccgaccgccgtgtccgcggtcagaggtaggttccgtcctcgtgcgcggaaggtctcccgtgtcacgtttcgtatggggctcgtgttctggtgatgccctaagccgctcgtctagctgaggttccgccggntcgtggctgaccagtctgcagttaagcagcgtgtgttgcacagcggtgaactacgcagtcgccacctggttcaggtgggtgcgcggcaccacagtggcttttgtgcggccccaccctgcgggtcaaccacagcgacgcaccgtttgctgttcggaccctcgcttggaagcctgttacttcggccgcaccttacccctcttggggggggctacattgtcacccctgtaggagctgagcgacgagctcaggggatcaggccccagatacatcttcacagcagggccatgagatcagcgcgaacccataccagggacttgaatgcgcctcgaaatgggtacaaacccctgccctttggcgcccccccggggggccccctccccctggtttgcttcggattattttcc

SEQ ID NO: 538807 - DNA, 694 bp, Homo sapiens
gagtgcgagttgcagaagggggtgcttctcgtatcagtgcttcttcgtggcggaggaggaagtatgggtgtgcacctcagcactatcccaagactgctggtcaagcatgcgagttcctggggaaaaccccatgggtcacaaacgctcagaaatggattcctgcactgaaggcactagactgacgattgacaagctcctgctaggccagacaaactccggcaacacggaaagaaggaacgacgatgattgcaactatattacgaggatgtaagcttattctagtaaattgccactaaagcagcaaccgatgcaaaggactttaattaggacggggctttagggggggcctatggcacccgtaccgttgccaggcacgtatcacaagcagttgagcgggatagcctagtaactatcctacgtgtagtgtattatgagggggctgggctccggggccatccgttgtggatgatggactaggtagtgtggcccaggccttggtgatccgaagtggacttggggcgccaattaccgggagccatcagagccacgcaagggcagaagactggccagagccacgccaaagaagccgtccaaaggaaccatagcgcggggacaaccgcagaacacccaagggggaggctaagggaagcaagaggggcccagcgggaggaaggcccctaggtctgagaaccag

SEQ ID NO: 538808 - DNA, 496 bp, Homo sapiens
atatttcacacattattgattaaattgtttaactttttcaattttgttgcttgtgttccagagatatttaattccctttaaatgcctatatgatgctaaaatggataaaagtgttatactgaatgccagaatgtaaaaatttaggagtttctcccatcattttttttcaggttatttaaatttaatttacttttttttcctgacttcttttaattaagaagaggaggaaaggagggaattttccatgagtttgaatcctacaaatgccacaaacagcttctgaagctgaagccatgacaatgaacttccatgacacaaagaagatgaggaattggaagggaacagtgcaggagaaacacagtgacattgtgtcacagtaggtatttatgcctgctatcctcatccgagataaggtcaataacttctgctggtgaagcccaagtctgctgggggctcacagcagttccatgactgtgtctgcctggtgctaagatac

SEQ ID NO: 538809 - DNA, 412 bp, Homo sapiens
aggccaaagtcagtggaagggggatacgccctccaatcggggtatttccaggaaagtgttccaaagcagggcagcaagggcaggccctccagcctcagcagcccccttctgttgagcaaaacagattcgaggaaacccaaagttttcgcctgtgaagtcccccatcagggcctggggttggccgttcaaaaaagcttctacaggggagagtgttagagggggaagggcccccccctggtcctcagtttcagcctgaccccctcccatcctttggcctttgaccctttttccccagggggccaacccctattgggggcctccaggttattttttcccccccccccccccccccccttgggtttaattatggtaatgttgggggggaatgaaaaaaaaaagggaatttttgcca

SEQ ID NO: 538810 - DNA, 400 bp, Homo sapiens
tccaccgattcaagtacactcacacctcctcctccagcaggaagatgctataatcactaaagtgcgtctggtagctctcgtgcccagagtcgtcaggcccttctctggctgcggagccgtctcctcagtttggctgtactctcttggtctccagtctcccctgttgtcccaggtagagctggtgatcaatgcttatgttgcctcgatttctactctgtctctctataccatctgatctaccattgctcaccatcagatcaagctctgatttcacatcatgatgtaatcaccattggaagcttcactgttactaaattattaatttcttgcgtccagtgttctaatctctgaggctgcgcattattaagaaaatgacctctgctccgtttgcattgcagaa

SEQ ID NO: 538811 - DNA, 232 bp, Homo sapiens
tccttcggcgccgagcacagcgagtcattgccacatctgcctgtggagcataagacctgctctcccgcgtcctgagccaggccagcgccgacctggaggccaccctgtaggcacaaactaactgtcatgtcagtcagatcaacggggctgtctagagcactggattattgtgagaaacaggcagcaggactttgcggactgatctgcaataccagaataggtggacgcagct

SEQ ID NO: 538812 - DNA, 529 bp, Homo sapiens
aatattgggtgatagcgtcgagaagattagtcataaattcactgtaagatacagaacaaaattcacagttaggctagaatttagtagtatagaattttatgttggatccactgatacttttgtgaatgaggtgcgcttgaaataattgattcagcctaccaatgagctgatactttatctgtataaccaggagtctataggtttacaatgtatctagtaatcaattattcaccaataatttaggaaacagagatctacttgaaaataccatagatagatacccgttagcaggataattagaataagaagcgaatagcagctttgattgtccatttccatgaatgcgtacaagataaatctgtattttacagttaaaattggtacaaaaagtcaagccctgaagtagttttccccccaaaagttctgatgttaaaactttaaaaaacaaaaaaggagagaggtggggggtaaaaatatttttccttaaatggtggaaccccggcaccatttattttataactgaaagtta

SEQ ID NO: 538813 - DNA, 922 bp, Homo sapiens
  misc_feature (37)..(37): n is a, c, g, or t
  misc_feature (145)..(148): n is a, c, g, or t
  misc_feature (160)..(161): n is a, c, g, or t
  misc_feature (176)..(176): n is a, c, g, or t
  misc_feature (205)..(208): n is a, c, g, or t
  misc_feature (210)..(211): n is a, c, g, or t
  misc_feature (214)..(217): n is a, c, g, or t
  misc_feature (219)..(219): n is a, c, g, or t
  misc_feature (224)..(227): n is a, c, g, or t
  misc_feature (334)..(334): n is a, c, g, or t
  misc_feature (404)..(404): n is a, c, g, or t
  misc_feature (463)..(463): n is a, c, g, or t
  misc_feature (778)..(778): n is a, c, g, or t
  misc_feature (914)..(914): n is a, c, g, or t
tacattaaaaaaaaaaaatataaaaaaatataaaaantaaaataactaaaaaaaacatactaggattgacattctgtgtaactgctataaaccctttattaaacgctcctttacatttaatgcgccctatccccccccccccccnnnntaaatcttaaanntttttaaaaacaatncttaaatacaaatctgttaaagagggagnnnngnnggnnnngnttttnnnnttcttttatgcccaaagtccaatttgaggcagtttacattatggctaaatctttcagtctcaagactcagccaaggttgtgaggttgcatttgatcatgcatttganacaagttcataggtgattgctcaggacatttctgttagaaggaatcgttttccttacttttccttacgcncaagagttccgtagctgttcaagtttgtgtttcaactgttctcgtcgtttccgccacangtcctcttcagaaatgagcttttgctcctctgcttggacggacaggatgtatgctgtggcttttttaaggataactaccttgggggccttttcattgttttccaactccgggatctggtcacgcagggcaaaaaagctccgttttagctcgttcctcctctggcgctccaagacgttgtgtgttcgcctcttgaaattctcctcggtgtccgaggacctggggctggtgcattttcggttgttgctgatctgtctcaggactctgacactgtccaacttgaccctcttggcagcaggatagtccttccgagtggngggaggcgctgcgtagttgtgctgatgtgtggagacgtggcacctcttgaggaccagtgggctgtgaggaggtttgctgtggcctccagcagaaggtgatccagactctgaccttttgcaagagcctgctcttttncacagaaa

SEQ ID NO: 538814 - DNA, 997 bp, Homo sapiens
  misc_feature (333)..(333): n is a, c, g, or t
tgggctccagtgtcattggctggactaaaaccaccccggttgaactgttgtcctcctaattcctcgcaaatcgctgtgcaaggtgcctcaagtggccgtccccgttcccctttccaatcaatcgtgcggaacagcggaaggtcccgggcggtttcacgtgcgtgtcctcaacatcttcgatccgccaatctttgctcattattttctctttgtgaaaacatataaggtctctcctttgtgtgagaggccaaacagaagaggaacaccggggaacaccatcttataaaacacccccctattctctgtgtgggggagagatggccctttgtgtcnccccgagggcgcgcgcggccctcttttctctctcccagaagaaacaactaaaacagacaacacgacgtatatatatctcccgtttctctccctctataacacctctattatgttaataacgctctctcgcagagaaaatcttcgcccgacgagagaggggtcgtcttcttctctcttcttcacagcgctctctgcaggcgtgttgaggagccccctctcctttgttgtgcgaaccccgcgtcgctattcttcatcctagcggaggggcggggggcccaccctcatttggttgctgttcccccctcgtgcgccgcgccccctcctaatgatgatttgttgggcggtcggtgcgtgcgacgacccccacccaaacacatcttttctgtcgtgtggaggaggggggggggggagaaagaaaaaacaaccccccccccataatgaaaaaaaacaacccccccgctacaaataaacagggggctaggtaggagcagtgcgtctttgctccgcccgccccacatggggtggggggggtgaggctgtttggtgagccccccccccccccacaggtgggggtggggtggggggagaggagcagagcaaccacacaaccccccccgaggtggggctggggagcttaccacgatgagcaccagcccaccaacct

SEQ ID NO: 538815 - DNA, 304 bp, Homo sapiens
tgctgcaggttatctagaggatcccggtggacacggggtctcagttcgacagttgttccgggatgtgggaagagcaagagagaaatgatctaagtgatggacaaggaatcttgaaaagccagaccttcactgacttggctgacagtgacacacatttgtgctttactagtgacaagaacatgaatcttgtgacaaaggtataacaagccacgtggtcaaagaagtacctggcacagcaaaggccaaaagcagcatgcaaggctaagctgggcaacagtgggcagcatgaagcctggatgaatat

SEQ ID NO: 538816 - DNA, 235 bp, Homo sapiens
  misc_feature (88)..(88): n is a, c, g, or t
  misc_feature (95)..(96): n is a, c, g, or t
  misc_feature (125)..(125): n is a, c, g, or t
  misc_feature (158)..(158): n is a, c, g, or t
  misc_feature (222)..(222): n is a, c, g, or t
gtgtgacagacacccacagggctggactttgttcaatacaaactggcagagaaatttgtgatacaaggcgaggaggaagtggcctctnaccatgnngcagcattccccattgcagttgtggcatncgggatctgggagctccaccccagagtgggggncctcattcttgctcatatacataagaagtgtccttactctgttcctttctatcccacttttaangggggattggctt

SEQ ID NO: 538817 - DNA, 1044 bp, Homo sapiens
gtgggtgccacggccctgtgccgtggcgaaagatgccggcggatgccggaaacccgctcccggagacgcctgcctcgtcggatcccgcgcgcgggcgtggaccgggcggccggcagtcatgacccgtgtatcacttcggtgaatctgcttcgctcgttgcctagcttccccttacttcatcaccatacacagttggcagcggtcactgttgtagtatgcgtggaaggggcgctggggcggagaaggcgcgggagcccgggcccgacccgtacacctccacgacttcatccaggtccgcagttactaatcggccattctgggaaatgcgtccaggtcgtggagttcagcctactctctatagctcccagacttctgacaacggttgatgggccaccctgggaatggccacctgtgtttctgggacccctcagagtctcgtgccaagatcacacgggaccccagtcagccaaaaggtcataccatgaggccacgcgaggccagcccagaagcgaggccgagccataggacgcaccccccatgtatggtcccaacacgcctgtagtcacaagcgccatcatgcgcccttgcattgcccacccagcgcctgtgagcttgcctcatccaccaccacggcatcaacctccatcaagaccataccgtgcacacacgccaacgggccccgtagttacaccctcctatctccccaatcccgcgcaaccctttcccgttccgtgcacactcgttggcgctgaccgccttcggcgggctgcccctctatcgtcgcgagtggctcctcccagaccctctatctcacgtgtcaccccgtcctcctccgccctccgccacgcgtggtcccttcaaccgtcttccggcctcgacgacggctgcatggcgagacgccgcctgtttgcgagagcccccgcggtccttgctggaactacgtcctcgagatgggcttggccccttggggggaccccataaccggacggtctgcctccagcccgtggttgcccgctcttcggcactcctatagccgtttcccac

SEQ ID NO: 538818 - DNA, 1080 bp, Homo sapiens
gtcactggcttcaggctgacaggaggggaaacattcaatatacctctcttaagctcttactcttggcccacaagcacgccagattcccctatcttccaagagtttgctctgacgttgtttcccatttatatcagccccttctctgcccagctgctttaatgactatgccccctgtattgcttctaatcccttgctttatgtttcctctggctgtactttctaagcatttcatttaagctaataatactttgtgactggttaactttactgtgtccacttggctgggccacctgtgcccagactgtgctgggtgacacgtcatccctggactgctcctgtgcaatgtcgtccccggcatgcgcggttgcatattcagtgcactttcgcagttcaaggactgaccccttctcctccaatacatcgtggcgctggcgcccttggtccttaactccagcctccgaaggaacacttggaaaaacgaaaccacgacacttcctggaacccatcccacacagcacgcccacacggacagcgacccccttccttgcccccaccgccaccacccaccccccttctccccacacctctaactccccccacacacaccccccccccgctctcccgcacccccacgacccttgggacagcaccgtactgcgcgcctggggcccaaaattacccggccccctggcatgcgggatccacccccgggcccccacaacccctcatcaggggccagccaacgcgggccaccccggcaaggacacccctcggcgcccgaacatcggcggagacgtttccccacgatgcgccacacgcggcataccccgacgccggcacaccgcaacattcccggcaaaccccaaacaccccaaagctctcgccctatggcggccccccccataaccgccccccaaccccggacgggcccggcgacacaccaacacccccccgccgcgggcatccccatgcccgttcaccccctccaaccaccacgcggcctacccccagcgacaaccgacacgccacacaaccttctacaggcgcgcccccaaccgacgagccccggccatcacgggg

SEQ ID NO: 538819 - DNA, 1136 bp, Homo sapiens
  misc_feature (474)..(474): n is a, c, g, or t
  misc_feature (508)..(508): n is a, c, g, or t
ttgtggtgttttttcctcccttgttgccacacatctctttttaaggtttaccagggggccatattttttcttagaagaacgtgggggtcttctcacgctctctctccaaggtgttttacagaggattattgggtttatttggggggtgttttaaagaaaagaaaaaaaaagattttgtggaaagaaaccgtgtcccctatcccgggcctttcccctagtgttgggcaaaataaacacgtgttccgtgtttataatgtaggatcatatttttatttaaaaacctttttttccccccccttttccacccgccccctcttattctaggacctcgttttgtaaccaccgattttttgacacacggttataattgtcacacggatcccaaaattttggcctttttacaccaggataatttaggtaataaagaaactttgcctctagcccaggttttgccccagaaaagtccccagattnccttctgggatcccacccctggccttctcctggnaacttctgagacctgcttgtggaaggaattgcgccaatgagccttcacccttctggagagaattatagggttctattggcgcaagggaaaaagggtgtgtttcacccactgagtaaaccctatgtggccctcccactaagaaggggtctttgaaagaaatttccacgtccgagttttctttgtgtgtcacgcctgagctttcctctagctgagttgttccccaccttggcacccttctgccaccctcttggcacctagagatctccctcgaggacccccccttttcttcaaggctttctccctcccctaaccacgccggttcagggctttggagccaccttcttttgtgaaactcccacgattatttataagacgagaaagtacccagaccacgagaattctttctagcacctttgtaaaacaccacgtgaataacccttcttggagtatttttggctttatataaaaccaggtgttttaattgtaaagtataagtgccacttagaaaatgcaccacgggcatattctttgtttaagtagatttttcaatgttttacagaattacacttttccaaaaaaggtttttataatgaagttgtttattaaaaacttttgaatgatgtgttta

SEQ ID NO: 538820 - DNA, 424 bp, Homo sapiens
  misc_feature (424)..(424): n is a, c, g, or t
ggagccatgtggctccggccgtgcgcgggcctcggaccctcagagaggcgagggttcgaagggcacgagttcgaggcaacctggtccacatggtcgagacagacacaacacacgagagcacaaaattttgtggggcgcctgtcgaccctgggaaaggttctcacaaccattgtcggtggggcgcggggggccccagtacgggtttagtggcacatgggccacaagggcggttccacaggaactgcgggcacatggcaacggtgccggtgggattcctcacccgcaataaaaaacggccgggggggaaacgcgcgcgcgttcgtgaaaccaatcacagagggcgaggcacgagggcaacaaaaggggggctcatacacaggggcgtcccaggagggcggcaaatcaatgtacgccccgacgtgan

SEQ ID NO: 538821 - DNA, 438 bp, Homo sapiens
cgctagcggtcgcccttatatatttctatactagcttacctacttatacaggtaaaaataaatctataaatcttctaaaagtatgtaataatctatctaataaccctatctatctctattctttacttcgcctatcccgtacttctgtcttccagtaatccactatcaaacttctatctatctccaaatagtatcatacctaccactcccaattaatctttccattttcgtactagcgtatagtaaatgcgttaactaggctttaaatgacgcaattctccctgcgtcatggatttcaaggtcttttaatcacctatcggtttaatctctttttaaaagatcgccttcaaattattttaatcacctacaactatttaaactaaactaaaagctgtataagtcaccttcattataatctaaaaagcatagccctatact

SEQ ID NO: 538822 - DNA, 257 bp, Homo sapiens
  misc_feature (70)..(70): n is a, c, g, or t
  misc_feature (99)..(99): n is a, c, g, or t
  misc_feature (112)..(112): n is a, c, g, or t
  misc_feature (185)..(185): n is a, c, g, or t
  misc_feature (190)..(190): n is a, c, g, or t
ctttctccctggggttttcacaagaagcccaggggtcccgtatcaaggaagctgaaacaaggccacacanaagacggaactagtaacatgatccagagncgcgtggtaaggngaggagagaaggcctcaaactatgggcaatctgaacctccacaggtaggcatcgcgtcattcctgatagagcntgcgngagttttgtccagtgtgtccttatggaggtggagggactgctgggagggactctccccaaggcaggt

SEQ ID NO: 538823 - DNA, 135 bp, Homo sapiens
  misc_feature (19)..(19): n is a, c, g, or t
  misc_feature (37)..(37): n is a, c, g, or t
  misc_feature (107)..(107): n is a, c, g, or t
  misc_feature (129)..(129): n is a, c, g, or t
gcagtgaggtgtaatgcancttcatcactttattcanatcttcaaaatagtctttattctacatttttagttttctccttccacggtgttatgtgcaccacagtgtngagagagactttcttttctgancttcca

SEQ ID NO: 538824 - DNA, 704 bp, Homo sapiens
  misc_feature (158)..(158): n is a, c, g, or t
tgtaaagatctctctcccccgaggtgctggcacttggttcctttttaaccagagtgttaggaacccaaacctaaattttctggttggaccaatcaagagattaagttaactgctcatcaatgttgggtcctgggggtcccagtttgggttcgcaggtnatgtgcccctttctcgtcttgagcccagagtggaccaatcgaaagcctaagtgcctattaccctcgcttgtcctaggtccctgggtggacccatcaggaccccaagtgatagtggcccagtggtcttttagatcctcagtagaacagtccagaagccttagagccagtggccccttaataatctgggtctcacgggaccagctaggggtccaggtttcagtcagtaaataagagtggtccacgtcctaaaaacccctctcctttacaaagacttgtgatgctttgggggttttgtggccaagccccacccttttctggtcatggtacccgtacagcgtttatggccccagctcaaaggggggctttcgtgtccccctgtgcggtcagtgttttcagaaccccctctttcccgggcccacttggctatttacttatttatttattgtgtgccagtgatggtgggtgggggatgggccttcccccccccctccccccctgttgtgacctgtccttccgtacttaataaagtgggggtgggagtgttta

SEQ ID NO: 538825 - DNA, 860 bp, Homo sapiens
agagtccggttctgggacagctgggagacagtggtggtgactgaaataacttaccaaaggaaagctatttgcgaactatcttctccagcggagatggtcaagtgtgcttgtaacagagccagatctgttgccgtatctcccaggattgggctcttgaggttaaaagggttgtcattcccaaagccttattcgactgcagggatcatcaggtcggatgagtctcatgtggctgtgcacctccagatatatgctctcgatacagtgtggcctgatgaaacctagtgggacccttggacctcaagatcagaggttccagcttcctgggaagcataggtccggagtggtcagctcagtgggatctgcttcaggcagaagaaaagcctggtacataaaattggcctgatgtgctagtcggaacctttatcacagtgacaggacatgagttctgtgagggcccaatatgtgatgtgaatcccaggggacatgatgcaccggttgtaacatgaaattaccgtgcgaaacttagtttgaaagggcagagtagagtgtgcatgacagactgtcccgaattggtgcgaacgcttcgagtcctggtttccggaagtagttgtggcaaactatgtgcgcctgtgcccagacaactaagattgttgcgtgttggcttgggcagtctcactgcacgggacagtcccttcacaggtcccagggggcgagaatagccggctcggcggggtggggcgatatggcccactgtttgggttggcggtcacaccctttgacgtggcgcacccttgttcttgcgggcggcgccctgccacggggtctatcgcggtatacccctctgttggggcacttgtcct

SEQ ID NO: 538826 - DNA, 508 bp, Homo sapiens
  misc_feature (12)..(12): n is a, c, g, or t
  misc_feature (15)..(15): n is a, c, g, or t
  misc_feature (22)..(22): n is a, c, g, or t
  misc_feature (25)..(25): n is a, c, g, or t
  misc_feature (43)..(43): n is a, c, g, or t
  misc_feature (46)..(46): n is a, c, g, or t
  misc_feature (91)..(91): n is a, c, g, or t
  misc_feature (99)..(99): n is a, c, g, or t
  misc_feature (107)..(107): n is a, c, g, or t
  misc_feature (128)..(128): n is a, c, g, or t
  misc_feature (130)..(130): n is a, c, g, or t
  misc_feature (132)..(132): n is a, c, g, or t
  misc_feature (267)..(267): n is a, c, g, or t
  misc_feature (356)..(356): n is a, c, g, or t
  misc_feature (368)..(368): n is a, c, g, or t
  misc_feature (434)..(434): n is a, c, g, or t
  misc_feature (483)..(483): n is a, c, g, or t
  misc_feature (487)..(487): n is a, c, g, or t
ccgacatttcanaanactgtantangaatcacagacggcctcncanagtgctgggattacaggcatgagccaccgcgctatggacactgtntctgaganaatgagtnacagggcctttggtacctccncngnatctgctctgccccttgtacttctgctttcctgattgggtggggaagtttaggtgcccaggcacccaaggatcaaagcatcttatggactttaccatcctcctcttcagtgtgattagagaggcacagagcagcngtaaagccgttagtgctcccttcaccaccccttccatggctggctgtgccttctacgatgcacttcccaggaacgtgtccactgttccnttcagctgcttnaccgcaaatactcttgccagtttccctcggacttggaaagccgctgtccacgccttgcgcaaatanagctaaaatccattgtatcagtttcctgggatgctgtcagaaattaacntcancttgaaatggtcgccaatccg

SEQ ID NO: 538827 - DNA, 159 bp, Homo sapiens
atcctcctcctcctgcttatgggatgtgactaatgctgttacatccatccatacatgtgaaatactactcggcaacaaaaaaaagtgaactaccaatgcatacaacactgatgaaaattaaacaaaccaggagtgaggaggaattctgccgtggtacct

SEQ ID NO: 538828 - DNA, 1613 bp, Homo sapiens
tgatgaagaaggacgcgctgacgctgagcctgagtgagcaggtggcggcagcgctcaagcctgcggccgcgccgcctcctacccccctgcgcgccgacggcgcccccagcgcggcaccccccgacggcctgctcgcctctcccgacctggggctgctgaagctggcctcccccgagctcgagcgcctcatcatccagtccaacgggctggtcaccaccacgccgacgagctcacagttcctctaccccaaggtggcggccagcgaggagcaggagttcgccgagggcttcgtcaaggccctggaggatttacacaagcagaaccagctcggcgcgggcgcggccgctgccgccgccgccgccgccgccggggggccctcgggcacggccacgggctccgcgccccccggcgagctggccccggcggcggccgcgcccgaagcgcctgtctacgcgaacctgagcagctacgcgggcggcgccgggggcgcggggggcgccgcgacggtcgccttcgctgccgaacctgtgcccttcccgccgccgccacccccaggcgcgttggggccgccgcgcctggctgcgctcaaggacgagccacagacggtgcccgacgtgccgagcttcggcgagagcccgccgttgtcgcccatcgacatggacacgcaggagcgcatcaaggcggagcgcaagcggctgcgcaaccgcatcgccgcctccaagtgccgcaagcgcaagctggagcgcatctcgcgcctggaagagaaagtgaagaccctcaagagtcagaacacggagctggcgtccacggcgagcctgctgcgcgagcaggtggcgcagctcaagcagaaagtcctcagccacgtcaacagcggctgccagctgctgccccagcaccaggtgcccgcgtactgagtccgcgcgcggggcgcatgcgcggccaccctccccaaggggcgggctcgcgggggggtgtcgtgggcgccccggacttagagagggtgcggccctggggaccccccctccccgagtgtgcccaggaactcagagagggcgcggcccccggggattcccccccgagggtgcccaggactcggaaggggcgccccggactcgacaagctggaccccctgctcccgggggggcgagcgcatgacccccccgccctcgcgctgcctctttcccccgcgcggccgccccgtgttgcacaaacccgcgcgtctcggctgcccctttgtacaccgcgccgcggaagggggctccgaagggggcgcaagcctcaaaccctgcctttcctttacttttacttttttttttttttcctttggaagagagaagaacagagtgttcgattctgccctatttatgtttctactcgggaacaaacgttggttgtgtgtgtgtgtgttttcttgtgttggttttttaaagaaatgggaagaagaaaaaaaaattctccgcccctttcctcgatctcgctcccccttcggttctttcgaccggtcccccctcccttttttgttctgttttgttttgttttgctacgagtccacattcctgtttgtaatccttggttcgcccggttttctgttttcagtaaagtctcgttacgcc

SEQ ID NO: 538829 - DNA, 120 bp, Homo sapiens
gttagtcaagggcatccttctaccattgctctcagtgacgacgaagtgggattcctattcagataatccgttgctcctgttcactatcacactgctgctctagatactctgtatgggtct

SEQ ID NO: 538830 - DNA, 213 bp, Homo sapiens
tagagtgaaaagttaaatggtaggtactgggatagagatgaataggatatcgtgagcatagtgcaggtgcaacaggtggtgagctatgcagaatataatgagaacgatgggttaactgctggtgagggagaggaagtaggcctgtgctggggctgaggatgatggagatgtctcgggctgagccggaaattgctagccactcggagacacagc

SEQ ID NO: 538831 - DNA, 153 bp, Homo sapiens
agtgcataacgaatgtccagtgccatacacactgaagagtaaatagagtgcggcctttcccattacagggaactggtaagctggcatccaagagcgctaattaccagtgctctagatactacacacagatagcagtcatttaatgggaactga

SEQ ID NO: 538832 - DNA, 214 bp, Homo sapiens
tgaggtgtgggtggaagagcaagtttactctgtcgccaggctgagtgcatcatggctccatcttccaggtaatactcccacctgtctcctgaatagctgggactacaggcgtacgccaccatgcttggctaatttttgtaattttttgtagagaaagggttttgccatgttacccaggctggtctcaaattcctgggctgaagcaatcctcctg

SEQ ID NO: 538833 - DNA, 1307 bp, Homo sapiens
tggaaacaaagtctcgctcggtcacccagggctgggatgtacagggggctctattcttgggctcactggcggagtctccgcctcccgggtgttcaccgccatttctctctggctctcagctctggccaatgtgggctgggagatctggcaggcgcccgccaccacacccgggctaattttttgggatatttttaggataagaagcacgggggttccaccctggttgggccagggatgggctcttcgatcctcctgtgaccctctggtgatccaccttgcctctcgggccctcccaaggggcgggaatttccagggcgggtgacgccaccgggcgcccgggcctataaattggagatatttcttataacgcacaataaaagtgttacacggggggtgggcccatattttggcgcaatatttattttggaacaccttgtggacaggggaataactctggagaaccacggggttccgggagactgttcaatctggagaatctacggcgaggcattggggagatttaatctctccaaattctcttgggggaaaaatgtctggcgctataaactacgtgctcttgacttaacctctttgggcgtttcttaaacaccaacacacacacacaacaaaaaaacaaaaaacaaaaaacaaaaaactcccagaggaaggaaacaaaaaaagagacagcgaggggggacagaaacaaaaagagagacaaaacagaaaggccgccccaaccgggtcagcaaaaaaccatgagaagccttcagacaccccacattctcttgctgcacccccaccgggggcaagaacaaccgcaggcggggcccccccaatgaaggaggaggagacaaaaacaatacagaaaacagcgcgagttataccctctttaataaacatcttcaccagaacaacacacagccaacaacgaagacgacccagacgcaaacaatcacaggacgacaccaccacaacaactacatgtacacccaaaaaccatcacgagcacaacacaacaacgaatcacaaaaagaaacatcatcataaatatatatctctaaagaaaacaaatactatgactaaacacacaataacacaatcaataaatcaaaaaaataaaaacataaacaaaaaaataactaaaaaacaaacatcaaacccataccacactcacagaaataaaaaaaccatcagctacatcacacaacaacaacaacaaactacaccaaaacatcatgaacaacacataaaacacacataaaaaaaacatacacctcaacaccactacagcatgtactactaccccg

SEQ ID NO: 538834 - DNA, 580 bp, Homo sapiens
tcgcctcccttccaatcacccccacccccctcgccaacaatcgcgactaatattaacaaaccttaaacttttccccacagcctcgcacccccaacgagggcatctagcgggggacagcgagggtggggggcagggggtcgcgagaaaagccccggaaaggcactaaaatgccacttttgattctgccctcgctgacaacagccgcaaggaccctctccctgcccattgacgcggggctgtgagcgtctggggtcccagcaagtgaggagagaagaggttcggggggagggggaggaggaggaagatcagaaggcacccccagccacctccaccgcctaggcagcgacaaactccccgccccctccccccaaaaagtcgccaagctctcactcgtccagagtccgaggtaaacaacgagcaccacaatggcactaggactttgggggaaaagaaacccagaaaccccgacaaaactgatcaggagtttcccgaaatgaaagaggggggcgggcagcgtcctctagagtcgccctggctttcggctgggcccccgggcaggatagagggcggccgcaagctt

SEQ ID NO: 538835 - DNA, 151 bp, Homo sapiens
ttctcgaacacgctcgtggtcgttgttagcggtcccctctacctccccgatctgatgaccagcaggctgtccatcccaggacagtctcccttatactttcctaggtaaggcctttctctttgcgaacattgcttgccctgaagagggaggc

SEQ ID NO: 538836 - DNA, 798 bp, Homo sapiens
ggggttggggatgtaatgaaatacccccactgcgaggtaaaccaggtctgctgttaataaaaaatagcccccccttaaaggaaatcgcctcccccccggcaggggaaaagtggcttattctggggggagggaagggtttcctgtttagggacttggcagttcccccaaagaaaatttttggaggaaggttttcttattttttggtaaaattaaaaaggttggagggcctggccacgtcttttatgggaaaatgaaatttttgttcatataagacaagtgggaagccctaggcattaaaacgccgggcgggaagctttttcaggttcaaggtgggttaattttccagattgggggaaggggcgccggtaaaaggattagaggatctggtggccttggggggtttgaaagggttaaccggccaagcggtctatctaaggtagccaagtccttgtcattaagagggggcgcagggattataggctttagctaagggattggtaatgcctgaggggacttctttttgcaaggttcacttcctggcgttatcccctttgtagttattatggcagccaaaagcgggttcattcaaccaatagcagggagggtttgcctaacgggtatcatttccgaaggacacctattcatgcacgtaattggatgcgaccccctagcaagatctcgcattaacggtccctaaacacttatcatcttcgctgttgtaagtgaaacgagggatcctaggaatcgctgtcgccttaatgcaagcaaacgttttcactcttctagtaagcctctacc

SEQ ID NO: 538837 - DNA, 630 bp, Homo sapiens
  misc_feature (102)..(102): n is a, c, g, or t
cggggccgggtgtccccggtgtgtggcaggggtttggcgggttcctctcccccccggcgcggttgtagttttcggtttttctggcccggttataatcggcgnggggggtgcgcaaggggccgggggatccaaaaatggggggcgcccttgttttttttccccccccttgtagcggttgaatttggaccgctctggtgtgggcgcgggaaaatttttcccccaaggggccaaggccggtgggggggggttccccctcccattgggggattcccgggggggtgtcccaacgggggcacgaggggggggcccttccccctctccgggcccccttgggtggggaaaagaggttttgggaaaccccaacttttcggcgggggggttccccccccgggggggggggtgcccggccccaaaaggtttccccggggggggggttttaggggaaaggggccccccccggtccccgggtttaggggggccccccccccccctttggggtttgggcccttttttccagggggggccccccccattggggggcccccgggttttttttcccccccccccccccccccccttgggttttttttttgttttgggggggggggggggattaattaagggggtttt

SEQ ID NO: 538838 - DNA, 862 bp, Homo sapiens
  misc_feature (9)..(9): n is a, c, g, or t
  misc_feature (141)..(141): n is a, c, g, or t
  misc_feature (149)..(149): n is a, c, g, or t
  misc_feature (251)..(252): n is a, c, g, or t
  misc_feature (272)..(272): n is a, c, g, or t
  misc_feature (276)..(276): n is a, c, g, or t
  misc_feature (278)..(278): n is a, c, g, or t
  misc_feature (282)..(282): n is a, c, g, or t
  misc_feature (309)..(309): n is a, c, g, or t
  misc_feature (314)..(314): n is a, c, g, or t
  misc_feature (317)..(317): n is a, c, g, or t
  misc_feature (323)..(323): n is a, c, g, or t
  misc_feature (351)..(352): n is a, c, g, or t
  misc_feature (355)..(355): n is a, c, g, or t
  misc_feature (370)..(370): n is a, c, g, or t
  misc_feature (387)..(390): n is a, c, g, or t
  misc_feature (392)..(392): n is a, c, g, or t
  misc_feature (398)..(398): n is a, c, g, or t
  misc_feature (406)..(407): n is a, c, g, or t
  misc_feature (423)..(424): n is a, c, g, or t
  misc_feature (426)..(429): n is a, c, g, or t
  misc_feature (431)..(433): n is a, c, g, or t
  misc_feature (440)..(440): n is a, c, g, or t
  misc_feature (443)..(443): n is a, c, g, or t
  misc_feature (475)..(475): n is a, c, g, or t
  misc_feature (506)..(506): n is a, c, g, or t
  misc_feature (512)..(512): n is a, c, g, or t
  misc_feature (522)..(522): n is a, c, g, or t
  misc_feature (537)..(537): n is a, c, g, or t
  misc_feature (544)..(544): n is a, c, g, or t
  misc_feature (595)..(595): n is a, c, g, or t
  misc_feature (602)..(602): n is a, c, g, or t
  misc_feature (626)..(626): n is a, c, g, or t
  misc_feature (657)..(657): n is a, c, g, or t
  misc_feature (705)..(705): n is a, c, g, or t
  misc_feature (717)..(717): n is a, c, g, or t
  misc_feature (719)..(719): n is a, c, g, or t
  misc_feature (725)..(725): n is a, c, g, or t
  misc_feature (746)..(746): n is a, c, g, or t
  misc_feature (756)..(756): n is a, c, g, or t
  misc_feature (764)..(764): n is a, c, g, or t
  misc_feature (766)..(766): n is a, c, g, or t
  misc_feature (769)..(769): n is a, c, g, or t
  misc_feature (777)..(777): n is a, c, g, or t
  misc_feature (796)..(796): n is a, c, g, or t
  misc_feature (799)..(800): n is a, c, g, or t
  misc_feature (834)..(834): n is a, c, g, or t
tagaaactntcaatacagaaatactcctagcaaaccattgaaaagtggtgtttgtttgacaggaatttcacatcaggtccactaggacgtcggtccagccctgagtccccacccccaccccataacccccattcatgcgtnttacagtnggacaggcacactgtcatgaccaaaatcaccccaatacctggggctgatgtccagctgccagaagccatgggggcttctagcctgggctggaagccccaggnncccccctcttattgcttgantttncnagcnctccctcgctggcctcgcctgatctcncagangcnagcccnccccccgcccaccggcacaggtgccccnngcnccgtttcttcctctngggccctttgcttccannnntnttcctnggtcggannccccgcttctgccccnncnnnntnnncccccgnccngtatgaggctgtcctgctggttctagcccttnctccccctcctcagcaccctccttccctggnccatgnggctcccccnccccatcctcgttgntccaaanttatttcctgtcccagaatcaccagcttttggcagtttgggcaagtggagngtcggtnagaagaaacccccagtttttattnattaaaaacccatccacagtgctaacatggnaactgcagtgtgatctgtgatgtgatttttcaatcagggctctccctngaaatcgcctangnaagganatctaaggaaacacatcctgntgttaaactnggttcttncnagntcacttgntccctgtagttggaggggnatnnggtgtccgggctgggggtcggggagcattcatcnagtgcagatgaccctggttgttctccag

SEQ ID NO: 538839 - DNA, 951 bp, Homo sapiens
  misc_feature (3)..(3): n is a, c, g, or t
  misc_feature (14)..(14): n is a, c, g, or t
  misc_feature (24)..(24): n is a, c, g, or t
  misc_feature (84)..(84): n is a, c, g, or t
  misc_feature (214)..(214): n is a, c, g, or t
  misc_feature (236)..(236): n is a, c, g, or t
  misc_feature (294)..(294): n is a, c, g, or t
  misc_feature (307)..(307): n is a, c, g, or t
  misc_feature (313)..(313): n is a, c, g, or t
  misc_feature (315)..(316): n is a, c, g, or t
  misc_feature (321)..(321): n is a, c, g, or t
  misc_feature (325)..(325): n is a, c, g, or t
  misc_feature (341)..(341): n is a, c, g, or t
  misc_feature (356)..(356): n is a, c, g, or t
  misc_feature (360)..(360): n is a, c, g, or t
  misc_feature (365)..(365): n is a, c, g, or t
  misc_feature (377)..(377): n is a, c, g, or t
  misc_feature (387)..(387): n is a, c, g, or t
  misc_feature (392)..(392): n is a, c, g, or t
  misc_feature (398)..(398): n is a, c, g, or t
  misc_feature (407)..(407): n is a, c, g, or t
  misc_feature (419)..(419): n is a, c, g, or t
  misc_feature (425)..(425): n is a, c, g, or t
  misc_feature (433)..(433): n is a, c, g, or t
  misc_feature (435)..(435): n is a, c, g, or t
  misc_feature (442)..(442): n is a, c, g, or t
  misc_feature (477)..(477): n is a, c, g, or t
  misc_feature (536)..(536): n is a, c, g, or t
  misc_feature (547)..(547): n is a, c, g, or t
  misc_feature (559)..(559): n is a, c, g, or t
  misc_feature (563)..(563): n is a, c, g, or t
  misc_feature (565)..(565): n is a, c, g, or t
  misc_feature (593)..(593): n is a, c, g, or t
  misc_feature (596)..(596): n is a, c, g, or t
  misc_feature (598)..(598): n is a, c, g, or t
  misc_feature (601)..(601): n is a, c, g, or t
  misc_feature (612)..(612): n is a, c, g, or t
  misc_feature (614)..(614): n is a, c, g, or t
  misc_feature (623)..(623): n is a, c, g, or t
  misc_feature (642)..(642): n is a, c, g, or t
  misc_feature (651)..(651): n is a, c, g, or t
  misc_feature (653)..(653): n is a, c, g, or t
  misc_feature (655)..(655): n is a, c, g, or t
  misc_feature (674)..(674): n is a, c, g, or t
  misc_feature (689)..(689): n is a, c, g, or t
  misc_feature (694)..(694): n is a, c, g, or t
  misc_feature (697)..(697): n is a, c, g, or t
  misc_feature (948)..(948): n is a, c, g, or t
gangtttacaattnaatatttgancagaaaatctgtacacattatcatttacagcaattttacatggtaaattaactgattgtnttaaaatgttctttctaaatcgctccactctgctgccctaactcttggagtattctaaagagtctaactagtgctatttacaagtaccaaattaagaccatataacttacataaaactcattagtttaanagctcaatttaacaatgtctgncttcagaatgctgttatgacatattgataaaaggccaaaaattaagtttccataaagntattaaaggtgtntgggantnntttgntgcntataagagtagctggntctcaattggtcccntggnttacntggttaaatccnaaacagtccncctgncaagcnataactgangatgcctgtggnaaaccngttatgtngncgtgtcngcttaccctggggggcaacaggggttacgccattnggctcgctgggggggggcttcaggtgctttcttgggcttggctccctttgccatttagnacatgccaaanatactccctatncctnanattggtgtttcttgggggggtggggccnagntngtncggcctgggcngntgggctgcnaacgggggaaccgcccggnaccggtgcncncncctgcttggggcctggccngccttccgcctggtnggggnggngctgtttctcttcctggccgccagggggcagttagctcatggctgagaagtctctcaagggttcagttaaacaagcttccaaatcaaactcatcctccacttgactgtccatgtgtctcaccttggtgggtgtgccagagtacacatcaaagtcatcctgagagctggtctggggctcggagctgctttctgcagattcaaggtctacagggtgtttttcttgcaaatcacatccttcttccgctgggggntcc

SEQ ID NO: 538840 - DNA, 473 bp, Homo sapiens
gagctcggcacctggtgacccgtatccctttcagacagagaatcatgatagctatgttaaggacacttaaataactcaagctaacacagagaaggaattcagaattctatcagataatttaacaaagagattgaaataataaaaaagaacctagcagaaattctggagttgaaaatgcagttgaaagactgaagaatgtgtgttttttaatagctgaattgatcaagaagaagaaagaattggtgagcttcaagacaagctatttataagagacaaaataataaagaatgaaacatgcctagaagactctagaaaaatgcctcaaaagggcaaatctaagagttattgaccataaagaagtggtagagagaagtagaggtagaaagttttttcaaaaggaaagtaacagagaacttctgagacctagagagagatatcaatatctataactttctaagaaagttatggaactc

SEQ ID NO: 538841 - DNA, 1041 bp, Homo sapiens
  misc_feature (100)..(101): n is a, c, g, or t
  misc_feature (103)..(103): n is a, c, g, or t
agcggctcacccccaggtcctggggcagcacagggtcctccctggcccaggcgcccggtggccgagagcctgcccgcgagctcaacgctgctcaacggtnncngtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaagatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatattcggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 538842 - DNA, 128 bp, Homo sapiens
cacgagggggcccatacccggccgtcgccggcagacaagagtggacgggagcggcgggggcggcgcgcgcgcgcgtgtggtgtgcgtcggagggcggcggcggcggcgggggtgtgtggggtcctccc

SEQ ID NO: 538843 - DNA, 1075 bp, Homo sapiens
  misc_feature (100)..(101): n is a, c, g, or t
  misc_feature (103)..(103): n is a, c, g, or t
agcggctcacccccaggtcctggggcagcacagggtcctccctggcccaggcgcccggtggccgagagcctgcccgcgagctcaacgctgctcaacggtnncngtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaaggtttttggggagcaggtggtatttggttacatgaatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatattcggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 538844 - DNA, 832 bp, Homo sapiens
  misc_feature (45)..(45): n is a, c, g, or t
  misc_feature (48)..(48): n is a, c, g, or t
gcgggggagccagctccctgggaaagcagggttttggtttttttnacngaccttacttggtatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatattcggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 538845 - DNA, 882 bp, Homo sapiens
ctttgccatgtgcaagttcctgcttcaccttctgccatgagtaaaaactctctgaggcctccccagaagccaagcagatgttggtcccatgcctgtagagcctgcagaacgatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacattgaaacttcatctaaaatattcggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 538846 - DNA, 425 bp, Homo sapiens
gtgcatcacggaattctggtccgttcatcattttcttcacgttccactgttctgcgccttcctcagtgctctcctctaaagccaagacccctttgtctcctaacttgagtgaatataactataggttatggtttacctttttatttactagaagcatctttttatataaaggcttaaatgtgatagtctattctatctatttttctccttttttgcttaatgctatattttctgtcctacacgtatttagcctaccatggcctactagaattctcttgccagtgtaaaattacctataagttttatagttttcgttttcacatttaggtctataattcatgtataattaatttctctgtgtcttatgtaagatagagattcagagtcttccccagtccacatgcagatagcctgttttttcaaca

SEQ ID NO: 538847 - DNA, 884 bp, Homo sapiens
  misc_feature (100)..(101): n is a, c, g, or t
  misc_feature (103)..(103): n is a, c, g, or t
agcggctcacccccaggtcctggggcagcacagggtcctccctggcccaggcgcccggtggccgagagcctgcccgcgagctcaacgctgctcaacggtnncngtccttggctgtggctcctgcgctctggctgagccatgttccttctcctcgccctcctcactgagcttggaagactgcaagcccacgaaggttctgaaggaatatttctgcatgtcacagttccacggaagattaagtcaaatgacagtgaagtttcagagaggaaggtttttggggagcaggtggtatttggttacatgaatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaactcacaggtgactgtcatcattctgatgttatgacatactagaacattgcctgtgtagttttcttgtaaatcatgaaaggaatttagttagctgttgagtaggaatattaaattttatgtatttttctacctttaaataaaacagagcgccgaatttctttttttaatttttttcttttttttctccttcctttttt

SEQ ID NO: 538848 - DNA, 418 bp, Homo sapiens
gtcgacgggacaccgaaccgatatgcctttgtacactgtcagcgctaccgaccttccgaccataaaatgctttgctcaactcttgcttgcgaggaggactgtggttctgaagtcaagtttccagtcttctgttgtagttgacagcactgatcagtaatgagcaacgtctttcttgtagaaacacaggcccctttcttcccatgtcaacacctgatctactcgatccccaggggagatggataaaatacgtcgtggtgatgagaccataacctcaatcacctgtgtatccattggggagtcaatacaagagtcaagttttcactaacttcccctctgatagcaatctgattcacctgctcaaacacttgcagtggacagtggatatcctatttgttgtcgtgcaaatcgaccttgacca

SEQ ID NO: 538849 - DNA, 322 bp, Homo sapiens
acaggccagccataacacctggcagatcttcctggagcccgcattttactggacatgtaaggggtagcgcggcttcaaggcaaccttttaattgatccttgcgaacagttatgtgtgaaatttactgccaatctgtactggagtcgactacaacatgtgtgaccgaaatagaatgccagggcgtgcacgttctaaggtaaagcttgggatgtcagacaaattttgcatcccactgagtgtcatttaagaccacatctccattcagctgcctcccattcccagaatctgcggtcacggtcttcggtggctgtcgggctcgggg

SEQ ID NO: 538850 - DNA, 807 bp, Homo sapiens
  misc_feature (1)..(1): n is a, c, g, or t
ntcgtctggaaactactctctaatcctccaccgctacactttttggggttacatgatgatttacatcattacaattgatggacaaccttacactctacatctcggaaaacaatcattcttaccccagaactttttggtttatacatataatgaaactggatctttgcattctgtgtctccatattttatgatgcattgccattaccaaggatatgctgccgaatttccaaattcatttgtgacactcagtatatgttctggtctcaggggatttctccagtttgaaaatatcagttatggaattgaaccagtagaatcttcagcaagatttgagcatataatttatcaaatgaaaaataatgatccaaatgtatccattttagcagtaaattacagtcatatttggcagaaagaccagccctacaaagttcctttaaacttctgatgttatgacatactagaacattgcctgtgtagttttcttgtaaatcatgaaaggaatttagttagctgttgagtaggaatattaaattttatgtatttttctacctttaaataaaacattgaaacttcatctaaaatattcggaaagttacatatttcaagcttaatattttatgatgtattatgtaacattaatttttatatttttttcaaacaaaatgatactatttgaaaaagtttagaaatgcagaaagaacagagtcacttgttattctagtaccttggtaaattacgtttaatattttggtatatattctaactactacttgaacatatctttctaaaatgccagccatttgcatg

SEQ ID NO: 538851 - DNA, 432 bp, Homo sapiens
  misc_feature (327)..(327): n is a, c, g, or t
  misc_feature (357)..(357): n is a, c, g, or t
  misc_feature (385)..(385): n is a, c, g, or t
  misc_feature (397)..(397): n is a, c, g, or t
  misc_feature (430)..(430): n is a, c, g, or t
gttctgatggagagatatttgaagttgatgtagaaattgccaaacaatctgtgactatcaagaccatgctggaagatttgggaatggatgatgaaggagatgatgatcctgttcctttaccaaatgttaatgcagcaattctaaagaaggtcattcagtggtgcacccaccacaaagatgaccctcctcctcctgaggatgatgaaaacaaagaaaagccggacagatgatattcctgtttgggaccaagaattcctgaaagttgaccaagggaacacttttttgaaccttattctggctgcaaactacttagacatcaaaggtttngcttgatgtcacatgcaagactgtggcccntatgatttaagggggaaaactcctgagnggatccgtaaanccttcaatttccaaaatggacttttcctgaagngg

SEQ ID NO: 538852 - DNA, 841 bp, Homo sapiens
ggtgtgtgtggacggaattcgggaccgactgacggcggccggcttcccggaactggaaggttacattgattacccacctagtacaacatcttacgggaagagcagtagtatttcctagaggaatatgaacgataacaggaaggtatcattggctctgaattaaatttgaacttgtcccgctgaatagcgtacaggttttggaacgctgaatcaaggtcatcagatgagttagaatccaataccagagtctcctggtacagtttgttcagaagtacgtgccatcccattgggacaggggcttgtagaatcagaatgctaaagatattactgtgcgttgtccctccttacccgtgagctgaagcctcagaatgcaggcggcgtaagtgttagcagatgatactacgaaatcattctaactcctccaaggaggtcccttcctcagctgtctggagaagccttcgggtgaatgtgggtccagacggcagaggagacgagagctcagactgtacagaaatccccggaagtcctgtcccacttcagaagtcttctagcttgtagacaagatctacagcgagtgatagcacttctatctatcttcttaaagctaaacaaagcaggtctgggctcttcagctgaagcacttagagtcggtccaggatgaggccagaagattcagggcattgattcctctccagtgagaagcacagacagcagcatacccatggtcctccgggtacaggagatgcgccacgcacagacgattggcagaaacagtgacaaccggcaaagaatggaacaacagcagccatggggaaaaaggccaaccaggacacggagaagg

SEQ ID NO: 538853 - DNA, 371 bp, Homo sapiens
acagaaatttcgtttagtaactctgtaaggtggggcattgggtacaccatcaattctcattttcagcaagcaagtaaactacccaggaccactcactttagcagtggtagagtaaatacagacatggagatctcataaatccggaagtctccaattaccagatcaaatagtcttgtggtagtaataagatttccatcattcagcagatctcataccacaaaggattaatttataagtcctcatacacttgtgattgtgcgttatattgatagccacagggagatcaaaatggtttttggttatggcagatgaaaaagtctaacattcagtgtgattatagttcagtgtaacttctccagtttaagtgtgac

SEQ ID NO: 538854 - DNA, 221 bp, Homo sapiens
gcacgactgacaagatccttttaggtcattgcaacgagaccgtggtttgtactcagttgccttgggacgcgcattggagggttttgagcaggcccgtgcaggatctaatgccttccagctcctgtgtggcggcgaggctgagagggtggaagcggtgtgagaccagttaagaagctatggccaaagccagatgggcactcatgggagactctaccagcatc

SEQ ID NO: 538855 - DNA, 157 bp, Homo sapiens
caggctctctggggaactacggctctctgggtctgtcctcagaacactgcgtcatatcgtaccctggtccctggctctctgaggccctctttttttttctggtttcggagacaaaatcttgctttggtcccccagcgctgaagtgatattgttgcaa

SEQ ID NO: 538856 - DNA, 290 bp, Homo sapiens
ggccctggttagaactagtgcctgtggcgctcatcagatggactggtttgaaaacccctgtctaaaaacactccgggcaggtgcagtggctcacacctgtaatcccagcactttgggaagctgaggtgtgtggatcacttgaggtcaggagttggagaccagtctagccaacatggtgaaaccctatctctactaaaagtacaaaaattggccgggcatggtggtgcacgcctgtagtcccagctgcttgggagtctgagacatgagaatcgcttgaagctgggaggcag

SEQ ID NO: 538857 - DNA, 205 bp, Homo sapiens
ctccactggtgccatcatgctcaatttctaactggatggttccctagaggtgcactgtccccaggggtgagtggatcttgtctagacccttggctggtgccattattctacattcattatgtctgggaggtagcggtatgttgaacagtataaatctagtttgcatcttgcttacatactaacatcagaattctaaggctggggc

SEQ ID NO: 538858 - DNA, 242 bp, Homo sapiens
  misc_feature (24)..(24): n is a, c, g, or t
  misc_feature (55)..(55): n is a, c, g, or t
  misc_feature (60)..(60): n is a, c, g, or t
  misc_feature (66)..(66): n is a, c, g, or t
  misc_feature (111)..(111): n is a, c, g, or t
  misc_feature (119)..(119): n is a, c, g, or t
  misc_feature (145)..(145): n is a, c, g, or t
  misc_feature (147)..(148): n is a, c, g, or t
  misc_feature (185)..(185): n is a, c, g, or t
  misc_feature (202)..(202): n is a, c, g, or t
  misc_feature (204)..(204): n is a, c, g, or t
  misc_feature (210)..(210): n is a, c, g, or t
  misc_feature (217)..(217): n is a, c, g, or t
  misc_feature (219)..(219): n is a, c, g, or t
  misc_feature (223)..(223): n is a, c, g, or t
  misc_feature (238)..(238): n is a, c, g, or t
aatgtactttatagagatggaggnaaaggtctaatactacatagccctaagtgtntctgncaatgntcaagtgtattttctgtaacagaaacatatttggaatgtttttcntttccccntataaattgtaattcctgaaatactncnnctttaaaaagtcccactgtcagattatattatctaanaattgaatattgtaaananacttgncttaccncncaanaaaagggtacttttntatt

SEQ ID NO: 538859 - DNA, 762 bp, Homo sapiens
  misc_feature (762)..(762): n is a, c, g, or t
gactgcgaggcaggcagtgatgctgcggcgttcgcatgtggctcctgcgaccgccaggcgctgtacagtggatgcgaataaccgtaaggtatgcagcagaagcggaacccacagttcacctgtggtgcattcctttatgatgaagacttatggatccattatatgagaaaggaaaaatgagcagaaactatgtatggatgtgcagtcacaccaagacagcaattttaggtaggcacttagggttatctttccagttcagcaggtgcaactctatggaagtagaatgcgagggagattttttcgccatgttgcgaggagaaagttgcgtcattaaaaaaaaattaccgtgctcagtggacacggaattaagaggtacacttttttaacgttgaaaaaaaaataaataacagagaaaaaaaaaaacattttttggtggggcgggctttgggagcctaagagaaaaacggttttttaaaagaaccccatctctgtgtgtgcgggaggacgggggcggccccatcggatgtgatacaggcgaaaccttggggcgcaaaagaggggggcgcccaaaaggagaacacccgggggcaaagcaacacagggggggggtttctcccaccaaaataaaaaaagcgccgcgggcggacaccccgagcgtgtgcttgggaccaatccccaggagggaggtccaggacgccacaacgcgggtctcaccaacgggagtgccaagggcggcagaaaattacgaggggcggagagggn

SEQ ID NO: 538860 - DNA, 306 bp, Homo sapiens
  misc_feature (286)..(286): n is a, c, g, or t
  misc_feature (291)..(291): n is a, c, g, or t
ttttgttcctagtgaagcaagtaagtcaattaaaggaatttagatttaaagcaaaagggtgacaggacaatttacattttaaaatagatcctcctggctcctctgcaaagaagcagtttgaaagggactaagctggaaaataagcagaaagacaatagtggttttaacaaagatgataattcaagagttaaaaagaattagagaatattactacacatatatgtatgtgtgtgtatatatatacacatacacagcaaattttaaataagtattttatatatatatntctcnctacctctccccctg

SEQ ID NO: 538861 - DNA, 98 bp, Homo sapiens
  misc_feature (62)..(62): n is a, c, g, or t
aggatttgatcaagaagaagtttttgagaagcctacacgtgaaacatgaccagggcatgagngcatgcattttacgacaagctggatgatgatggttt

SEQ ID NO: 538862 - DNA, 401 bp, Homo sapiens
tccctcaccagcatcccttaaaccaaagctaatccagaggtgaagaagctgcataagaaaagtttgaagctagcactatttggttcatgaggtttaaggaaagaagctgtctccataatatagatgtgcaaggtgaggtgaagcagcaggtgctgatataaaagtggaggcaagttatccagaagatctcactatgtccactgatgaaggtggctatactaaaacaacagattttctaagtagacgaaacagctttctgctggaaacagatgccatctaggactttcacagctatgagaagtcagtgcctggcttcaaagcaggctgggcacagtggctcacgcctgtagtcccagctactcgggaggctgaggctggtggaagggagggtaccgagctcg

SEQ ID NO: 538863 - DNA, 364 bp, Homo sapiens
gacgttgcacaggctggagtgcagtggtgagatcacaactcaccgtagcctcaacctccccaggctcaagcaatcctcccacctcagccttccaagtagctgggactacaggtgtgcaccaccacacccagctaatttttgtattttttgtggagacagggttttgccatgttgcccaagctggtctagatgaccctgggcttgagtcatccgcctgcctagtgctgggatgacaggtgtgagccactgcgcccagcctcccctctgagtttccatcattacattggcctatcggctgctggtggtagcaacctctgggaggcagaggttgcagtgagtagagatcacaccactgcgctccagc

SEQ ID NO: 538864 - DNA, 112 bp, Homo sapiens
actaccgaccttcaaaggcagcagccctgcctttaacagagccgaggctggaaggcagaaggcaagcttctctctttggcgctgtgtttctagtgcttcccacggtgtggag

SEQ ID NO: 538865 - DNA, 101 bp, Homo sapiens
tgggaaaaaatccctttgtattttctgtccagggcttcagatattttgcccgaattttaaaacatggcaataaatggctcgtgggctttggctccctggga

SEQ ID NO: 538866 - DNA, 684 bp, Homo sapiens
acaacatttaaccacgcgcagcacgacttttcccagcggggccacgaaaacgcgcaagggcgaccacaacaaccacacgcccgcagaccaccacccaccaaggcaccaaaaccacgaccgaccgaaacacaccaagcgcacaacagcgcacaacagaccaacagaaaaaaccaaacgaacccaaagggaccgacacgcagcaagaaaacgcaacacaagccgccaaaacaacgacacccacagcaaccacacccgcaaaggcacaacgaggaagaagcaaacccccgaccgccacacaccaacggcgcacacccgaaaaaagagaacaagcaagaaaaaatccagacaccggagatcccccagccgacaccgcagcacgaggcacacaacaagaccagcccgcaacagccccagtgccaacgccacagaacccaaaaagacgaccacccacgaaccaacaaaacgcaaagaccggaaaaaacgaccaacgacacacagaaacccaaaccacaccggcacgaaccaggcacaacgaaaaagccaacccagcggggaaaaataagcgccaaaacaggaaacccacccccaccacataacgaaacgaccaaagaagaagggcgaacatgaccgcacgacaacacccccagcaacaggacgcaacaacaagccgagtacaagaccccc

SEQ ID NO: 538867 - DNA, 92 bp, Homo sapiens
tgggggtatccctagttaaactttgggaagcccccttcaatgttttttggaccaaggcagggacaaataaaaaaataaaactttggaaagca

SEQ ID NO: 538868 - DNA, 977 bp, Homo sapiens
  misc_feature (30)..(30): n is a, c, g, or t
  misc_feature (76)..(76): n is a, c, g, or t
  misc_feature (79)..(79): n is a, c, g, or t
  misc_feature (85)..(85): n is a, c, g, or t
  misc_feature (93)..(93): n is a, c, g, or t
  misc_feature (97)..(97): n is a, c, g, or t
  misc_feature (162)..(162): n is a, c, g, or t
  misc_feature (188)..(188): n is a, c, g, or t
  misc_feature (215)..(215): n is a, c, g, or t
  misc_feature (232)..(233): n is a, c, g, or t
  misc_feature (241)..(242): n is a, c, g, or t
  misc_feature (257)..(257): n is a, c, g, or t
  misc_feature (261)..(261): n is a, c, g, or t
  misc_feature (335)..(335): n is a, c, g, or t
  misc_feature (355)..(355): n is a, c, g, or t
  misc_feature (377)..(377): n is a, c, g, or t
  misc_feature (423)..(423): n is a, c, g, or t
  misc_feature (430)..(430): n is a, c, g, or t
  misc_feature (441)..(441): n is a, c, g, or t
  misc_feature (498)..(498): n is a, c, g, or t
  misc_feature (586)..(586): n is a, c, g, or t
  misc_feature (634)..(634): n is a, c, g, or t
  misc_feature (682)..(682): n is a, c, g, or t
  misc_feature (696)..(696): n is a, c, g, or t
  misc_feature (765)..(765): n is a, c, g, or t
  misc_feature (826)..(826): n is a, c, g, or t
  misc_feature (911)..(911): n is a, c, g, or t
  misc_feature (976)..(976): n is a, c, g, or t
cggcctgagaggtctcttgtcgctgcaggngccttagcccagctgcgtgccttggcccatggcgcctactcttacngcnccggcnctggggcnggcnctgggcctgctgcaggcgcggcgctgccggaccagagcttcctgtggaacgttttccagagggtngataaagacaggagttgagttatatnagaaaccgagctttagcaagctctctncaacggcacgtggactnnctttaatnnagttactgttaggtngatnatattcatgtttgatcgtgagaacaaggccggcgtgaacttcagcgagttcacgggtgtttggaagttcattanggactggcagaacgtcttcngcacgttcgatcgggacaactncgggatgatcgataagaacgagctgaagcaggctctcttaggtttnggctacnggctctttgancagttccacgacatcctcattcgaaagtttgacagggagggacgggggcagattgcnttcgacgacttcatccagggctgcatcgtcctgcagaggttgatggatatattcagacgttacgacacggatcaggacggctggattnaggtgttgtacgaacagtacctgttcatggtcttcagtatcgtatgancctggcctcttgtgaagagcagcacaacatggaaagagccaaaatgtnacagttcctatctnttagggaatggagcacaggtgcagttagatgctgttcttcctttagattttgttacgtggggaccagcngttcatatgttgataagctgattaatggttttgcaactgttatagtagctgtttcgttctnatgcagacattggatttggtgactgtttcattgtgccaagaggtaaatgttatgtttcaggcattctgcttgcaaaaaatctatnatgttcttttctagatgtttcttgttctatagtgcaatgcttttattagcaataggatttaaaana

SEQ ID NO: 538869 - DNA, 238 bp, Homo sapiens
gttagcaagacgggagccagtgagagtcgagggagaggtgacctcatgcttgggctggcggcgcaggcctatgggactgccaggaggtggctggggtaacgctgtcttttctaacattcagcattggctcaggcgccaggtcagggctcacagactgttgctataaagggctgggtggctttcttccccacagctactcagcctaatgccattgcagagcacttgtagccatggacaa

SEQ ID NO: 538870 - DNA, 241 bp, Homo sapiens
tagaccggtctgggatccagacactgcgatgaatgcttctccacattatttacttcactcttcacgaccctctatggtgtattacactcctatttgacagatggagcaaaagctggaggctcagagaggttaatcatctgcctaaggccacacagcatggcaaatgtgcagaatcacagacttgaatccaggtccatctgtttcaagagttcatgcgtctagccagtatcctgtggggggt

SEQ ID NO: 538871 - DNA, 906 bp, Homo sapiens
cgcgctcggtctgtatccggttgttattgcaccgggtttctccgccccctgttttcgcctccctggggtttgccccttgtggtggcgcccccccgtagtggttcctcttgccgagaacacctgctctaggttggcagtttcctcccgctggggcctggcctccgcgtgcaaggtgttcgccggcatgtaacgcacaccaggtcggccgtcattacgccccgcactatgtgcctctgggccggggcacccaatttttccaagcgcgccggtatacatgcgggtggctatgtgcttccccgccatgttctcctgccgtcttgtgtgtccccgcctttttgttccccgccgtcaacgctgccccccggcataatttacggggggcgctaccccccctgcgcccttttggtcgccccgcggctctctgggataaaatgtgttcacgccgtcccccttgtggcagtagtcactcccgcgtgcggttttagcccccgcgggaagccgcccttctggttgttagggtttccctggcaggcctcaccacacctctcaaagtaggggtgatcttgaacgcctctccctcacacaacgggggggatcaccctcgaccacaattctcccgagcgtcgagtggtggttcccgaggcagagttagggtatgcgtggaagcacacttttcggaacggtcaaggtcccagccacccatggagaaggcgcccctttgtagcctgcgcccgacaggttgtttggcggcgccccaggtccgcgcctattcattaggggcgttcgcgcggaatgcgcttgaccgccgtcccccgcattatgcgcggcggttcttacactttctcctcgataccaaggcgctcgggccccaagggaaaaaaaatctttgaacccccacatatcaaa

SEQ ID NO: 538872 - DNA, 225 bp, Homo sapiens
  misc_feature (1)..(1): n is a, c, g, or t
ngactccgccttacaatttgaactagtgaaaaaagagtagaaatatagacgagcaggatcacgttaagagagtactcagaaaactctaggttacttgcagtcatgtgctgttctccagagtactagaatatcttttattggcaatttccaacaatactgttaaagacatattgtgctaattaagcttaacactagatgtgcttaccatggtatcttttcatatta

SEQ ID NO: 538873 - DNA, 166 bp, Homo sapiens
cccttagttccttctatattgtgtgtttgcataagatattattagacatgtgcacacattcatggttcaactcttattcatctcaggaaatcaggactatggtgaatacgaaatcattgactgacatctatacatctagacacgctacaggatggaattttggaaa

SEQ ID NO: 538874 - DNA, 362 bp, Homo sapiens
ggatttagaatagtccataaatttgagggttcgagaagattgactccaatgttggaagaagttctgctgtgggtagtcaatcaatgtgacaaacttcattgttgtcttattttaagaaattacagccaggcatggcgactcatgcctgtaatctcagcctcccgagtagctgggattacaggcacctgccaccacgcccagctaatttttgtatttttagtagagacgggatttcaccatgttggccaggctggtctcgaactcctgacctcaagttatccgcctgccttggcctcccgtgttgggattataggcgtgagccaccgcacccagccctcatgtgaactattttaacgtgtcct

SEQ ID NO: 538875 - DNA, 113 bp, Homo sapiens
tctagagtatcccccgccaagtgggattcactggcatctggtagaatatccttccttcccatactagagcttcacttttccagagctcatgagaaacggggtccctacaaccc

SEQ ID NO: 538876 - DNA, 482 bp, Homo sapiens
attcgcggccgcgtcgaccagaataaatcaaggaccatcaaccaaaatgggaggtccaggactcaggaggacttaccagtttcaccagaggagaagctagaacttggtgaggtttcactgggcccctgctagtaccttagctagggttttaggcaactccttcagggtcctgagtcttctctgtggccccacgtgtttgggcaccagattattgttgaagagtcaaacactgtaaaatatttgaagagatttattctgagccaaatacgagtgaccgtggcccgtggcacagccctcgggaggtcctgagaacatgtgcccaaggtgatcagggcacagcttggttttatacattttagggaggtatgagacttcgatcaaatacatttaagaaatacattggtttggttcagaaaggcaggacaactcaaaggcaggaggcggtgaaggggacagtaagggcagggaggtccttccaggct

SEQ ID NO: 538877 - DNA, 772 bp, Homo sapiens
  misc_feature (258)..(258): n is a, c, g, or t
  misc_feature (375)..(375): n is a, c, g, or t
cctacctggtcaagtcaatcggttagtgtcccacctcgctgatagactgactacgtcgatacgcgagagaagaggaccccttgatcgaggaatggtcgatctggacaggattctatttcggcacctatgaggatgaggtccgagagtggatcgatggccgatccggactgaacccggtcatccggttcgactgctccgagatcaccgcggacatcgagtccttcaattgggtgggtctcaatctgaccgacgacggcntctggttcgaggacaccaagtggttcatcgtggatcgcatcgactctctgtccgccgagaacttccggcagctgatcacgcatctccacgacatggagaccaagctggtcatcgccntcgtgcagcggaccctcaacgacaccatcaccaagcgatccgtccaggccatcggatcggacgctgagctgtatccccgccccatcccggcgatctcggaccacgatgacctcgtggagtgggtggtgggatggctggatcgccacgacgtcggcatccagcggaagacggtcaaccggatgattgaattcaccggcaacgtggatcagactccgctggtggagctgtgcgtgaccctggccagcggcttccgaggcaggaccgtctccgccgcggacgtcaaggctcagatgggcatcgacggcaagctggactcctaccacctgatgaccacgctccaggccggagacgcggagagcgccatcgacatcatccgtcgggctgacatcgaacacct

SEQ ID NO: 538878 - DNA, 162 bp, Homo sapiens
cggggctccgaacgtgtactttcaaagccactcctctctgtctgcccctcaaactggaaattccatgttactactccgcacaccttaggtttacttatttcatgttacagatttgtttgttataggctgggcacagctggctcacgcctcatcaccccagca

SEQ ID NO: 538879 - DNA, 803 bp, Homo sapiens
gtctgccgcgttgccactacctgtttcgcggcccacagagcacgtcctccatcagattggccggagccatgggtgtgagaagagacctaggtccaggtgatccagactaatccccgataaatcacccattgcttaaaaagcaggctcgaagatggtctatctgtttgttatcctcgccgacgctcctgtggattcaggatttcatgtctgtatacacaaaactctaatttagacgcgcctgtactatgtagctgagtagaaccaatggagcagcattgtccattctagctagagcactatagtgtctcatgcctcgataatgagagagaggagaagtgagtagcacagtggtcacccagatgtgaccccaacatagctggacatcgtctatgggactcccagagtttacaatgtcaggcaagactatcagtcacttggtgcaaggataaggtcctcctgtggtctcccaatgaccatgccgggatttcagccaaatgcttgaaaggtttgaggaatcggtgcttgcatgactccaatgagggcgttccctgatcctgcacttgtccacccagtcagcacctgcttccagggagcacctaggatcacacatccgggcctcctcactcctcctcctccatcacggcagagaatcagctcctttgaagacctttggctcctctcaatgcctgacaaggagcccagagactgatgcctccagcctcctctggggaggcagcaaaactcttgggaagcatgaggaaggacggataactgaatcttgacggcgaggggtgcaaccatct

SEQ ID NO: 538880 - DNA, 366 bp, Homo sapiens
tttttagaggcctcccggtgataactgttgcctgattggtatacaggaggaccagcaaaagggtgctcgccggtgatcagggtgatctgatctcgaaggcttgcttgaggatacgcacagtcatgagcttcttgccgttgtcgcggactgagcatcatcatggagataagagagtgcgctccacaatgggacactgaggcttttgcaggaagcgtgtggcggaataccgcccctgcactgtgaggcaggtacttggcatatttctccttcactgcaatgtaatcctgcagggaaatgtcaattgatcttgacatcatcggttgctccagttcccaaagagcttgatgtctggggtctctgccaccg

SEQ ID NO: 538881 - DNA, 949 bp, Homo sapiens
cttagcgtccccaactggaaggcatgacgcatatgaatgaattcgccatcgtggactgttaaggagcggcttgcccagtcttatccagcggttctatggaataactgctcttgtgcaatcggccgatatatttacatagataaaaggcaattatttacccacgggccatttctgagatcctgtcgtgttaggtgcacaccacatcccatcggtagtacattcttgcatcatctggtaattggcgtatccggcacgctctcgtgtctcgcgggaataatgcctcctctaagcacccagtagcgatgacggcacaggccgacgcggccccaggttaggtacatgtcgagccactcgggtgctatcaggctcgtcaaccttaagcgaaccataccctgtcgtgacaatcagagctcagagcgatgcgattacctaccacccaatgagcaaaaatggcccccggccgcgcaggagcctgaaggccggtgtgctcgcttcaaatcatgcactaaatctggcaggtgcgactcgagcgttcagtgtaactaaggagtcctgatctaactcatcgcagagtcaccacaatgctgaacgatgactgattacatactaacatttacaggtcccgacctcgggggcacaactccaactccagagaagcccacagcccagacaatatactacaacgccgaccacccagacgcgcgtggcgttcccaagccaaccacgactaacacacactcgccacaccaccgatcccacctcctacggccgaacaagccaggccaacctgcacactcattaacctgcagcaaacccggcgactagcaccccatgccacgacctaccaccgcggcacacggaagaccactccacaaatccaacccacactgcgtccccacaccagacaccctagccgacgaccacggcccccccccgcccccgcagcacc

SEQ ID NO: 538882 - DNA, 203 bp, Homo sapiens
gaatgccggaggcacaacgggtgggcgggcgggggctcaccagtatatagtgggcaggatatggagtgatacgttttcagacactctgtacgccaagaaagccgagcagtgaggccagcagtgggccagtcgacggaagacaagtcctcatccaaggacatgagctccccgacagaccgtcatcctgacggctattgtagcca

SEQ ID NO: 538883 - DNA, 214 bp, Homo sapiens
  misc_feature (9)..(9): n is a, c, g, or t
cgtccccgnggtatgtcttacggagagacactcggtgtggctgacacaagggctctggagtcagacggctgggagatgttgggcaggttcctcaacctctctgagcctcagtttctttacttaaaaaatgaggataatagtgaaatacacttttcaaaagtgaggaatgaggagttcccccgtggcgcagtaggttaaggatctggcattgtcg

SEQ ID NO: 538884 - DNA, 146 bp, Homo sapiens
acgtgcctgtggtagaagtggcatggcttgaatcttaagcgaaagcctatatcactgctcccgctcatcaggggattgccatcgctaggtttatatatagttgggttgttggtgtacatgagtgaggcaggagcccgaggaggtta

SEQ ID NO: 538885 - DNA, 777 bp, Homo sapiens
gaaaataattttttccccaacttatgttctcgtctatactttcctgtgttgactacaattgttaggtgacataatcttcccgtttagacatttaaaataataagtttaaaacaacgtctgaaaaactatttccatgtcctttatatagattattttgtttaagaatttattgtacttggggataaaggaaatacatccatgaactatgtcactaagagctatgtttgaggaagtaagtctttactatattgagttagggggtttgataactttaagtttcttaattttattttagtgattaagactggagaacagtggcatgatacgtttatccggcgttcttacaaaaaacaaccgatggacttgggtccagtctaatgcacgcctgctttataacaactggaagaccagattatatcattgtaactcagatgaccactaacgtaagcgacaaagtaatgtttcctgttttaacagtttggtttgcataagtcctcttatgtgaaagcatagaaataattcaagcagactttagtctgtaaatacccaattgaaaagtttaattcatctatgaaagaagagcacaggtgagagacattgagaagatagaattgacgaacttgattgagagctacatgtgcagagctatagaaagaataataaaagtctagggtttatcttgggcatatgaaagacacatgaaaagctagtgtcttgataaacgaaaaggtagctaaaaaaaatttttgggcaatgggctcgaaaaggttttaaaac

SEQ ID NO: 538886 - DNA, 102 bp, Homo sapiens
  misc_feature (99)..(99): n is a, c, g, or t
  misc_feature (101)..(101): n is a, c, g, or t
tgctgagcctcgagccaccgcgctcagtccaaaacttcttttttttttctagtgtgtttcttcctgcaatacatgtttctccctgaaatgtaaccattncnt

SEQ ID NO: 538887 - DNA, 265 bp, Homo sapiens
  misc_feature (241)..(241): n is a, c, g, or t
agagagagacacacacactctggagagagagccccagggtgtagggaggagagagagttaacaggagccggctttttgtcttttgggtctccctggacttaaggaaggggagaataggagcccagactaagattctcaaaatggtttattacccagactctttgtctgggtcagtcaggaaccatttccaacagggacatggagggaggcttctagggggacttcctgtcccaaggaggtnaacccagagcaccattagacaaac

SEQ ID NO: 538888 - DNA, 199 bp, Homo sapiens
  misc_feature (73)..(73): n is a, c, g, or t
  misc_feature (108)..(108): n is a, c, g, or t
  misc_feature (127)..(127): n is a, c, g, or t
acacggtaccccgtaggttgtgattcgcaacgcctttgcctgcttcgacgaggaagcctcaggtttcatccantgaggaccaccttccgggagcatgcataccaccantgggtaccgcattacagantgaggaagtggacgagatgtccgggaggcacccattgataagaaaggcaacttcaactacgtggagttcacc

SEQ ID NO: 538889 - DNA, 480 bp, Homo sapiens
aaaggggagggttgggggcttccaacaaatttggagatagagggggggaaaatgccaagtcccgatttttttttaactttgttcaaacaaaccgggttttgttcaaaaaataaaagaagattaaaattggaagaagttggtaaaaaggggaaagcccggggttcccggttgttgtcaaggggacgcgttcggggggggcccgaacccgttgtttggtccgaggtccgtttgtttgtccggggtttttaaagggaggggagggggttttgggaagggtttttgaagccgttgtcggtttaaagttttatttttagattaaaaaagaaaaaacggggagaaaaaaattccaaccccaacatttttattaaaggcaattttcttgtgccgaatttttgtagaccgggggattcattagttttaaaaggggcggaaacgcgggggaggttaaattttttggttctttaaggggggttaattttc

SEQ ID NO: 538890 - DNA, 102 bp, Homo sapiens
gaagacgtacggctgggacagacaggcgagtagtgccagcatcatggccagctgagagttcttttctctccccctcgctgtggagtacatggtaagaatctt

SEQ ID NO: 538891 - DNA, 303 bp, Homo sapiens
cacagaaaactagaatttcatttattttgtttttaaaatatatatgttgatttcttgtaacatccaataggaatgctaacagttcacttacagtggaagatactcgaaccgtgtagaggcaatttaggaacttgggggctactccataattccatatgctgcatcaagagttcccagcaggtactccaagctatgatttccaaaaccggaagttattaattctttaataacccctgaaagtcatgaacacatcagctagcaaaagaagtaacaagagtgattcttgctgctattactgctaaa

SEQ ID NO: 538892 - DNA, 329 bp, Homo sapiens
tctatccctgagatatcacatatagaaataaggatcgacataggtcagggatagaggtcacacctactatcccagcactttgggagaccaaggcaggtggatcacttgacagccaggagttcgagcccagcccggacaacctcgtagtaaaccccatctctactaaaaagacaagacttagccagacgtggtggtggacgcctgtagtcccagctactcgggaggctgaggcagtgagagtcacttgggctcgggtaggtggaggctgctagtgagcaagaggatcatgccattgcataccaacctgggtgacagagccagcttctgtc

SEQ ID NO: 538893 - DNA, 234 bp, Homo sapiens
ttgcctgtgtcgtgggatactatccctaatgaccttttaaggccgtcgtaggtatctgctttataataatgatgtaaatacctattctggagaccggtacacagggactgccctttaaatatttgccagattttgaataaatgattttattgtttactgaacatttcctgttattccatgttctgcgttgaatggctgctttagtgactgctcaatgccaagccccagctgcgg

SEQ ID NO: 538894 - DNA, 161 bp, Homo sapiens
gtaatgcgttcagcgacgccagagtctccaggcatcgggcttggattcccactccagcagtccagaggagctgcgcccactttatgcctgagaatactttcacagaatgatggccggttcactcccatgctcatcgcagatctcaaagaagttctcctcgg

SEQ ID NO: 538895 - DNA, 528 bp, Homo sapiens
  misc_feature (475)..(475): n is a, c, g, or t
tcggtacccatcagcacatggtgctcgacgtgcgatcgttcaccaagcagattcacaccaatccaagatcgctgtggcttgtgcacccgggaacacccgatccaactgcgctggcgacagcccccacagacggctgagcatcccgctgaacaggctgcggtaattgttgagcactgggtaatcgcgattctgcagcagctgcgcctgttcgaccgccagctgttcgccagcgatgcgaccgccgcgcaagccacctcccagcacccagtacgtggtgccgtgcccgtgatcggtgcccttgctgccgttctcgcggaaggtgcggccgaattcggagatgacgaccaccacggtgtcgttccaggccgggcccaacgcatcggcataggcagccagcccttcgccgagattgcgcaggtttgttggccaggccaccttccacgctaacctggttggcatgcgtgtcccaagccancgacatcgacgaaagcccaggcgatagcgctcgcgcatcaatgtggccatgcg

SEQ ID NO: 538896 - DNA, 251 bp, Homo sapiens
cgcactacttgtcccatgctactcaggaggctaaggtggcagggtcctttgagaccatggtcctttgagtcgaggctatagtatgccatgatctacgcctcttaatagacacgtgcattccaaactatgcaacataatggcagtcctgtctctaaaataaatcaagtacagtcagaaaatatttggctgggcgcagtgatcacacctgtaaccccagcactttggaaggctgaggcaggcggatcacctga

SEQ ID NO: 538897 - DNA, 261 bp, Homo sapiens
actgcctcgatggggcccaggcagagacttcacaggtcttcatggcttcccttcatgcactacacaccttccggtctgaattcctttgtctctgcgggttccatccatccctttttacaacctcggtcagagtaacagagcgtcctgcgggtgggatactcgggacacaaccgctgctcttggccttctgttttgagaaacgttgtcatcacgaattaaagagttcccctgctatggggaatgtgtagtctgcgttgtggc

SEQ ID NO: 538898 - DNA, 104 bp, Homo sapiens
ccgagccgacgcaaggccatagtgcgcgctacagcgcctcgcactgatcagattggagccctgcgttctatcgtgacgtgcaaagccgtcgccacatttcattg

SEQ ID NO: 538899 - DNA, 664 bp, Homo sapiens
  misc_feature (565)..(565): n is a, c, g, or t
tacaaaaaattagccaggcgtggtggtgggcgcctgtagtcccagctacttgggaggctggagcaggagaatggtgtgaacctggggggcggagcttggcgggaactcgagaggtgcaccagctgcaattccagccgtgggcgacagagcaagactctgtctcgaataagaaaaaatgaatagaggacacaaaaagaaacatgtgtgtgtcgggccgtgctgtgcgaccactagaaaaagagtatttgtagaaccaatttggtctggggggagcgcggggcgcccccgataggggtataaggtgaaacaacgtgggccacacggggtgggtcccccaaaggaaagaaacctggggacaaggaccaataggggggggtggggactcttctccaccccaaattaaaagacgcggccgggggggccaacacgaggggggttgctgagaccaaaaacccgaggagggaaggagcctcagaggaggggccagtaaaccgggcccctatacacacaagaggaggcgccccaaggagaagcgccgaagattattaaataataccgccgcggncgggggggggagcagaggcggacaacgagagacacgacaaaaaaaggggtgcacaacaggagaaccagcagatacaaaaatagaccgcacggggcgagg

SEQ ID NO: 538900 - DNA, 642 bp, Homo sapiens
gctcagaggatcccccaacgcgctcacaattgagtccgattattgaagtagaaaggcagatttaaaaacagatagactatgaggtgtgagtatgaaagcctttatgttttaattcagagggctgtcccatgctatagattctctctcctgtagtaactcttaccaaggaggaaaaatgtagaggcctgatagaagagaaaagataccttttaaccatcttagtccacctggctaaaaagattttataggtgtctttagctttacccccacctcagtgttcagctgggtcatttgaggccaggtgggaactgggaattaaatattgtattagtacagactcttgactagctccaggtaaggttgaacctttggctttaagcctcaagtactacattgttttcttccccgtgtgcataggtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggtaggcctttgcttagatttgcttgattgatttggttatgccagtatttgtgttagatgtcgtgagagggg

SEQ ID NO: 538901 - DNA, 2204 bp, Homo sapiens
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (392)..(392): n is a, c, g, or t
  misc_feature (2019)..(2019): n is a, c, g, or t
  misc_feature (2098)..(2098): n is a, c, g, or t
  misc_feature (2109)..(2109): n is a, c, g, or t
  misc_feature (2142)..(2142): n is a, c, g, or t
  misc_feature (2195)..(2195): n is a, c, g, or t
ccgggggccagngcnggntgctgnctggcggccaacgggccaggtaggatttccgggagaggctgctgtggaggctgaggaggcggcggcggagatctggaaacagtatctcacctccctaaactggttaatagtggcatggaagatccatttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgtnggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaaccgagaaaattaaccgtcggctcactagaaaanctcaagtcaaaggccaacttgtccgcttgaactccttgccaggaagattcctgaggtttaatgaatatgtagagggtanaggatgctcangattatgaccgggcgaagccgaacaaaaccctnggaccaaaacttgacccctgcttggacaagggttgccctttagggaaaaggantttaaattg

SEQ ID NO: 538902 - DNA, 2384 bp, Homo sapiens
  misc_feature (255)..(255): n is a, c, g, or t
  misc_feature (572)..(572): n is a, c, g, or t
  misc_feature (2199)..(2199): n is a, c, g, or t
  misc_feature (2278)..(2278): n is a, c, g, or t
  misc_feature (2289)..(2289): n is a, c, g, or t
  misc_feature (2322)..(2322): n is a, c, g, or t
  misc_feature (2375)..(2375): n is a, c, g, or t
ctcgtgtttcctgcacgccagctctacacagtgtgcattctggaatgacaggcattcctgtgtgaagagtgccagtgtgaagacagttttgtaagaactgcaagtgctcaggctgtatgggaaacagaaacttcagcagatgaactgaccttatgccatttcctgatgtttggcagtgacactgaaagaggaccgcatgtcccctctttatgtggatttatcttttatgaaaagtttgcttttgtccgggacagnttgttgtcgtgagatacatcagacaatataatcatgggacaagctgatgtctccagaccggtaaatccagatgcagttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgtnggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaaccgagaaaattaaccgtcggctcactagaaaanctcaagtcaaaggccaacttgtccgcttgaactccttgccaggaagattcctgaggtttaatgaatatgtagagggtanaggatgctcangattatgaccgggcgaagccgaacaaaaccctnggaccaaaacttgacccctgcttggacaagggttgccctttagggaaaaggantttaaattg

SEQ ID NO: 538903 - DNA, 120 bp, Homo sapiens
agtgcagcagtgcagtcagtcagcaatgtttcagtgcagcctcagggtgtttgtgcagtgtccacattcagtgcgcatgcagtcaggggcacagggcagcctcactcatcagcttggggc

SEQ ID NO: 538904 - DNA, 157 bp, Homo sapiens
gggaacggacttccacgccgtctcgcaaggcgcggtgtcggtcactgccgttgcagtgtctgacctgactcgaacatcgcacgcatgccgctagtggtagacagatggatgggggcatggggggcgcagtcgtgagagcctgggtactcgagcctcg

SEQ ID NO: 538905 - DNA, 2232 bp, Homo sapiens
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (420)..(420): n is a, c, g, or t
  misc_feature (2047)..(2047): n is a, c, g, or t
  misc_feature (2126)..(2126): n is a, c, g, or t
  misc_feature (2137)..(2137): n is a, c, g, or t
  misc_feature (2170)..(2170): n is a, c, g, or t
  misc_feature (2223)..(2223): n is a, c, g, or t
ccgggggccagngcnggntgctgnctggcggccaacgggccaggtaggatttccgggagaggctgctgtggaggctgaggaggcggcggcggagatctggaaacagtatctcacctccctaaactggttaatagtggcatggaagatccatttgacttctccagagaaccttggaacagttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgtnggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacaccagaagaactagaacaacgcaatatattgcaacctaaaaatgaagctgatcgtcaggcagaaaaaccgagaaaattaaccgtcggctcactagaaaanctcaagtcaaaggccaacttgtccgcttgaactccttgccaggaagattcctgaggtttaatgaatatgtagagggtanaggatgctcangattatgaccgggcgaagccgaacaaaaccctnggaccaaaacttgacccctgcttggacaagggttgccctttagggaaaaggantttaaattg

SEQ ID NO: 538906 - DNA, 2216 bp, Homo sapiens
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (392)..(392): n is a, c, g, or t
ccgggggccagngcnggntgctgnctggcggccaacgggccaggtaggatttccgggagaggctgctgtggaggctgaggaggcggcggcggagatctggaaacagtatctcacctccctaaactggttaatagtggcatggaagatccatttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgtnggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaaagttccagacgatgaagaagaagaggagcaaacctgtccatccacattcagtgaagaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacatgatgaaaccctgtctctgctggaaatacaaaaattagcctggcgtggtggcacgcatctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtctta

SEQ ID NO: 538907 - DNA, 197 bp, Homo sapiens
  misc_feature (128)..(128): n is a, c, g, or t
  misc_feature (138)..(138): n is a, c, g, or t
ttgtgggtaggacagacttagaggctgaggctggcatctgggggagccgcagcccctgggggtggcagggggcatctgtcaccaggaggaaggaagaggcggttctgtgcaggaaagggagcagctcngggggcacangcaggattcggcctagtgagctggaccattagcctcggagtgctgtccccagcatctcg

SEQ ID NO: 538908 - DNA, 2157 bp, Homo sapiens
  misc_feature (12)..(12): n is a, c, g, or t
  misc_feature (15)..(15): n is a, c, g, or t
  misc_feature (18)..(18): n is a, c, g, or t
  misc_feature (24)..(24): n is a, c, g, or t
  misc_feature (392)..(392): n is a, c, g, or t
ccgggggccagngcnggntgctgnctggcggccaacgggccaggtaggatttccgggagaggctgctgtggaggctgaggaggcggcggcggagatctggaaacagtatctcacctccctaaactggttaatagtggcatggaagatccatttgaggaagcagaccagcccactacagagccaggcatggtcctggacagtgtggaagcaggagacacaacacctcctaccaaaaggaagagcaagttctcaggctttggcaagatcttcaagccctggaaatggaggaaaaaaaaaagtagtgataaatttaaagagacttcagaagttttagaacggaaaatatctatgcgaaagccaagagaagagctggttaaaagaggggttctgtnggaagaccctgagcaaggtggtgaggatccaggaaagccaagcgatgccatgttaaagaatggccataccacccccatagggaatgccagatcatctagtccagtccaagtagaggaagagccagtaagattagcaagtcttaggaaagctattccagaagaggacctaaagaaacgactaggctcaactggaagccagcctaattctgaagcagagtctgttcctgagaatgtacccaaaccacctttacttcctcccaaaagacccttgtcctcttctcatgaagcaagtgaagggcaagcaaaggatgccacttcctctggcggcacggcaaggttcatcatctccacctccatcaccacagcacccgctgccaccactgctgccacaagccttgcaaagactgttaatctctctgtcaccccttccccagcacccaggactctgcctgctgctcctgccagcactaacactactgctaccccaagcctcactcatatggtccctgccaagcagccccctatccctccccctaaaccagctcacagaaatagcaaccctgtcattgctgaactgtcccaagcaataaacagtggtacattgttatcaaaaccgtccccacccttaccacctaagagaggcattccatcaacctcagtacccaccttggagtctgctgctgccatcaccacaaaaacaccaagtgatgaaagagagaagagcacgtgttctatgggctcggaactactaccaatgatctcacctcgctctccgtcccccccactgcctactcatatacctccagagcctccacgcacccctccattccctgctaagacttttcaagttgtgccagaaattgagtttccaccatccttagatctacaccaggagattccccagcaggaagatcagaaaaaggaagtccccaagaggatactggaccagaactttggggagccccatataccctctaggctgcctccactcccactgcatattcgaatccagcaggccctcaccagcccacttcccatgactcctattctggagggttctcacagagctcattcgttgctttttgaaaacagtgacagcttttctgaggacagcagtacgctgggtcggaccaggtctcttcccatcactattgaaatgctaaatgacacctacctcagtcattcctaaattaccacagtgtctacgggaggaagaagagaaggagagcgactctgattcagaaggtcccattcagtaccgagatgaagaagatgaagatgaaagctatcagagtgctctcgccaacaaagtgaagaggaaagacacactggcaatgaagttgaaccacagacccagtgaaccagagttgaacctgaattcttggccttgtaaaagcaaggaggagtggaatgaaatacggcaccagattggaaacacactgatccggcgactgagtcaaagaccaacatgatgaaaccctgtctctgctggaaatacaaaaattagcctggcgtggtggcacgcatctgtaatcccagcactttgggaggccgaggtgggtggatcacctgaggtcaggagttcaagaccagcctggccaacatggtgaaaccccatctctactaaaaatacaaaaattagccaggtgtggtggcgcctggttgaggcatgagaatcgcttgaacccaggaggtggaggttgcagtgagccaagatcatgcctactgcactccagcctgggcaacaaagtgggactctgtctta

SEQ ID NO: 538909 - DNA, 228 bp, Homo sapiens
  misc_feature (5)..(5): n is a, c, g, or t
  misc_feature (18)..(18): n is a, c, g, or t
  misc_feature (54)..(54): n is a, c, g, or t
cgggncttgaaacaaggngccgctctacaactggtttttttaggacttgtgagnacacagcaacggaatccatccacaaaggatgcagtccccaacttgttactgcgccttgaatagtcatgtgataatttactgaagaaatctagtgttactttaaatttttttcataaaagtttactaattaatgtaggttaacatttaatgttttatagcaaatacttcaaaaaa

SEQ ID NO: 538910 - DNA, 281 bp, Homo sapiens
cggccggaacctttggggccggcccctcccagggcccccgctccgtgggaaaaaacagctcctccctttccttgaaaactgggcgattttttaaaatagattaaacttccctggaaatgagtaacccggaagttcaggggagggggccgggtccttcccgggcctggggggttggagcccccccggtcccccacctgccccttaaaaaatgcaaatatttgttgtgccaaaaatcccaaaccttttcttttaaaatagttgccttttttggtcagcttcca

SEQ ID NO: 538911 - DNA, 321 bp, Homo sapiens
gataccaatggtgtaaaggcacctccaaaggcaggactggactaattccaagcaactatgtggctgagcaaggcagaatcctattgatcaatccattgcatgtaatccagcaaaatagaggctacttgcagctggttgagcagagtgtttggacaatcagagtgggctgttaactggctctagtacaaagctggcaatcactgtccttatactgggccttgccacgggggaccacaaagcatataggtggaaatgctgatttacatctagccaaaatattgtaacgtgaaccagccagcaacaatgttgggcagaatacag

SEQ ID NO: 538912 - DNA, 326 bp, Homo sapiens
aaaaacccccccgggggcaccaggtttttttttccccccttttttttccccccccggggcccctggggtttttgggggttaaaaaattcgggggtcccccttaaagggggaaacccccccccccttggggggggggggaggggggggttttttttttggggccccctttttttgggggcccccccccccttttttttacatttttgggggcccgggggggggcccccccccttgggcccccgggggggggggggcccccccccaggggggggggtttttttttttttttttccccaaaaaggggggggtttaagcgggggttttta

SEQ ID NO: 538913 - DNA, 935 bp, Homo sapiens
  misc_feature (303)..(303): n is a, c, g, or t
  misc_feature (495)..(495): n is a, c, g, or t
accccctccggcaagcgcaggaaaaaaaagaaagagagaaacacaaggttcgcgcgcgtacacacggacccgactacccgcacaaaaggggcttgggaagcttatacacccgcgccccgacacagccgctacagccaaggacaaccggtccgggccgggaccatccggccggctccggctggaggacacagcctgaatacgggaacagcagggcaacgatccgctgccacacgccagtgctggagcttccatcgcctaggtcgcggggccgcacggggcaaggcaagctcgggtgctggcccngctcctgatccccggcgccgcctgggccgccgcgggggccccattcttgcccagcgccaggcagagctccttaagcgctaggttctcccgcagcagctcctctggcggccctccagctcggccagcttctgccaacagccgcccaggtcctcgcgcacggcccgggatgcttgggtcccgaagagctgccancgtgcgtgcggcgccgctccgctggcgctccgagtccaggaagcagcagagggtgcgcagctcacggttctctgcctgcagacgccggttgagctgcttgagctcgcggatctcgcccaggtggccctgcagctgccgattcacctcctgcatgaggcggccgcagctgcaccagtgccgccaggcgcagcacagcacatcactcccgccagcaggcgcacgcactagccatcttccattgcactagcagcacagcacatcgtccatcagtcacgtcaagcatcactcacaggccagcacatgccatcaggcacatcacaatggctggtcaggcactctggagcatcagcaccagccacgccagcacagcaggcacacatggagccaccacgtcagggcccggcgcacactcaggctcagggctccaggctcacagcacc

SEQ ID NO: 538914 - DNA, 272 bp, Homo sapiens
ttttggtatggataatagagacggagttcaccaggtgggccaggctggtcacagactcctagcctcaagtgaccggtgcgccttggcctcccaaaatgcttagattacaggctaagccactgtgcccaacccaaatatagttttcttaagtttagtgttcgtacaatatatacttttttactattttactttcaagctgggtgtgtctttatatttctaagatgtttctggtaaacaaagtaacctgagattttggtgctctgtcttctaat

SEQ ID NO: 538915 - DNA, 1187 bp, Homo sapiens
  misc_feature (107)..(107): n is a, c, g, or t
  misc_feature (187)..(187): n is a, c, g, or t
  misc_feature (1187)..(1187): n is a, c, g, or t
cactactcgagcccacagagccgatctgtcgtgcacgacggattcctcgcttatatacgcgagtacccggtcatgcaagggcggtgcagccgaatggcagtgcaatnccgccagtgctgcgtgaatcagcagagtgcacacgggagaaccagagagttcagaatgatgtgtatggcaccgaatgaanataggtcagcagatttgcgttcacagtgactgtgctgcccagagtcggtgtagcggctgctgcactgcaggcagtgagtactggggttgacgccagagactacgtgagcatgcgttgttgcccgggcgtcacagggagtgttcctggaagatacgaattggccagtgggaggcaaggtataaccggggtgtttgacggatgaggtagatcagcgattcccgggtagcgtgggtgtgagcaccaaggtagaaccaggcatgcggtgatagttcgtccaagtctggcgcctgggggacatggtgaggcatggctgtgatggaaacgtagcgtgcaaagcgtttcttccgtggtggccagatgactatcaatggcattctatcccattacccggccgaggagacagatcatgctggtatcaagaagaccgggcgtgggtttggcatgccatcgatgatgctaacctccttgtaagcatgttatctaccggtctgctgaagctctatggccgggagcagacctattacctgaacctggatcgagctcttcctgcagagttcctatcagactgagatcgggcagacctggagctctcacagccccagggcaaggggatctggtcagatcactgaacagaggtacaaatctatggtcagtacaagacagtttctactcctttaacttctataggctggagcattactggcacgaatgatgggaaaagggcacgccatgcaggcagacaccggcgggcaaaggcgggagacactgagaatacgggaggacagctgaacccttggtagcccagtgtacggaaatttgggcggtgttcggaaaaaagtgtggtgtgggcaagtggggaggtacccaaaggtagatatgagaaatggggaaaaggtgagagcgaaaagcatagaggaagtaagattaagagaaagcagtctttaaacagccacatggggcacaagaaagggggaaaatataaggacatcgtgttttgtgn

SEQ ID NO: 538916 - DNA, 190 bp, Homo sapiens
ggactcccgactagccgacagggctggggtgtctgcggacaggtgttgctgatctgcgtggacgggtgtgatctgctgtggataggggtgtggatgatgctgcggtgaccttgttgtgatctgccatgacgtgagtgtgggcgatgctgcgtggacctgtgtgtggatgctgctgtcgggctagtcgggg

SEQ ID NO: 538917 - DNA, 833 bp, Homo sapiens
aacccgctctctcgggagcgatggattacacacaacacaaagatgttcccctcacaccaaatggggtggaagggggcgggagagaaggattgcaatagaccccgcctcccatgttgacacagtgccgtgtcccaacagaccagacatcgctacttggggggtcgcccacaagggcagatgcttgtgtctgtatagatgtctcatggacatattatattgagtatagagagacataacatagatgacgccgcgtgaataggccatatcagagggggtggtagacaaatacactcatccatttggtaggtaacatcacccgcgctgtgctgttagaagagaagagctcgtcccgtgggttgtattatattatacagacagaggaggtgagttagccgtcaatagatgtgttatggtctaagtaaatcttcttctaggcaggcttcacacgctgttctactaagacgctcccagtacaattctcactcagggggacgctcacactctagagagatgagcaatctgtgtggccccccacacacacactgtatgactgtatgcttggtggcaagacagagagataactctgtagttcctctttacttattgctccctctcaagagggtatctgtggtacacaggtgtctgtgtcgcccactccctcaggtcaaaacaacggtggggggttagtaaacgccttagtcaccggcacttcttttgtgctgaagttaggttcgtgtcccctatagggtctgtcctacaccaaggttttgcataagacgaggcaaaacaaaagaataacttagcagcaaccagcggcaagataaatgtcagag

SEQ ID NO: 538918 - DNA, 797 bp, Homo sapiens
ccgtgttcgttgttcaacgggttgtgataatatccgttgggggcgtgggagtggggggaagtcaaaaagggggaagcccgtgtgtttctggtattatgagtgggtagatactgagaatgggtcgtgtgctaactttttgagcaaactgtttgtttctgttgatctacattgtgttagtttggtgtggagcgcgcgttggtgtatgcagtttgatttgagagtggaattgccttgtgatacagtgttagtaacgggccatgaggattaatggtttcgctggtgtataacgatttgtatgttgtttggtgtgctgggtgtgtaaacataattgggtaaggtggtcttaattaacttgttgtactgtcattgattaattatttgcagtaaaagttttatatacaaccattgcatggtttggcttgttgatgtatccctgtgggtgaatattagctacttgttggggcccaaatgggagataatggctggcattgcactctcccgggtcttttccccttccctacgagctagaaacgtgtttatcagcaagtccgtgagtcaaactggctgccttttaaaaacccacaaaatgctgattcagttcaaaattaatgcaaatgtttcaaaaggtgggtttctgatatttgtaaatgtgtttcttgtattagagtaagagtgtattacccattaaagtcattagtataatattgctttgcataaagacatggtagacgaaactataatccagcatctgttagtgcattggaaaagactggcaaagtctggtggagtggttggaa

SEQ ID NO: 538919 - DNA, 88 bp, Homo sapiens
agccgcaggagtagccgccgccggagccgcgcgcagccatggccgagtaacccagcttggagaaccaccgcatcaagagcttcaagaa

SEQ ID NO: 538920 - DNA, 358 bp, Homo sapiens
gcacgagcccacagttgagttgggtttaaagaggcgagccctcctagagtttgcaaaaaagttgagtttgggttgggcacagtggttcacgcctgcaatcccaacactttgggaggccgaaatggggggatcacctgaggtcgggagtttgagcccagcccggccaacatggtgaaaccccgtttttactaaaaatacaaaaattagccaggcatggtggcaggcccctgtaatcccagctactcaggaggttgaggcaggagaatcgcttgaatccgggaggtggaggctcccgtgagccgagatcgtgccattgcactccagcttgggcaacaggagtgaaactttgtttcaacca

SEQ ID NO: 538921 - DNA, 1211 bp, Homo sapiens
ggtctcgagtttttttttgattatttgtaaaagtttttcatttttggaaatggggtttacacccgttgtcacccaggctggagtgcagtcgcacaatccgggctcacgggaacctcgcgcctcccgggttgacgccattctccaggacctaccgcctccggagtagctggggactacaggcccgtgcctctgcgcccagctaatttttggtatttttaagtaaaagacggggttaacaccggtgttacgccaggatggtctcagatctcctgacctcgtagatctggccctcctgggactccccaagtgtctgggattacaggcatgagctgccgcactcggcccaggtatcttatatttaaatagaacaagagacacgcgggaaggaaccacaggtccagtgtgaggacagggggtcatgggtagacacagaggtggactgggtctctacctcctacacatggggctacacaagggacacagaacaagattcaaaggcccttgcaacaaagagaagccagagtccccctaagaacccataggggaaggccgtagaggaaatccgggactctcaggcgacacacagagggcaagagtgggcaatccacaaggcgcacaaacaaagagcacgagtggccaccagagcatgtaacacagcgggtgaagacctccaaagcccgtgggacaacagggtggacacaaatcaagccttagaaagtaagcaccccaccaaattacacacaccgagagactcagtagaacctccccaataatcaacagggagaaaacgcaaaagattcccagaaggaaccccacaggaaacacacaaagggaggcaaaccgaggcacagcaacaggacatggcacacacagacaggaggggaaataggatggggacggggcacaacgcgagagtacacattcatcaaagaggcaaaacgggagacacaggaggcagccaagggcacaaggagacccccccaaaagcaaaaaaacgcacgcccatcataccctgcgggcgcgaaagacagtcttagcagccaagagggcgaggcggatccagaaaggtaccagcgccaacatcgcggagccccaaccacaagagagcagaacaaccataggcactggagcggccacgtaaaccagcacaagaaaggcggcatcaaagaggtggcgacaacctggcgcacaggggacccgggaaagacaca

SEQ ID NO: 538922 - DNA, 491 bp, Homo sapiens
  misc_feature (201)..(201): n is a, c, g, or t
  misc_feature (367)..(367): n is a, c, g, or t
  misc_feature (389)..(389): n is a, c, g, or t
  misc_feature (461)..(461): n is a, c, g, or t
  misc_feature (470)..(470): n is a, c, g, or t
tgcccatttatgagggctacgcgctgccgacgccatcatgcgcctggacctggcgggccgcgatctcaccgactacctgatgaagatcctcactgagcgtggctactccttcgtgaccacagctgagcgcgagatcgtgccgacatcaaggagaagctgtctacgtggccctggacttcgagaacgagatggcgacggcgncatcctcctcctccctggaaaagagctacgagctgccagacggcaggtcatcaccatcggcaacgagcgcttccgctgcccggagacgcctcttccagccctcctttcatcgggtatggagtcggcgggcattcacgagaccacctacaacagcatcatgaagtgngacatcgacatcaggaaggacntgtatgcaacaacgtcatgtcggggggcacacgatgtaccctgggatcgctgaccgcatgcagaaagagatnacgggctgnaaccagaccatgagtaagata

SEQ ID NO: 538923 - DNA, 252 bp, Homo sapiens
  misc_feature (221)..(221): n is a, c, g, or t
ggtgactctaaggatccccgaggcgggcagattgttgagtcaggagtcaagacctgcccgggcaacacattgagactctatctctacaagaaattaaaaattagccggacatggaagcatgcacctgcagtcccagctacctgggaggccaaagtgggagaatcacctgagcccaggaggcggaggccgcagtgagctgtgaccgtaccacgttactccancctgggcgacatagttggaactccaactctc

SEQ ID NO: 538924 - DNA, 340 bp, Homo sapiens
cagtcatgtcctacgtcctgcctcgcaatgagggagcatgtacccaggtacatccatgaactgcggcagttttgggacttattgctgtttcagctttaagggtgttgtgtttttggtttttaattaacaggcaacataaccaccagtgttagggattaatgtggggcaccttcttattgggatgtcactgtaattgcctacatttctttgctgtaatataactgcctaatgggtggtcaaccatttaatctgaatttggaaatctttctgggttccggataaattctccttcatatgggggttaatttagtaaatgttagtgggctctcctttattctct

SEQ ID NO: 538925 - DNA, 389 bp, Homo sapiens
  misc_feature (49)..(49): n is a, c, g, or t
  misc_feature (57)..(57): n is a, c, g, or t
  misc_feature (175)..(175): n is a, c, g, or t
caagcacaggcatcaagctgtactccattcaacaggacctgggctgtgntgcaagcntgggtgtcatctcagataaccttctggtgaccggcggccagggctgtgtctccttttgggacctaaactatggggacctgttacagacagtctacttgggcaagaacagtgaagcccnacctgcccggcagattttggtgttggacaatgctgccattgtctgcaactttggcagtgagctcagcctagtgtatgtgccctctgtgctggagaaactggactgaaggcaggtcaagtacgctattccctttcccccatcccaaggtggggcacaggggatagcaactctttggacctagactagaggcaatagctgactctgaactgttgtc

SEQ ID NO: 538926 - DNA, 159 bp, Homo sapiens
ttgtatgggcacagaaattcaagaccagtatggaccacagggtgagaccctgcctctggcaaaaatacaaaaattagctgggcatgatggtgcatgcctgtggttccagctacttgggaggctgagatggggggatcacgtgagcccaggagttcgagg

SEQ ID NO: 538927 - DNA, 733 bp, Homo sapiens
  misc_feature (1)..(1): n is a, c, g, or t
nagccttatgcgtccaagccgtgtccgcttttgaaaatcgcaccgacgtgtttatctcacattctcaccttctgggatttggcgctctttgctatctctccccccctatttctttggtcttttgtgccccctcccattccttgcgaatctgctttcaatacaccaacgagggtctcacagagtccccccctttccccgctcaaactcatctggcgcccccacagggggtcgtgtgaccctatcgagggtactccccacattcggcgcggcgtaatttttttccacagtctcctcaaaaaactcctccccccgtattgttcgctaaggacaccccggcgggccgctttgtgcattcccctgtgcacgggtcgccacatccggggttggtgtcctccccgtttgtgacgcgccccccctccccgcgtttattatgtgcacctcccccgaacactctttcgactcaagagaccgtgccccccaattagggtttataaccacgagacccaatattcccggacacgttttaacacccaacaccccatttctcccggacaacacaggaccccggggtgatatataccggtccaatagcctctttaaaacatttttggagacccaacacccccatgttcatcccccctcgtcactagaatttattcccccctaaaatccttttagaataggcgccctttttcccctcgccccccctttcccccctttgggcccaaaaaaa

SEQ ID NO: 538928 - DNA, 1739 bp, Homo sapiens
ttttctcctgattttcgtagctacgtgttgtattctgcttgtcttgggctctttacggttggtccgcctttttttgcttcgcgggctggttgttttttcacgccgggtgctgtttttttctcctccgtggatctgtgcgtcggggtggtggacgcgctctcctcctgtgttttttcatcgtggccgcccgagtggtgttggtgtcctcctctcctggctgctcggtggctctagatgatttccgcgagtggggttgcgccggggggtctctctccccccttcgtggtcttgtcactcctagttgttgcctcccttcttggtggggctttcctcctccccctcccgctttattttgcccgctccgctggggttgtacacacacaggggggtggtgtgccacgtcactctttggctcctcttaatagactcccctaccctctcgtgggggttctctactccgagggttgtttgttttcttctcctcccctcgctgcggtcgggggtgtgtccttcctctctcctcctgctgtgctgccttctctgccgtgggtttagtcaccatccacctcatgagcgggggtctcccctctcgttcgatgggggggggagccccgcccccatcaatactggtttcgtgggagggggttttttatcttttctccccctctggtgtcgtctctccttctttctgtggtggggggggtgtagaattttctctcctctgcgctctctctcctctactccgaccatcaggggggggtgatagttttttctccttgcgtggctctcgcatgagtgttgttttgcccccccgcctcggacgccagctggggggggcgccccccacatatcggtgcgcggagatgttgtttggcgtcgttgctacactagagtgcgctctcacagagagaggtggtctttgtttgcacgcgctttttgatacttggggcggcaacttcgctcgaacacacacgtttcttttcttgtggcccccatctctcacagagggtccctctgttttggtggtctcccctctcctcttttctcctctctggcggggtttgtgtccactctctctctctctgagagggtgtgcgcgtgcgcgcctctctctgtcgtttcttttgtgagagaaatctctctcagaggagttatatatctctcttccttctcttggggcgcctcgctcttgtgtctctctcacacgagagagattctctccccggggggggcgcgctccgcgcggggcgcgcacacacctcgtcgacacatggtgcgcgcataaacgcgcgtgtcgggcgcctctctcggccacacgtgggcactctctagatatcttttctctctcctctccgcagacccctcgggggggccccacagcgagtgggctccgcgcgagagggggtgtgtgagaggggtgtctcacactcggggccctacacagaagacacctatctatcttggcggaggcgcgcgcgagatatataagaactggcgcgcgcccacagagaaaaagagccggccacacaaaaccgggcgccttcggcggcgcgttatatattgggcgtttctttctcctcccttctcccccggagcccccaacctttctcctgctcccccccccccacctcctgttttttataggtgattttaaattattgtgctcggggttggggagagggaccccggggccctggggcccgggattttttttttataaaaaaattgggaaccaccca

SEQ ID NO: 538929 - DNA, 208 bp, Homo sapiens
tcttttgtgccccgtgccccttttaccatgtcccctcggaggcgctttccccgggcagggcgagagctggtctggggtcccgcctctgcccgggtcccgccgccgctatgggaggagggagccccctcccaacccgggctcgagcggcggcggcctcaggcgagaggtcatcatggaactaattcgctgaccgacccagcggccgcag

SEQ ID NO: 538930 - DNA, 982 bp, Homo sapiens
gaatccgcttccatccgtcgcgcagaccctgccggagccgctgtcgctatggatgatcgagagggatctggtgtaccaggcgaagatggacgagcaggcttgagcggatacagacgaagtggtggagttatttgaacaaagattgcatgggtagtggctgtgagcgctgacggttgaggaaacgatgacctcctatctgttggagtataagacctgtgagttgcagctatgacagagcctcctgtgagagtaagtcagggtagccggttgaggtcagtggaggcgaaagaatagaccttggccatggaagaaggatcgacgctagatggtgattcgggattatcggcacaatggtgttgagacctgaagctataagtgaatcttgtccgttgacgtttctgtgatggtacgtgcactgagacctactctctatgttccatggccagcataatcactggcgcggaggtccgaaccgattctcctgattataaaactgaaccgggtgactaccagcaggtgtcttggctcagatttgccacatgtaagactggagaggaggggaggctgcggagtaacagactaggggcctatgaatgctaggtaggtgagaatgtggccatgtaccaggaaactgtgccacccaatcggcattgctatacgacttgaagggtctttgctctcaaattttggccggtaatctaatacggaaaattctttttattcccccttgaagcgtggcctgcctggtttcgggtatagccagttttgtgcgtgcatggccccttcggcggaacctgggttaccgccgaggttggacaggaaacagctgttccagggaaccctttcaaactttatccacaccacggcgtggcacgggaatattcctgagcacatgtgcctcctcgaacaattctcggggggcccgtcggagaacacaagaaaaaaaagggcgggcggggcttggggcgcaaccaccacctga

SEQ ID NO: 538931 - DNA, 174 bp, Homo sapiens
gccccaaccaggggcctgggccagcttgcacgcctgaaagagactcggtcacggagccaatctgagttgactttgacgcaggaggcagttcgcaggacttctcgttctacggcctatggcgatcctactttgggttggtcacatgtgagatcatcccccactagcctggattcc

SEQ ID NO: 538932 - DNA, 203 bp, Homo sapiens
aggattggtttgtcagtgtccccatcgactctctggggctgatcacttagttttttggcctctcctgcagccgtcatactgttccaaatgtggcagcgggacagagtaccctcttcaggcccggtcatgatggaggtccagccacagggaccatgagctcagtggtctggaacaagctcactagatcgatcctccttgacctg

SEQ ID NO: 538933 - DNA, 488 bp, Homo sapiens
aaggttccagccagttccaagtgaagacaccacccctggacatcaagaagctacccttcctccactagatagagcagggtgagagttccatgatccccaataggtagggactatgccccaagccagcatgaagcagttacagaaaaaagaccatcggtccctctgcctcccataaagatttatggggatcacatctcttgaaggggcagatgaggcaggaaaatagggtctgaagtgtgaagatcgattcacacttcagctataacaggaaatatcctctccatagggtgtatgactatgtaacttgaatacttcatcctctccatttacataaggtgtatctgaagtaaccaatggaatcctctgggggtaaatgccccacaattctgtaacgggacctttgagcccctacgctccgcctgctcccacactgtggtgtgtatgttcattttcaataaatcccttcattccttccttaaaaaaaaaaa

SEQ ID NO: 538934 - DNA, 103 bp, Homo sapiens
atctctgggcaggacttctgggctggagctttttactcgcgggggtgatctttttggctggaactttagcagcagcagcagcagcagcaccacgaattcgccg

SEQ ID NO: 538935 - DNA, 303 bp, Homo sapiens
aataatgacggccacatagcaaggcatcttagaaaaagacacaagctggacactgtgggctatctagacctcgaactatactacaggactatgttaaccaaaacagcatggtgcataggcacaaaaacagggacataaaccaatagaacagaatagagaacccagaaataaagccacacagctatgattatctgatcatcaataaaacggacaaaaacgagcaatggggacaagactgtcctttacactaaatggtactgggataactaactagccatatgcacaagattgacactggacccc

SEQ ID NO: 538936 - DNA, 401 bp, Homo sapiens
  misc_feature (370)..(370): n is a, c, g, or t
  misc_feature (399)..(399): n is a, c, g, or t
ccagggagtttcagatgcctttgagaaatgaatgaagtagagagaaaataaaagaaaaaccagccaggcacagtggctcacgcctgtaatcccagcgctttgggaggctaaggcaggcagatcacttgagaccagcttgggcaacatggcaaagccccatctctacaaaaaacacaaaaattagctgggcattgtggcgcacacctgtattcccatctagtcaggaagctgagatggaagaattaattgagcccacgagttcaaggctgcagtgagtcgtgattgtgccactgcacttccagccggggtgacagaagagaccttgtctcgaaaagggatcttgaaaaacaatgggaaccatgcctttctnatttctaggaaagttattttttcaactgntt

SEQ ID NO: 538937 - DNA, 180 bp, Homo sapiens
ataagagacggaagaaaaagagacaaaacaaacaacacagacaaaaacaaaaagaagaagaaaaacacgagacaacacaaaaagaaaaagcaaagaaaaacaggagaacaaaagaaagaaacaaaaacaagaaaacaaaagctcacaaaagaggcgagggagaaggagagagggaagaga

SEQ ID NO: 538938 - DNA, 285 bp, Homo sapiens
tcctttttttgggggttttttccccccttgtgggtggccgaaaaaaaagggttttagggttatccccttttttttttgcccttaccccttttttcccccagaggggaggggggcccttggccccccctttaagggggggttttccttttttttttcccccccgggggaaagggccccgtttttttttaaagccgggggggcctattttgagggtgggggttgaaagcccctttttcccccccctccccccctgggcccttcccaattattccttttttgggccca

SEQ ID NO: 538939 - DNA, 155 bp, Homo sapiens
gtttaccaacctgggcagcaaatggagctattaatagacgtgtcctatgcgctgatatatcacaacccttacctcatcgtccacatagagaaacagtcacagattgctactcaccccacacccaggtcaagtccaatgctggtacgggatgctgt

SEQ ID NO: 538940 - DNA, 316 bp, Homo sapiens
tgcagacagacgggacttgaattactatcatccaattatttggagaggaagagtgtgtgtgtgtgtgtgtgtgtgtgtgtgtgtgtgtgtgtgtgtgtgttgggggctgtaaacatgctctaggtctaggagtgaaggcgagtgtgggttatccagaggaggaatgtgtacagaggcatgtgttctcttcgggatctgggtggctttgtggcatcagaacagtgtgtctggaagtatgagggagagggcgtacccttgcttctgatttgggccaggggatttgtgtgattttagacgtatatagagactaacatgt

SEQ ID NO: 538941 - DNA, 129 bp, Homo sapiens
cttgaccccacgccctagcctaatatagatcggctacggcgttattagattcgcttggcgcttggttggaaacgggtgtgaagcagccttctgatggatgtattttcgcgttgttgaataaggattcaa

SEQ ID NO: 538942 - DNA, 141 bp, Homo sapiens
attatgttggttgaatctagagtgatccccagtttacccacaaacaggtcattattaccctcactgtcaatccaacacagtgcattctcattagtgaaagtgttaaaaacaatgtaaaatgggggtacctgagctctgaat

SEQ ID NO: 538943 - DNA, 127 bp, Homo sapiens
aatcatatcactgatattgttacagactcctacgcaaaatcctttgcatgtgcagagaagtttgcagcagaaaaaacagcagcttcagcttctacattatcatgtgaatctaaactctagacgaata

SEQ ID NO: 538944 - DNA, 404 bp, Homo sapiens
aatagcatccacagtgcaggggattatagattaagccaccgtgcccggcccattcctgtctttttaatttaatctgctcgtccctgacatcgaagatggtcttgcttaacagcttccacttatgtctcggaatagacctttttctgcaggaagggtgtagttgattcaaccctcacccactcatgccaaccgtagtgagtgctgtgactgcagctgcactgtttatcctgcttttctgcaggctactttttccaggtgtaccagttccaaccgtgcacaaaccgtcacactttaaagtgcacaatttcttggctaagcctgtgaaactgtctggctgctggcctaactatgagcaaacacagctatttatacgacaacgatgaactctgggcaggcagcagagc

SEQ ID NO: 538945 - DNA, 1063 bp, Homo sapiens
  misc_feature (440)..(440): n is a, c, g, or t
tgggtttttatcccgcccaaaattttttatttccttcaaaaattttgattttcccccggggccccttttacccccagtcgcggtcttcgtgttgcggcccgcccagtctttggtgatttcttctcttctctcagcaagttgggggagagggggaataccttttccctgcgggaaagaagaaacattcacggtggttgtggtggccctctgtggcaataaaaacaaaatgtgttggcgaaaacgcccagagtgtggcaacactgtgtgtgtgcgccagtgtgggatgatttttcttcccgtgtgtgaacccccgcgtttaaaagagatcccgcgggggcgccctctctcctgtgtgtgggggtgatctccccccacaattctcttctcctgtgggtgttggccccctctccggttccccatatgccagcgggtgtccccgnggtgctcgacaacttgtgaagagaacaatcgaagaaaaatctgttggcgcacaggctcttctatataacctacacctcagagagaggggggactacattccccctttggagagagggggagactcggggggaaagcgagagaagtgggggcggggcacatattctgagaggctcccacaagatgagaggggagataccccttgtgtggtgcgcccccaaaaagagaaatctctttctcacaacctgtgtgggcgccacaacattgtggtcactgtggggggccccccctatgagggggtgataacacacagatgtgtttacaggagaaaacgggacaccctgtggtgggggtgtctcaataagaacttacagagggagaaaaatttcttctccccccgcggtttgtgtgcacacaaggcgtgtgatatagaaccatctcaatagagatctctcccccagggaggggggaggaggggctaattatactacggtgcggagcacctttgggcaaccagaagttttataaaaagaagaacgccgggctgtgattaggaaaaaaattttttcttttaaatctacatacaccctccggtggaagagggaggacaaatatataaaagttg

SEQ ID NO: 538946 - DNA, 775 bp, Homo sapiens
  misc_feature (2)..(2): n is a, c, g, or t
  misc_feature (70)..(70): n is a, c, g, or t
  misc_feature (72)..(72): n is a, c, g, or t
  misc_feature (93)..(93): n is a, c, g, or t
  misc_feature (96)..(96): n is a, c, g, or t
  misc_feature (100)..(100): n is a, c, g, or t
  misc_feature (114)..(114): n is a, c, g, or t
  misc_feature (129)..(130): n is a, c, g, or t
  misc_feature (137)..(137): n is a, c, g, or t
  misc_feature (158)..(158): n is a, c, g, or t
  misc_feature (160)..(160): n is a, c, g, or t
  misc_feature (162)..(162): n is a, c, g, or t
  misc_feature (214)..(214): n is a, c, g, or t
  misc_feature (225)..(225): n is a, c, g, or t
  misc_feature (229)..(230): n is a, c, g, or t
  misc_feature (235)..(235): n is a, c, g, or t
  misc_feature (244)..(244): n is a, c, g, or t
  misc_feature (247)..(247): n is a, c, g, or t
  misc_feature (252)..(252): n is a, c, g, or t
  misc_feature (256)..(256): n is a, c, g, or t
  misc_feature (258)..(258): n is a, c, g, or t
  misc_feature (262)..(262): n is a, c, g, or t
  misc_feature (285)..(285): n is a, c, g, or t
  misc_feature (300)..(300): n is a, c, g, or t
  misc_feature (302)..(302): n is a, c, g, or t
  misc_feature (310)..(310): n is a, c, g, or t
  misc_feature (313)..(313): n is a, c, g, or t
  misc_feature (367)..(367): n is a, c, g, or t
  misc_feature (401)..(401): n is a, c, g, or t
  misc_feature (421)..(422): n is a, c, g, or t
  misc_feature (432)..(432): n is a, c, g, or t
  misc_feature (434)..(434): n is a, c, g, or t
  misc_feature (445)..(445): n is a, c, g, or t
  misc_feature (458)..(458): n is a, c, g, or t
  misc_feature (493)..(493): n is a, c, g, or t
  misc_feature (500)..(500): n is a, c, g, or t
  misc_feature (544)..(544): n is a, c, g, or t
  misc_feature (554)..(554): n is a, c, g, or t
  misc_feature (603)..(603): n is a, c, g, or t
  misc_feature (688)..(688): n is a, c, g, or t
  misc_feature (697)..(697): n is a, c, g, or t
  misc_feature (743)..(743): n is a, c, g, or t
tnttctgctgtggtgtggcggtttccctttcctcgggggagtgttttccgtggtttgttgcccttgccantnacaaaaatgttggaaagtcgngtngcanagctgttgccattngcatctttcacgtgnnccacgtnaaaagatccagggtgcctttntntnttggtgttcacaccaattcttcctaggttagcacctccagtcaccattcacnggttaccagtntcgnncttgntgaaatcanttntcttnccantntccnattcaatctgaatggtattattnaccttgttggggggntnggggtagnggntggtgcgggcatcatgagttaccagatgagggattccttttgtgcccacaaagntctttctcactttgcacaacttgtactagaaaantacaagggttagccacattnnttccatcttncntgttctttttnaccctatacaggnaccatgggttccctaactgctgcagattaattgtnacgctgntcgttctttccaccctcaagtgtttgttgcataaagcccttctntaggctcgtnctcctaacatccaccattgccctccactcctccaatgtaaatgccactncagtttcccaggctctttaagccttatggggccctgggaattcttcccttcaactcaactttatcttaatggctccctgtacatnacgactgantattgtctcacaaacaagcaattacattaccagttcatccaatcancaaatacttcacatagcatttcaattttggat

SEQ ID NO: 538947 - DNA, 186 bp, Homo sapiens
acccggtgtcgtccactctgagctcaggtgatcaccttgcgctcgcccgtccaaagtgctgcaagttacaggcatgagccaccgtgcctggccgagacacattttaatagcatatatccagagagagaggacgtatttgtggaagatgttatgaaagcaagtaaagcacagtgatggccaacatgg

SEQ ID NO: 538948 - DNA, 1005 bp, Homo sapiens
tctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgagggatccgtttcctggctttgagccctcacaccctggatccttgactaataggccattatgctgtgaatgaacaaccccacagaagcctttggccctaaacgttgcataaaggcgctgcttgctgattctggctgcaggactgtccctgcaaggttcagtgggtataatgacccctgtgagagtggcactttagagtcacacagtcatgaccctagaacagcggacatggtctgctatacac

SEQ ID NO: 538949 - DNA, 196 bp, Homo sapiens
aagatactcactcttcagaatatgggataactcgtgttattgagatagagtaacgctctatgttgcccaggctaggagggccgtggcatgatctcggataactagcaacctccacctcggatcgctgcaaccttcaagtaattctcctgcctcagcctcccgagtagctgggaccacaggtgcccgccaccatgct

SEQ ID NO: 538950 - DNA, 842 bp, Homo sapiens
  misc_feature (762)..(762): n is a, c, g, or t
  misc_feature (769)..(769): n is a, c, g, or t
  misc_feature (799)..(799): n is a, c, g, or t
  misc_feature (828)..(828): n is a, c, g, or t
  misc_feature (838)..(838): n is a, c, g, or t
tctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactggaaagggancctgaanggaattcggtttttccctgggctttttaanccccctcaaaaaaccctgggaattccttngaccctaacnaaag

SEQ ID NO: 538951 - DNA, 413 bp, Homo sapiens
tgcaaaagggctatgtcttagccctgtcataatccccacttttaaaggacaaataaaagatcttccctgacggagttaaccttcccaatcccactacagctacactttcccatgcaccttggcaaatgtgtaacaacttccatttctcagaagattgtggaaaagaaagaacgcactttcaaaataccacaccttttattcctgaccataagaacagttgagagaaacacgattcctccatcagttaagagtattttaacaggatcttacctttattttcatctgtctttacaacttggacaaaatctcttctaatgaccatatttgaatgcgggagcccgtttctctcggttttcatcaaagatccagaggttgacccgagcccgtgtgatggcggaaagtcagtgcgtatt

SEQ ID NO: 538952 - DNA, 484 bp, Homo sapiens
  misc_feature (19)..(19): n is a, c, g, or t
tgacgggcagtgaatcganctcggtaccagggttgcttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaaccaagcaaccctggtacca

SEQ ID NO: 538953 - DNA, 235 bp, Homo sapiens
aaattcattccagcgtaagaatcttatttttaaactataagaattctaggctgggtgcagtggctcacgcctgtaatcctagcacttgggaggcctaggtgggtggatcacttgaggtcacaaattcaagaccagcctggccaacctggtgaaaccccgtctctactaaaagtacaaaaatcagctgagcatggtggtgggcgcctgtaatctcagctacgctggaatggaattg

SEQ ID NO: 538954 - DNA, 641 bp, Homo sapiens
tctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttgcatttgttgctgattctgtatttagtagccataggaaccaggtcttgtaattgtaagtacactttcaacaaaatcagatcagaccagatggaagagtaaatgca

SEQ ID NO: 538955 - DNA, 638 bp, Homo sapiens
tctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagttaaacaagcctccggaaactcttatcactactattgattactagtttccagcttggtggaccaagctgggtgatcccgtgccatctctgcacgtggccgtcgccttgcatgtatctgcctatacatggcagaaggactgaa

SEQ ID NO: 538956 - DNA, 209 bp, Homo sapiens
agcaccagtctgcatcatggtccaatgacccgctaaaagcctgtgaccgcatttacatgatgccctgaatcctctaccgaacagacacactgactgagtatgcctagtgggaggactacgtggcctgccgccataccaacacctacagcctgcccaaccaattctatgacacaggcttctttgtctacgataacgccgtcttctacaac

SEQ ID NO: 538957 - DNA, 951 bp, Homo sapiens
tctcttcagttgtctgctactcagaggaaggggcggttggtgcggcctccattgttcgtgttttaaggcgccatgaggggtgacagaggccgtggtcgtggtgggcgctttggttccagaggaggcccaggaggagggttcaggccctttgtaccacatatcccatttgacttctatttgtgtgaaatggcctttccccgggtcaagccagcacctgatgaaacttccttcagtgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataagattctgccaacgttggaagctgttgctgccctggggaacaaagtcgtggaaagcctaagagcacaggatccttctgaagttttaaccatgctgaccaacgaaactggctttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgagggatccgtttcctggctttgagccctcacaccctggatccttgactaataggccattatgctgtgaatgaacaaccccacagaagcctttggccctaaacgttgcataaaggcgctgcttgctgattctggctgcaggactgtccctgcaaggttcagtgggtataatgacccctgtgagagtggcactttagagtcacacagtcatgaccctagaacagcggacatggtctgctatacac

SEQ ID NO: 538958 - DNA, 1004 bp, Homo sapiens
tagatcatccgattgacgcgcggcgcagtaggtaagtgagtatggtgataactgtgtcctaagagatcctggtcatgatagtgcttggatctcacgaataaaaaaacgcccgcggagccgatcgtgctgaatagttccagatgtactacctgaagtcctaatctggtagtctatcgagcagtgaggtccgaggtgcagcgtcgatatcatggatgacaacctccgctctctgatgaggccttgctgaagaggaatcaggacctggctcccaattctgctgaacaggcatctatcctttctctggtgacaaaaataaacaatgtgattgataatctgattgtggctccagggacatttgaagtgcaaattgaagaagttcgacaggtgggatcctataaaaaggggacaatgactacaggacacaatgtggctgacctggtggtgatactcaagattctgccaacgttggaagctgttgctgccctggggaacaaagtcgtggaaagcctaagagcacaggatccttctgaagttttaccatgctgacccaatgaaatgggtttgaaatcagttcttctgatgctacagtgaagattctcattacaacagtgccacccaatcttcgaaaactggatccagaactccatttggatatcaaagtattgcagagtgccttagcagccatccgacatgcccgctggttcgaggaaaatgcttctcagtccacagttaaagttctcatcagactactgaaggacttgagggatccgtttcctggctttgagccctcacaccctggatccttgactaataggccattatgctgtgaatgaacaaccccacagaagcctttggccctaaacgttgcataaaggcgctgcttgctgattctggctgcaggactgtccctgcaaggttcagtgggtataatgacccctgtgagagtggcactttagagtcacacagtcatgaccctagaacagcggacatggtctgctatacac

SEQ ID NO: 538959 - DNA, 712 bp, Homo sapiens
  misc_feature (129)..(129): n is a, c, g, or t
  misc_feature (180)..(180): n is a, c, g, or t
  misc_feature (186)..(186): n is a, c, g, or t
  misc_feature (192)..(192): n is a, c, g, or t
  misc_feature (195)..(195): n is a, c, g, or t
  misc_feature (200)..(200): n is a, c, g, or t
  misc_feature (209)..(209): n is a, c, g, or t
  misc_feature (221)..(221): n is a, c, g, or t
  misc_feature (226)..(226): n is a, c, g, or t
  misc_feature (237)..(237): n is a, c, g, or t
  misc_feature (240)..(240): n is a, c, g, or t
  misc_feature (246)..(246): n is a, c, g, or t
  misc_feature (249)..(249): n is a, c, g, or t
  misc_feature (259)..(259): n is a, c, g, or t
  misc_feature (262)..(262): n is a, c, g, or t
  misc_feature (266)..(266): n is a, c, g, or t
aaggaacgccacttcgtcactatctcctctccactggccactcagatccctcaggcggtgggggcggcgtacgcagccaagcgggccaatgccaacagggtcgtcatctgttacttcggcgagggggcngccagtgagggggacgcccatgccggcttcaacttcgctgccacacttgantgcccnatcatnttnttctncggaacaanggctacgccatntccancgcccaccttngancagttntgnggcgatggtnttntcancacgaggccccgggtatggcatcatgtcgatccgccgtggatggctaactgatgtgtttgccgtatagcaacgctcatcaaaggcaggcccgacggcggcgctgttggcagtagtaaccagaccctttctcatcgtaggccatgacctacaggatcgggcaccacagctaccagtgaccgacagttcagcgtaccgctcggtggatgaggtcacttactgggataaacaggaccaccccatctcccggctgcggcagctatctgctgagccaagggctggtgggatgaggagctaggaggaaggcctggagcgaagcagtcccgcaggaaggtgatggacggcctttgagcaggccgagcggaagcccaaaccgcaatcccaagctgctctgctcagcacgtgtatcaggagatgccgcccagtccgcaagcagcaggagtctctg

SEQ ID NO: 538960 - DNA, 704 bp, Homo sapiens
  misc_feature (28)..(28): n is a, c, g, or t
  misc_feature (74)..(75): n is a, c, g, or t
  misc_feature (146)..(146): n is a, c, g, or t
  misc_feature (209)..(209): n is a, c, g, or t
  misc_feature (217)..(218): n is a, c, g, or t
  misc_feature (272)..(273): n is a, c, g, or t
  misc_feature (283)..(283): n is a, c, g, or t
  misc_feature (287)..(288): n is a, c, g, or t
  misc_feature (293)..(293): n is a, c, g, or t
  misc_feature (297)..(297): n is a, c, g, or t
  misc_feature (301)..(301): n is a, c, g, or t
  misc_feature (311)..(311): n is a, c, g, or t
  misc_feature (320)..(320): n is a, c, g, or t
  misc_feature (325)..(325): n is a, c, g, or t
  misc_feature (371)..(371): n is a, c, g, or t
  misc_feature (378)..(378): n is a, c, g, or t
  misc_feature (409)..(411): n is a, c, g, or t
  misc_feature (447)..(447): n is a, c, g, or t
  misc_feature (510)..(510): n is a, c, g, or t
  misc_feature (541)..(541): n is a, c, g, or t
  misc_feature (558)..(558): n is a, c, g, or t
  misc_feature (632)..(633): n is a, c, g, or t
  misc_feature (640)..(640): n is a, c, g, or t
  misc_feature (678)..(678): n is a, c, g, or t
gccacaatcagaaagccacccattctgntgcttctcttggcttccccttgagaaggatgcctgaggcgggatgnncccccaaactccaggggacaactggggaagacatggggtatgcaaagagatatgatgtaaaccacgggacngggggagggtggggtggtgtggattccggggaagacacatacacacagactctcccgctcagnggctaagnncgggggcgtcaatctctgcccccaacagcagccacgagaacatcagggaaagannaggtgtccanaagnnttttnagtncttnctatcatgangcgtctgcngagangggctgggtcaaggtccctggactctgccttcagggcgcattatcnctgagcnaaggtggcttttttggtggccatcaactttnnntatttgctttctgtgttcacgtagccatcgcctttnttcttagagtgaatcaacttcccggctaccatcacttcaaagaacccggtggcctggggggtnccctcgccgcagatgtccaggcggccggggnactcatcttctaacttnttcttgagctgaagatacttggacttgtagcctcaagcgccacaataaacgattcgcgcacggcgagagccatnngctcggnggctgccacatccgctgaggagcggacgcccggggccncactaacctcccacctggacgcgcta

SEQ ID NO: 538961 - DNA, 262 bp, Homo sapiens
agggggaccccgggggccccctcgtgtgtaaggacgtacccccaggtattttttcctatggaaccaaaaaagggccccccccaggggtttacatcaaggtttcccccttcctgccctggataaaaagaccaatgaagcccctttacccccaggcatgagactacccttcctttgggcctgcccctttttgggccaaaggccaaaatcccccagggggggcccgtcggggttgccggcctgtaataaatggttttttggggta

SEQ ID NO: 538962 - DNA, 438 bp, Homo sapiens
  misc_feature (15)..(15): n is a, c, g, or t
cctcttagaggggantttgaagacccgggccccgaaggggtaaccccttttttccggggggggggggaaaaaatcagggccccccttggtattttcaaaaacccccggttttttttgggggaaaccataaaccccaagggggggggggtttttttggacccccggggggggggggggccccccaaaattattttttttaggggggggttaaaaagggaaaaaggtttccaaaggggggcattttttggggttttcccccggtctttaaaagggggtttgggttgtttcccccccccccccggggtttaaaccaaagggggggggggtttttttgggcttttctttttttttgggggggttttttttgggggggggggctgttttttaaaaaaaacctgtttgggggggggttttaaaaaaaaagggtttttaccccca

SEQ ID NO: 538963 - DNA, 1202 bp, Homo sapiens
gcggacgcgatgggtcgacacagtatttcctcacgcaagcaaccgcatccatactccttctaatagctatcctcttcaacaatatactctccggacaatgaaccataaccaatactaccaatcaatactcatcattaataatcataatggctatagcaataaaactaggaatagcccccatattcacttctgagtcccagaggttacccacaggcacccatcagacatccgagcctgactatctatctacacatgacaaaaactagaaaccacatctcaatcatataccaaatactctaccctcactaaacgtaagccttacatacctcactctctcaatcatatatccaagtcatagcaggcagattgaggtggactaaacacaaacccagactacgcaaaactctaagcaatacgtcctcaaattacccacataggatgaaataatagcagattctacacgtacacaccccataacataacccatactcaacttaaacatactaaataataatcctaactacataaccgaaatcacctactaactcaactaaaacaacaagcaaacacaaccactaacatacagaatacatcaacaacctgaacgacaaagactaaacactgaccgtagaaaccaccataaatagcaagtcgacacacatacactctacacattaggacggaacagaacacaccgactaaaccggacataagacacaaaaagagaccagacatacaaaaagagatgcaaaagaagaacagacgacagaggagaaacgggaagtgccgccacgacaagtccagtagaccagcagcagggaacacgcgtaaaagacgaagcagcgatcagagccgtacggcagtaagcaagtgccagccgagagccaccgcgagcggcacaagacgcaaaggcaggaaaagaacaagaggaggcaggaaacctaaacaaccaacccatacagatagcaaaggagaacgctgaccagaacaaacagaaacatacacacaagacgaaagaaacaaagaaaaaccaaaaaaagaggaaaaaaaacgaaaagaccaagacgggcaagaaagcgaacgagaaatgcaagagcccatctagccgcaaacgaaacgacgccgtagccagcaggaacacagaaagagaacaaaaagcctggaggacaaaacaacagcaagacgaaaaaacagaaaaaaat

SEQ ID NO: 538964 - DNA, 664 bp, Homo sapiens
ctgagagtctcgaggacaatggaaaaacactaatgggatggattgaccacaactgagggtccccaggacagaggtaaacactaatggggtggatagaccacacctcagggtctccaggacagaggtaaaaaccaattggatggatggatggaacctgagggtctccaggaacgaggtaaaacactgagaagatggatagatcacacctgagcatccccagtacaaaggaaaacactaataggattgaccatacctgaggatctccaataacagtagggaaacactataggggctggtatcgcccacacctgagagtccttaggacagaggtaaacactgaggggctggatgggccacacctgagggtcctcagtacagagcagcgaaggatggctgttgctgggataattccatatctttggagaacaagaattccaggtagttttcttcgctccaaacagcgtggttatgaactagctttccctccaggaggatttaaagcttcagataatatctgtagtaataaagaaaaacaggccaggtgccacggctcacacctgtagtcccagcactttgggaggccaaggtgggaggaccactgaggccaggagtctgagaccagcctggacaacgtagcgagagcccatctctgtaaataatttca

SEQ ID NO: 538965 - DNA, 139 bp, Homo sapiens
ggtgctctagagatccctagacagcggacccatttgaccaccagtgtgtcccccttgtcttgagcaggtaggacacgctgtagagccggctgccacgtgcttcaccaggatctcctcgcccgggggtcgggctgtctga

SEQ ID NO: 538966 - DNA, 489 bp, Homo sapiens
cccccgggttttcccttttatgtttccggtttgtattttgggggaaattgtgagggaaaaccattttcccccgggaaccagttttgcccttgtttcccccaagctgaaatttaccccccctaaaagggacaaaaagtgggggcccccccgggggggggcccgtttaaaaaaaaggggtccccccggggggaagaaattgggcaaaaaccccttttccccccggctttgggtttttagggcttttgttttccgccttttttcttttaaacccctcccccaaaggggaagcccttcccccgggtcccctcaaagtttttccggggcccttggccccggggtttaaaaaccaatttcccaaggccaaaaccgttttttcccccagggggggggggaaacaaaaaaacttggcccctttttggtaggggaaaaaaaatttgaaaggtttttaattattttgatgggggaaaaaaagcagggggaaatccccca

SEQ ID NO: 538967 - DNA, 141 bp, Homo sapiens
tctagaggatcccaccctggctcacgtaggctggggttttttatggttacccccgttctgcgtgggaacggggtgttccgcgtccgctttgcacacacatgaaacccgagcaaaggtcacatttccaattgggtaccggag

SEQ ID NO: 538968 - DNA, 182 bp, Homo sapiens
gcagtaccctgagtgatcctgaagcttgatcttaacattgccctgattgttacccggaggcccaggttaccaaaccggaaatgaattgtcccagacattccgaaaagttcgaaagaaacataccctagcctcaaactctccggttcaaccgatggttgcacaacaggttctatttattcctg

SEQ ID NO: 538969 - DNA, 192 bp, Homo sapiens
tggtggcgtctgtgttccacacaacccgctgggtgccccccttgtatcggggagctgtacgtggctgcgcaccacagaggagtgctctcagtgccagccacggtttcatgtggtacactgtgtccctgatgccctccggccacctggtatcctgcccctccccactgggacggaataaatgctctgcagagc

SEQ ID NO: 538970 - DNA, 1030 bp, Homo sapiens
ggcggtcctggggtagagtttgcaagacttactgactaggctagtcgagtaactattcgggtcatggcgtcaaactcaactaagatctttcctggcagatgccggctatggcgaacaggaactggatgccaactctgacccttatggaattggacaaaggcctaagatctggcaaacttggtgaacagtgtgaagcagattgttcgctttcccagacttatttcagaagtatccattccctattcttatcaattctgcattcctaacagttagctgatgttttcagagttggaaataatatcctgcaggctatgtgtacttcacagttacccaacaaacagtgagacacacattcggcagaagcatctcacacatgtggcatcgacatctcgtgcaagcagcacatccctcctgtgcattccatcagtcacatgcatcctgtggccaagagccatcaccctccggcatgtagcgaagtcatggcatcaatcaattcctgagaggaagaatgctcatcatagtattcgtcagagtttagattcacatgatcactgtagaagtcagacagctgcatggaggacgcgagaggccacaacacacacctgacgcaaggcaaacggcacaacggcgacggaaccccgcaacccacgcagtgaactgatccaggaaagagacaccacaacaccgaagcacaaaacgaaacccagacagacgcacaggaacaagaagaaagaggaaaccagcagccgcaagaaagaacacacagcgccacaccaaccgaccacaaaaggggcaagaggcgcagaccgacaccggaaaagacacgaagcagcaacaagagagaagaggagcaacgagagcggacgcaccgcggagagagaggaggagagagacgacaagacgacacagcgggacacagagacagggcaaggaggcacgagaaaaggagcacgacaacgccaggcgcacggccaggccagagggaaaccgcggaggcggggggaagagacgaaagaacaaagcgagagac

SEQ ID NO: 538971 - DNA, 227 bp, Homo sapiens
agcggcggtgctggtatttagagcgcagcggctgaccgggccggatcgccttcgcccgccgcccgcccgcaaacttcgtgcccggcccgtccctcgccccccgcctccgccaccgctcggccgagagtgcccctccccaccgaacatgtcgatccaaggcccgagtatcctgcgttgcctcggcggtcttcagcgccctgggcgctgctatggcaacagccaagagc

SEQ ID NO: 538972 - DNA, 385 bp, Homo sapiens
tccacgcggagagagatagtcgcgcgtgtgagagagagagagagagagagagagagatagagagagagagagagagagagagagagagagcgcgagagagagagagagactgattgtgctttaacacaccgcaattattgtctccaaactcttccggcctctccaattataattttcccatctatctatatatcttttccgatgttttttagacctatctctttagacacaattctgattttctagtcattccatctacagatctttcgcggccgaagtctctttaggttctgtgttcccttgccagagtgccttactccgtctctagcactggcgcggataccctgttcatttttctcttctcccctatattcccctccctctg

SEQ ID NO: 538973 - DNA, 890 bp, Homo sapiens
ggtcctcttcttcagcacatgccaaagctgttcctcacggactgtgagacaagagcatcttggatgtaggacaatggaatgagttagatgccttattggaggaactggaacgctccacccttcaggacagtgatgaatattccaacccagctcgctcttcccctggactcagcagtttccagaaaggcagacgtaaccttgattgagacttcggagatcctttctagttcaggatagacacaagtcccttggccggcgtcagctcgtgtaatactaaccaatatccaggagctcaatgtctacagtgagagcccaagagtccaacagtgaatcaccacgcatcgcttctaaaacgtcagcagctgctcagttgtgatgagctcatggctcacctgatcgtgagatgcatggccaaggttgcagtgagagcagatgctggcaacgaagcacttaccagtacaacgcaggatcacctaaggcctccctggactcaagtgcttggcgggtctggcgtcaggaattgcaggaccttggtgttgccacagtgcccaagggccattgtgcatcctgccagaaaccgattgctgggaaggtgatccatggctctagggcaatcatggatcctgtagcatttcgtctgtactcatgtgccaagaagaagatttggcttccagtcccttctttgagcggagtggctttggtctactggcgcaagagtaccaccaatttttttcttcccgctggcttactgaggctggccctgctgggtaagggctgtcgccatgggcccgactggccccagagcacttcttcggccccactgggggaggggtggggcccaggctcctcgaacgggcgggcgctggcgaaggtttctcccctccccctgg

SEQ ID NO: 538974 - DNA, 649 bp, Homo sapiens
  misc_feature (4)..(4): n is a, c, g, or t
  misc_feature (26)..(26): n is a, c, g, or t
  misc_feature (41)..(41): n is a, c, g, or t
  misc_feature (47)..(47): n is a, c, g, or t
  misc_feature (62)..(62): n is a, c, g, or t
  misc_feature (64)..(64): n is a, c, g, or t
  misc_feature (79)..(79): n is a, c, g, or t
  misc_feature (81)..(81): n is a, c, g, or t
  misc_feature (119)..(119): n is a, c, g, or t
  misc_feature (124)..(124): n is a, c, g, or t
  misc_feature (160)..(160): n is a, c, g, or t
  misc_feature (172)..(172): n is a, c, g, or t
  misc_feature (191)..(191): n is a, c, g, or t
  misc_feature (193)..(193): n is a, c, g, or t
  misc_feature (216)..(216): n is a, c, g, or t
  misc_feature (227)..(227): n is a, c, g, or t
  misc_feature (243)..(243): n is a, c, g, or t
  misc_feature (259)..(259): n is a, c, g, or t
  misc_feature (264)..(264): n is a, c, g, or t
  misc_feature (280)..(280): n is a, c, g, or t
  misc_feature (287)..(287): n is a, c, g, or t
  misc_feature (340)..(340): n is a, c, g, or t
  misc_feature (346)..(346): n is a, c, g, or t
  misc_feature (354)..(354): n is a, c, g, or t
  misc_feature (384)..(384): n is a, c, g, or t
  misc_feature (418)..(418): n is a, c, g, or t
  misc_feature (453)..(453): n is a, c, g, or t
  misc_feature (457)..(457): n is a, c, g, or t
  misc_feature (463)..(463): n is a, c, g, or t
  misc_feature (475)..(475): n is a, c, g, or t
  misc_feature (477)..(478): n is a, c, g, or t
  misc_feature (528)..(528): n is a, c, g, or t
  misc_feature (532)..(532): n is a, c, g, or t
  misc_feature (544)..(544): n is a, c, g, or t
  misc_feature (638)..(638): n is a, c, g, or t
taantaactatggtttaatttctcanacattcttgaataanaaaaanaaatccagggatgtntntttatgaaaagaaanantaaatgaagtaaaccaagaattgaccacttttaccccnctggnttctgatcccaaaaatttcactatggggtctttcanatttccaaaganatttctattctaatgccanantttcttgtcctggattacaaaantgatttaaggntttttattaaaaagtngtttcactcaaaaaanaaaanactttctactgtcccngaaaaanagccataacagggggatctatatcatttgtaaatttacattctgaatctaaanaaaccngttgaaanactagtggaaaaagagaaaaaaaaaaaagncaacaagttattcatgcctaaaaagaacaaaggntaacaggccttttgaattacaaagtaaagaatctncctnagaccncattgggggggngnncagccgggaaacttggctttggggggttgattggctatggccgtggtgcnaggnctggctacaacnctggctcagactccggctttctcttcatctttcaaagcttcttcgtaatgggttgggaaggccagggggtggtccatttaccttggccaaaaantccaggacttt

SEQ ID NO: 538975 - DNA, 133 bp, Homo sapiens
tcagctcgatgcataaaaaacacaggaatgtcgtgatgatcacgggaaggcatatctaaaggatttagtacaaagtgctaagtcaggtgtgaggcaaatctgatgggctccatttccaaagagaaatgaacag

SEQ ID NO: 538976 - DNA, 171 bp, Homo sapiens
  misc_feature (155)..(155): n is a, c, g, or t
acccaggctggagtgcagtagtgcaatctcatgtcactgccacctctgcttcctgggttcaagtgattcttgtgcctcagcctccctggtagctggattacaggcgcctgccatcacacctataatcatgctggccaggctggtctccatctttnggcctctagtgatcta

SEQ ID NO: 538977 - DNA, 512 bp, Homo sapiens
ggggccggcgcagtggtcacgcctgtaatcccagcactttgggaggctgaggcaggggatcacctgaggtcaggagtcgagaccagctgacaaatggagaaacccgtcttactaaaaatacaaaaaaaaattagctgggattacaggtgcctgccaccacacccagctaagtgttggtatcccaagtacgacgatggggttccaccatgttggccaggcagatctcaaactcttgacctcgtgatgcacccaacctcggcctcccaaaagtgcgtgggatcaacattgacgatgcagccaacagagcaccgtgcactggcggacgcaaatagagacacgcgacaaccaaaaatcccctcaatctactagcgggcaatacgaactcctctgtcaacgcagtaaggtcaaccactgggccccagaaagggcgtgaccaggaccccttaacacacgggctgaaccagatcgcagcgcaccatacccacacgccactggcgacactaccacaacaa

SEQ ID NO: 538978 - DNA, 678 bp, Homo sapiens
  misc_feature (59)..(59): n is a, c, g, or t
  misc_feature (63)..(63): n is a, c, g, or t
  misc_feature (66)..(66): n is a, c, g, or t
  misc_feature (73)..(73): n is a, c, g, or t
  misc_feature (83)..(83): n is a, c, g, or t
  misc_feature (89)..(89): n is a, c, g, or t
  misc_feature (132)..(132): n is a, c, g, or t
  misc_feature (144)..(145): n is a, c, g, or t
  misc_feature (152)..(152): n is a, c, g, or t
  misc_feature (154)..(154): n is a, c, g, or t
  misc_feature (158)..(160): n is a, c, g, or t
  misc_feature (246)..(246): n is a, c, g, or t
  misc_feature (362)..(362): n is a, c, g, or t
  misc_feature (383)..(383): n is a, c, g, or t
  misc_feature (397)..(397): n is a, c, g, or t
  misc_feature (486)..(486): n is a, c, g, or t
  misc_feature (495)..(495): n is a, c, g, or t
  misc_feature (498)..(498): n is a, c, g, or t
  misc_feature (529)..(529): n is a, c, g, or t
  misc_feature (547)..(548): n is a, c, g, or t
  misc_feature (553)..(553): n is a, c, g, or t
  misc_feature (569)..(569): n is a, c, g, or t
  misc_feature (610)..(610): n is a, c, g, or t
  misc_feature (653)..(653): n is a, c, g, or t
ttttttttttgtattccattcccccgtctataacccccttctctcctccggggaaagcnaganggngtatggngtgggttttnttgttnggttttgagaggccggggaggtgccgagctcggtgctggtctntttccaaatatnnatatgtntnttannnctggaaaatcctccagcacccaccacccaagcactctccgttttctgccggtgtttggagaggggcggggggcaggggcgccaggnaccggctggctgcggtctactgcatccgctgggtgtgcaccccgcgagcctcctgctgctcattgtagaagagatgacactcggggtccccccggatggtgggggctccctggatnagcttcccggtgttggggttnacactccagcactncccacgctgcccgttcagagacatcttgcactgtttgaggttgtacaggccatgcttgttacagttggggatgttcagggagtagaggngctccaganggncccgctcatccggaaggcgcatggaggaganccgctccaggacctggannagtanctgtaggcagggagtnctggcaagggggtggtcgcagcttcttgggctcctccaggnccaaggtgatgcttgccacccttgcccatctgccggtgctgcncagtgaccttctcccggaacacggc

SEQ ID NO: 538979 - DNA, 758 bp, Homo sapiens
agatacttctgagtcttaaaagcataataggccgggcgcggtggctcacgcctgtaatcccagcactttgggaggccgaggtgggtggatcacaaggtcaggagttcaagaccagcctggcccaaatggtgaaaccctgtctctactaagtatacaaaaattagctgggtgtggtggcgggcacctgtgatcccagctactcaggaggctgaggcaggagaatcgcttgagcctgggaggtggaggttgtggtgagccaatatcgtgccactgcactccagcctgggtgacagagtgggactccgtctcaaaaaaaaaaaaaagcttaataatttattacttcccaaatatttaaaatttggagtgccttggcagtggggatgggtccctaaaatggcgtatagaattaagggcacagaatggtgtgtaaggtcctgaatcgggctaaaatacaggggatgtatgtatgggaattatgaggcataagtagccagtatctatagtagaatctacaaggcctccttttggcaccggtagactagaatataccggttatgggttgccttggagtgtatatctctcaggggctagaggtgctggtctcaagcacaatccacgactagggttgaaccactcattgttcaaaatccatgggtgcggctccaatgtaaaatatcactaccatcagtccacaagcaaccattaggaaaatctacagggactgtcacttgacttttaagcagtataagaagtccaag

SEQ ID NO: 538980 - DNA, 624 bp, Homo sapiens
caagcttcccatccctcatattcagcgtccaccgcaggccgccactcgttatgcccgagcatcagagccgctgtgaattccagagagtcagcctggagattggcctgcgagccgcacggtgacctgattggtcgcgtgaggctgtgcgtctgctcgtaccgcgatgtctagccagtagacgctggctcgacatcaggatagagggcccggtaagcgatctcgccttcaagcaggatggggcatagaagattacactgacgatccagcaagagtgccaagatactgacgcccccgctgaccccagttgatccatcgatatggtcaccagagagcatgcaatacagcagtgccgtccccgagctaccctcaggcattcctaacgcgctcgaaagatcacgcctcaactcatcacaccgcccctggccattaaacgaacataggggtctcccctgccctcgccacatcgaaaggtcgcactactcccgcggacaactcccgactacacactcgttcctcactaccatcagctcgccccgcgcagccaggcctaaacatcgaaccacgtaccgctaaccacgacacacacccgagaggcatcctccactcgcctaccgaccccacccg

SEQ ID NO: 538981 - DNA, 533 bp, Homo sapiens
tggccaggctctctagctgtgggaaaaacaaacaaagggaacaagtaagagattggtaagatggagaaccctagaaaaggtattccctatacccctcaagggggcacagtagacaggtatgggggtgtacatcacggacgggccaagagcaggggggagatgctctagctttctccagtgtcacggcctcagggagcaggggacaagcacaagaagaaaaaaaggaccaccaggtttctttctttttccccttcgctcaatatcctagaatatatggatggaggacagtacgtgtaggggggtgacccgtgcagattggaccttggaactcaggggaatagcaggccccagggaggggacacttttcgtaggggcattccagggtagaggggccgatagtgatgcagcacaaagtgtaaaggggtggggcagtgtataatggagcgggtaggcatcggggggaattcttctcacaggcagacaggattggacgggcctaggggacggaaggagtaataaggaggacagaaggc

SEQ ID NO: 538982 - DNA, 405 bp, Homo sapiens
gataagttggcggctccttacgctgtggtgaccccagattaataaaggggctaatccgaaaaaaaagattgaatgaatgaatgaattgtttatatgttgggctcatatttttttgagatcctgtacttttaatacacgcaagcaaaaaaagagaacccttttcattccaatttttttttatttaatttaataaaatctaattaaatattaattgaaaaaatattacatatttccttcacttacgagagagacacacacattgtgtaaaatttttaaactgagtttccactcagaaattacaaaaagaattcaacaaacttcaacataaaacatgttccacatgttgtataaaaatgagccccctaaatgaaagatttaaagaaaaatagaaaatttaaacatgta

SEQ ID NO: 538983 - DNA, 724 bp, Homo sapiens
  misc_feature (38)..(38): n is a, c, g, or t
  misc_feature (61)..(62): n is a, c, g, or t
  misc_feature (66)..(66): n is a, c, g, or t
  misc_feature (68)..(68): n is a, c, g, or t
  misc_feature (75)..(75): n is a, c, g, or t
  misc_feature (85)..(85): n is a, c, g, or t
  misc_feature (87)..(87): n is a, c, g, or t
  misc_feature (128)..(128): n is a, c, g, or t
  misc_feature (140)..(140): n is a, c, g, or t
  misc_feature (146)..(146): n is a, c, g, or t
  misc_feature (158)..(158): n is a, c, g, or t
  misc_feature (167)..(167): n is a, c, g, or t
  misc_feature (184)..(184): n is a, c, g, or t
  misc_feature (195)..(195): n is a, c, g, or t
  misc_feature (201)..(201): n is a, c, g, or t
  misc_feature (246)..(246): n is a, c, g, or t
  misc_feature (251)..(251): n is a, c, g, or t
  misc_feature (266)..(266): n is a, c, g, or t
  misc_feature (281)..(281): n is a, c, g, or t
  misc_feature (305)..(305): n is a, c, g, or t
  misc_feature (329)..(329): n is a, c, g, or t
  misc_feature (415)..(415): n is a, c, g, or t
  misc_feature (597)..(597): n is a, c, g, or t
  misc_feature (601)..(601): n is a, c, g, or t
  misc_feature (644)..(644): n is a, c, g, or t
  misc_feature (652)..(652): n is a, c, g, or t
  misc_feature (668)..(668): n is a, c, g, or t
  misc_feature (714)..(714): n is a, c, g, or t
  misc_feature (718)..(718): n is a, c, g, or t
  misc_feature (721)..(721): n is a, c, g, or t
gccctgcggacagagaagagcctattggctgggttggnggcctggcaggctgcccctttcnncccngntacaggnccttgccggncnccacacaccagggggcaaagttctccccagccgcctcaggnggccccgctgcnaatccnctgtcttctgtnctgtctgtncctgggtcctgcctgcnccgtttctgcncaggcncctgaggggctgcctcaatggcccgctgggctcggggtgggtctngaggngggccttggcaaggntggcggggccgggcncccccagggacatgacacagtgcncacccttgcgcttggcccccgccnccttggtgctgtctttggaggctgttagcaggaccagtttggagaactttctgggcttcctgggggctgccgggatgacttctgtncctggcttgggggatggctcctggctggccttcacactctcaccctcctgctcgctgggctcgggcaggggcatcccgggacccagggcctgtccctcaggccacactcagcccccagcaggtggatttctcctactcccaggcaaggaacctggagtccagcggttccgtccttgcgtctnaacnagtactggcgctgccctggctgggtggggacagcgatgtgganatgttgtngatcccaccgtcactnaggactccttggcttctggcctcaagccggggtcacagcgcgacantgcncanaag

SEQ ID NO: 538984 - DNA, 365 bp, Homo sapiens
agagataacctactcagtgaactgcatggtgtctcctactataactttacacaagcacacacaagcgtgtaaagatggaaaggctacgcagacacaaccatgcacacacagatattataaaacagaaaaagtggaaatttaccaactagtcctcgcttggcaacgctttccccatcaacatgactagatacatatagaaaggagcttcattttaacatgcaccctaatcgagccagggatataggagaaacctctaatgcactttactttaaccacccccgcgaaggagaagggcctgtaggctgcctccgtacattcactctctgttttgttgttgtttaagagacagggtctggctgtgattg

SEQ ID NO: 538985 - DNA, 521 bp, Homo sapiens
  misc_feature (2)..(2): n is a, c, g, or t
  misc_feature (71)..(71): n is a, c, g, or t
  misc_feature (96)..(96): n is a, c, g, or t
  misc_feature (99)..(101): n is a, c, g, or t
  misc_feature (104)..(104): n is a, c, g, or t
  misc_feature (135)..(135): n is a, c, g, or t
  misc_feature (137)..(137): n is a, c, g, or t
  misc_feature (140)..(140): n is a, c, g, or t
  misc_feature (169)..(169): n is a, c, g, or t
  misc_feature (174)..(174): n is a, c, g, or t
  misc_feature (227)..(227): n is a, c, g, or t
  misc_feature (259)..(259): n is a, c, g, or t
  misc_feature (273)..(273): n is a, c, g, or t
  misc_feature (290)..(290): n is a, c, g, or t
  misc_feature (295)..(295): n is a, c, g, or t
  misc_feature (302)..(302): n is a, c, g, or t
  misc_feature (370)..(370): n is a, c, g, or t
  misc_feature (386)..(386): n is a, c, g, or t
  misc_feature (394)..(394): n is a, c, g, or t
  misc_feature (444)..(444): n is a, c, g, or t
  misc_feature (478)..(478): n is a, c, g, or t
  misc_feature (482)..(482): n is a, c, g, or t
gnggggtgatcttggttcactgcaacctttgcctcctaggttcaagtgattctcctgcctagttggccganatctcctcccagtgcacagggaggntgnnnagnattcccccagctttgctgtgtaggagcagtngnggnggaagaagggaaaggacccagtctgaggntcacnggtgccagcttcccgctctcgcagtgtctgatccacgtaaagccgggtctttnggggcacattgagtttcatggcctgggctggngggggaccactcanttcctccctctacaaanactgntgtacgnttcaggatcttgatgatcaggccaccacctcgagtggtcatgatgagggtgttgtcctcccgcccgtnccggccaaagcaaagnttggttantgcatccggggtgtggatgatattgagcagggccttgttacgataaatgnggacctctccattggtcagcccagccatgatggnctgnaggcccgggaatgctgctccaggaggttcatggtcagga

SEQ ID NO: 538986 - DNA, 492 bp, Homo sapiens
cgtgatgattgttgtgatgagtgagaagagattaaagaagataggttcaaaagatgaattgagtatgtggtgtaattaaaattatatgagaaaatgagaagatgagagtatagtaatggaatgccctatgatagttgaggtgaactcttgcaattgtgtgatcggtaggccccatcattcaaggtcattgagtcactcaagtggactatggatatacatgatataaagtactcctagagatcactggctctgttacgaattggaaaaagagcttctacttgggttgatctccgtgtacacacagttttattattcatagctcaaagtgtggatagataacgcccttgttgctccacctagttagttggattaaccacccagtgattatggacgcaatgccctgtggggatcacattatataatgtgacttgccgattcctgtagatccgtatttaccttgcatttgtcacactacgatgattacactatatg

SEQ ID NO: 538987 - DNA, 305 bp, Homo sapiens
gatgtgagagatagaacgtatgggtatactatccaagccggtaggttgtcagggcggtgtaccgactggggtaatagcaaaaggcaggtctgggtgcagtcacaagcgatggtggggaaatgtgtgtggcacaagtggacaggccactccctctaccaataaccatgttctatccccaagactgacagaagcgaagggtcttcactgggaacaggcacgggagccccagaatcaggatgggactcaggtggctgctattacccagaagaaatagaggagacattgttaccccatattttgccacg

SEQ ID NO: 538988 - DNA, 256 bp, Homo sapiens
atggggccctgcgagggggagccttcgcctctcctcctgtcctctaagaaaatggttgacccgcatggtgttgggaacctgagcctttctgacaccgtggcatgttgctagcgtatttttgtgcgtagctcctttgaaaagtggttaggtgctcaaggctagctgctacatatcctctccattcgacttaaaaaatgagagggtcagacttgacatggtgtttggacgccatgtaaaatcgaaggaagtcgacttg

SEQ ID NO: 538989 - DNA, 561 bp, Homo sapiens
acctgggagtagcttcctcagatctggaactgaacgccagtaggtgatgcagcagcccaaatgcccttctctgaggagaactgtgcgtgtttctcatagaacatttgaccgttgtcattaccgcgtttctagagtcgatgttgatgtacgcattgatatggaattgtgttgtgggacgacgtttacagaaagctgaagtcacgtgccctcagctgcagacactcatgcactgatgggaagagcagtgacctggctgtgcgtctgcacttagattctctgcctcttttcacatttctttaaactctgtttaaaacagcatgtggatgccatggagactggaagaccataccaacttggacgcgttaccatgagagcatatcctatccaaccgtactaacgtggacacccgacacctcccctcagaacttcaaaagggcaagatcttttttccttcacttattgctgaaaccaagagcacaattcccattgagaggaagatctctgtgctgtaaactaaaacaaattgtgcattccttccggggccatcgtctgccgcgggga

SEQ ID NO: 538990 - DNA, 534 bp, Homo sapiens
ttccgcgttcgccccccgcaggttcgccaccgccgttgagacttttttccgcccgcccgagcgccctcccgccgcatgcgcctatcgtctgccttcctaacctgctgtgctgtccctctagggggccaactcctcccccccgcgccccacggagctctccacgaagatttcttggaccacgcgctgggtatttcgagggcgcgacgacgcccgcggctccacacaggtttatccagtggagctgtgaatgggaaaaacaccttgtgaagaacgtctcttgccccgcgggttattggcccagacttgtcccagtgtacctcgcctgggtggggctgtttagaccctttcttgctgtcccccaggcgtcttgccagccccctgctgcctggttcttgccccctgctgccagccagaggagaagaaagatgagaagaaggaggagtctgtaagagtccagatgatgaccatgggatttggccctttttgattaaattcctgctcccctgccaatataagcccttttacaccatccca

SEQ ID NO: 538991 - DNA, 427 bp, Homo sapiens
tcgggagcggccatttgtgaccgggaattcggccgataacacaacgcacgcgatgacttgggaacagtacacttgacatagaggtggatgattgctttgcttctccagtgcaaggattttttgtacaacaacccttcctaaatatataatcgtgtaagaaaattatttttaataaaacactttcaaatgtacaggggggaattgcaccccacgggttccattgtgcttggtcggtgttacaagacttgttatccatttaaaaatggtagggaaattatatgccggtacacaccgctttttcaggttgtaacaacaaaaaaacatacattggggaaaggtttaagattatatagtacttaaatataggaaaatgcacactcatgtgattccctatgctaaaatacatttctggtctttcttctgtatt

SEQ ID NO: 538992 - DNA, 901 bp, Homo sapiens
  misc_feature (877)..(877): n is a, c, g, or t
ctgcaatctatctcctcgttctcattctgctttccttctggttgctcgcttcacctgatatcctgccctccacatccacctggcttcagctcttctctgcatttgccttcagtctcagggggtgattcagcaccttctagtctgggtttcattgtgtgcctctctgcctctacgattattatcctctaggcacttccaagtttttgtcctcttcctttgtggactttacagtactatttggtagtggtatttacttgtgtattttttctgttacatatcttttactataaataatttacagtagtttagatgtatataaggtcctaagtggttcgctatcaacttctaataacgtcttatcttagggtactacaattattgtgatgtgtcctgttgtaattagtagttctagcctttttatgctgctttgataggtagtttgttgtacctctatgatactagcctaagaatcctatagtttaccttcaagatgaatcctaggtgtatgtgattacttttgcattaaatctggcgcttacttctatggcccgacgtagcttatgtaagctaggtatactgaagtatatcccgccttatcttagtataggtagcttatgctgtactgggtatgtggtctatgtctaggcttcgtatcttaaggcagtagggtggagaatggaaaactgaagtcacctgtagataattttaataagattccaatgaccatattttgtgagatatggcacattattcacagaccatgatctttgtgaatttacatataatttccttaacaatgaacatgtaacttctctaccaagagtactctttactttgtaatcatatacaggtcacttattagatgatcaatccgggncaaaaacacattgtcggccgcccc

SEQ ID NO: 538993 - DNA, 433 bp, Homo sapiens
  misc_feature (165)..(165): n is a, c, g, or t
  misc_feature (200)..(200): n is a, c, g, or t
  misc_feature (215)..(215): n is a, c, g, or t
  misc_feature (228)..(229): n is a, c, g, or t
  misc_feature (235)..(235): n is a, c, g, or t
  misc_feature (244)..(244): n is a, c, g, or t
  misc_feature (272)..(272): n is a, c, g, or t
  misc_feature (287)..(287): n is a, c, g, or t
  misc_feature (299)..(299): n is a, c, g, or t
  misc_feature (305)..(305): n is a, c, g, or t
  misc_feature (308)..(308): n is a, c, g, or t
  misc_feature (329)..(329): n is a, c, g, or t
  misc_feature (346)..(346): n is a, c, g, or t
  misc_feature (348)..(348): n is a, c, g, or t
  misc_feature (362)..(362): n is a, c, g, or t
  misc_feature (364)..(364): n is a, c, g, or t
  misc_feature (369)..(369): n is a, c, g, or t
  misc_feature (384)..(384): n is a, c, g, or t
  misc_feature (388)..(388): n is a, c, g, or t
  misc_feature (394)..(394): n is a, c, g, or t
acaggctgtttgtgtgcgcgtcctgggcgcggaggggctttttcgacgctcgccggcggctcatgaaaaggctttgccccagcagctgcgacttttggtacgaattccccttccccacggtggccaccacccccccgccccccaggaccaaaaccagggtggtgnccgagggcaggaacgtgaccttcccctgcggccanaagatcctccccaanaaagggaaagtgnnctgggncaaggaccnggagcccctggagttttcctaccccggntacctggccctgggngaggggcccctnagcatnatngccaaccccgtcaatgagggnccctacccctgggtggngngcccccaacagggngngctgnccccctactcctggngagnccgtgngcgggggtgagcccggctgataaagccctttttttttta

SEQ ID NO: 538994 - DNA, 610 bp, Homo sapiens
gaggcccgtggggccgacaggatgggcaagtgtcgtggacctgtcgtactgctaggaagctcggtagtcaccgacgagaccataagtggcatgataaacagttataatgaaagctcatttgggcacagcgcctaaaggccgaaccctttttggcagtgtgcttctcatgcaaaacggaatctgtgctcggaaaacaaagtaggacgttgaaagcctacaactagccgatatactggcgcattatggagagtcgtcgtaatggggtccaggctgcatcacacgaattgcgcaggacacaatcaccaggccttttgtaccccagatgacaggtgagcgttgagcgtttgattggatggcaaaacttgatggcactgttctggttcgccttggatcttggtcgccacacaggtgtccatagcttgttaggctgatattcgctggatgtccgctctaaaggatgtgtcgcagttagccccttgttttctctttgtgggccctgatacggaaaggccaagaagggaaaagaacgaaggatcatcagaatcatgagatggtggatccacactgtagttatattcttttcatatgccatgttaataaatagatatat

SEQ ID NO: 538995 - DNA, 404 bp, Homo sapiens
caaatgcgaaaacttcatctctacagttcgtatctgctcacattaattggtcaatgtataaaaacttggaagactttctaaataaggaagaagaaaaagaaatctctaggagatcctgccaaaggcttttggaaagtagcataccttcgccgaagaaatggtgattcctgccaggggctgttagccaagaactgtgaaagagagagagaaaaaacctcaactgtgtatttggtcacggcggaaaatctgctcgcatcgaagcattcttctaagcgacttcgatgccaaggaagtagtgtacactgtgcacgcgctaaaccacacccagggtgaaacccacagttgcagagtctttaaccaatcaatggtaggtttaacatctgtgataggcagctttccttctt

SEQ ID NO: 538996 - DNA, 336 bp, Homo sapiens
  misc_feature (22)..(22): n is a, c, g, or t
  misc_feature (77)..(77): n is a, c, g, or t
acaaattactttaaatacctantagtctgtgcttgtgttattcctataggaactaccataaacttaggattcctgtnaagcggagcatggtgacttatgccctgtaacccccagcactttgagagggtaagataggaggatctccctaggccaggagtttgagaccagcctaggcaacatagcaagaacccattctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtg

SEQ ID NO: 538997 - DNA, 110 bp, Homo sapiens
ttccggttccaaagaaaactaaaagcagtcaaatatccacttgcagatactacgaaaagagtgtttcaaaactcctctatgaaaaggtattttcaactttgtgagttgaa

SEQ ID NO: 538998 - DNA, 565 bp, Homo sapiens
  misc_feature (418)..(418): n is a, c, g, or t
aacgatgtctcagctattcaggagcgaggtggaagaatcacctgaacccaggaaggtcaaggctgcagcaagctgtgatagtgccactgcactccagcctggacaacagagcaagaccctgtctcaaaataagtacataggctgggcgaggtggctcatgcctgtaatcccagcactttgggaggtcgaggcgggcagatcatttggggtaaggagttcgagaccagtttggccaacacggtgaaaccccgtctctactaaaaatacaaaaaaaattagctgggtgtggtggcacatgcctgtaatcccagctacttggggaggctgaggcagaagaattacttgaacctgggagacagagatcgcgtcactgcactccagcctggttgacagtgcgagactctcaaaaaaaattggncaggcatagtggctcacgcctgtaatcctagcactttgggagggcgaggtgggtggatcacctgaggtcaggagttcgagaccaggctggccaacgtggggaaaccccgtgtctactaaaaaatacaaaaattaggtggggatggtg

SEQ ID NO: 538999 - DNA, 206 bp, Homo sapiens
tattttaaaatcctacagtttccttctatgatgatgctctgctcgaaatggttatttaattcttaaacctgtttgtaatacaggtttagaaaagaaccagaatagggctggagtgtgacttactgcttctactgcaactgctttaggaaatttacatataaagaaaactaacaggaaattgtgtagttgtataggccgggtaatgt

SEQ ID NO: 539000 - DNA, 170 bp, Homo sapiens
tttttttaaaaaaaaaaaacctttgtttctttttttcccccccctttttggcccggggattaaaagcccaaattttttaaaatttttcccctttttttcccaaaaaaaaaagtttttctttcgtttttttttttttaaaaccttttatctttaccccaaaaaatttttta

SEQ ID NO: 539001 - DNA, 166 bp, Homo sapiens
gttcagttgacgttgcaattggccccccgggttgaaggttggttaaggacacactggggcgcaggttccatggcaaccggtacagggaaagggctgctatacggttgacaacgaggtgcagccatcagggccggagacaattgtggtcatcatctacctcagccgt

SEQ ID NO: 539002 - DNA, 178 bp, Homo sapiens
gggggaaagggttcccccccccccccccaaattttttttggggtttaaaaacccaaaaaaagggattttttttccccccttttaaggttttaaccccccaaaaaaaggtttccccttaaaggggggggcttttaaaagggggccccccttttgggggttttccccaatttccccggga

SEQ ID NO: 539003 - DNA, 1193 bp, Homo sapiens
  misc_feature (326)..(326): n is a, c, g, or t
  misc_feature (335)..(335): n is a, c, g, or t
  misc_feature (1021)..(1021): n is a, c, g, or t
taaagggtggtgcacttttatccaacgggtctcaagtcagtgtacaggtaaccccgggttgcctccacccatctcccagggaaaccaaaagccttcatacttctcaaggtgtggggggcacaaaaagagggggagagggggggccacgaagaggcctcatcatctcaaatataaacacgaaattaaacaagagttattaggggcgaagatattaaaaaatatttggctattcactattatttatcaccacgaaagagcagaggcttaatcaaccctcccctgtgtgtgtgtggcacttgtgggaagagaggaactggggccaaatnctctccttntgagaagaagaacaggtgggggggcgcttattaagagaagtggcccagaggggaaatatctcgcgtgttgtcaaaccaaaagcggccatattctctcgaaatatatgtgcggggagatagtgaccatctatattctgaaaaaaacacaccaacacatatgtgggtgtcacaatactcaagaagagtctccctctgcgggggccccaacatgtgttggtgcacacactctgtggggggggggaaaaggtgtgccctccaggctctaacaaaaagcgccgagaagctgtgggcggtgttgtacacagcctttatacaggccggcgtggtccacccccgaagtgatctctttaatagaaaatgctccgccgtgagaagttcttccaaaaggccgacaagaagaagaagacagagagaacaaaagaaagaagaaacgaccagaatagagacgacgatgaagaactacagaccaaaaaaagaaataatacaccgacgccaatgattattattaaaagacgccccccgcatgatgttggaccacaataatccttcctacatacacattgactggtggtggggaggatagtactactggtcgtgggagaagacaaaaaatagtattagaggcggggtcatgtttgtgggggccgcacaccaacaaaacagcggggggggggtggctgtaatancagcggcggcaacacactaatataagaggcggtctcagtaatagtataggtctccgcgcggcatcctataaaaagcaacagactcatatatttgtgggggggggggggagtgagcaccaccaaactcgaagaagaagaggggcggcccccgcggagaagaaactcactcggg

SEQ ID NO: 539004 - DNA, 175 bp, Homo sapiens
  misc_feature (143)..(143): n is a, c, g, or t
agccacggtagatacatgaacgtctgggtaactctgggcttgggtctggtgacattcgggccagaaatccatgaaaactaccgcataaagggatagaagagagaagcaccggtgctgggggagtgggcattttagatggcccntcacagaatatggaagctatagcatcagctct

SEQ ID NO: 539005 - DNA, 410 bp, Homo sapiens
ggacagcacagaggaggtggacagcacagaggaggcacagggggtggacagcacaggggtggacagcacacgaggaggtggacaggacgcggagggaaggcaccacgggaagaaagggataaccctacaccccacgagccccacggctggacatgctgactgtcctctcccctccagcctttggccttggcttttttagcctatttacctgcacggctgagccacactctcttccctttccccagcatcactccccacaggaagagcccaatgttttccacccataatcctttttgccgacccctagttccctctgctcagcccagcttgttatcagctttcagggccctggttcaccattagaataaaaggtagtaattagaaaaaaacaaccaacggggcggccgaat

SEQ ID NO: 539006 - DNA, 246 bp, Homo sapiens
tacatggcaaaagatattatggcagcgtaatagagagtttaaaatacagataaataaagggtcaccatctcctctggcacaaggaacagctcactttttgccagatttcttaattccacctctgtccaaagtccccttccccgagggcttcgcttttagctcctcgagattcttctgctcctcttttcgtttctgcttgaacgccttatcttcctcttccatctccttcgacttgccatatgcaat

SEQ ID NO: 539007 - DNA, 759 bp, Homo sapiens
gcaagaggtcccctctgaagcacatgggaccaggacacccaggatggcagctcctgggggcagtgacgtagtcatgcgtccaagccctttattcaatccccccctcttgtgcattcctctttgtccatttattcaatctcttcttcttacattgcacctcaatatttgttcaacttatccgtcagtcctttcattctgtgaatttcttcaattcaacgccgccttccttcttgccatccaggagtccttcaggaccccccccttcttctttattcaacccccttcttcattcgagcccccattaccacctctttgttgctgcttgcagctgtcccttccttgggtaccctgctttcccaggcactaagcctgtggctaggtgggaagcactgccctcaggcatcttgggtcaggtaggctgcacttcaagtgacaaacggacttgctgctcctttgcagagtcactggaactggaggacccgtcttctgggctgggtgtgaccaagcaggatctgggcccaggtaagggccttgcagaggggcattttgtcaccagcagctcattcccagcagggccagcttctttgtgggcaggtgaaagaatgtgacccttggccactcttcaacattccggggtgtccattttacagaacgaacaggttgggggggctgtggggagttcactcctgatggtcattattggaccttagcacggggcagggagggtggccaagccctctgttttgaggtccagatggt

SEQ ID NO: 539008 - DNA, 154 bp, Homo sapiens
gggaggagaagcaggagctgtcgggaagatcagaagccagtcatggatgaccagcgcgaccttatctccaacaatgagcaactgcccatgctgggccgggaccctgaccccccggctcgtctcttaaagtcggtgctggagaggaatctgattc

SEQ ID NO: 539009 - DNA, 853 bp, Homo sapiens
  misc_feature (272)..(272): n is a, c, g, or t
gctctctccaggcgtcctcgtggaagtgacagtcgtctttaaaccctgcgtgggaatccctgacgcaccgccgttgatgcccagggaagacagggcgatcctggaagtccacatcatacttcgcttaagatcagtccaactagtggatgatgtatccgaaaatgttgtcagttgtgcggagcacgacaagtgtgcggctccgaagctatgatgcaagctagatccgcgatgtacccttcgcgaggaagagctgtaggtcgcatgatgggcanagaactagccgatgatgctgcaatggccgatccgagggcacctaggtaaaacaatgccaggctctggagaacactgctggcatcatattcgggggagaatgtggcgctttgtgttcaccaacggaggaccttcactgagatcagggacatgttgctggccaattaaggtgccagtgtgatgcccgtgctggtgccattggcccatgtgaagtcactgtgccagcccagaatcactggtctcgggccgaagaaggacctccttattccaggcttcaggtatcaacattaaaatctccaggggcaccattgacatcctgagtgatgtgcagttgatcacgactggagcacaagtgggagccagcgaagccacgcttgctgaacatgctcaacatctccccgttgttacctttgggagatggtacattccaggcaggttgttcgagaattgggcaggatctaacaacccctgaaagtgactgagattcacaggaggacactctgcatcacacgcttcctggaagggtgtccgagactgtgccaaagattggaaggagataggttagccaatgtgcatagtacca

SEQ ID NO: 539010 - DNA, 228 bp, Homo sapiens
  misc_feature (33)..(33): n is a, c, g, or t
  misc_feature (205)..(205): n is a, c, g, or t
  misc_feature (219)..(219): n is a, c, g, or t
aattcgcggccgcgtcgactacggctgcgagangacgacacacgggaggtaaagtccatggttccctggcccgtgctggaaaagtgagaggtcagactcctaaagtggcccaaggagaaagaaagaaagaagaaagaccagttcgggcttaaaccggccggattgcaattaacaacgggcggttttgttaaactttgttgcccancttttggcaaaganggggcccct

SEQ ID NO: 539011 - DNA, 1342 bp, Homo sapiens
gggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctccccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagccccttcccccatttgccccccctgtgacctcatcccctgagaccctggtgcctggcttctttcgtgcacccttggaccagaccaacccagtcgggacagccgattaccatgcagcaaggccctgctgccccatctccatctgtcaacaggggcgtgaggtccccggaagtggcccaaagctagacagatccccgttcctgacatcacagcagcctcccacacaaggctcccagacctaggctcactggacgagaatgggaaggcaccacgggaagaaagggataaccctacaccccacgagccccacggctggacatgctgactgtcctctcccctccagcctttggccttggcttttttagcctatttacctgcacggctgagccacactctcttccctttccccagcatcactccccacaggaagagcccaatgttttccacccataatcctttttgccgacccctagttccctctgctcagcccagcttgttatcagctttcagggccctggttcaccattagaataaaaggtagtaattagaaaaaaacaaccaacggggcggccgaat

SEQ ID NO: 539012 - DNA, 386 bp, Homo sapiens
  misc_feature (155)..(155): n is a, c, g, or t
agcccacccgccccagagactgcccaccatgggcctcccgtccgtccgcccgcccaccccgctgcctggcgggcagcccctgctggaccaagcccagaacgggcctccccgggggtccccggacgctggctcgggactgtcttcaaccctgcccntgcactttgggcacgggagagcgccacccgcccgcccccgccctcgctccgggtgcgtgaccggcccgccaccttgtacagaaccagcactcccagggcccgagcgcgtgccttccccgtgcggcccgtgcgcagccgcgctctgcccctccgtccccagggtgcaggcgcgcaccgcccaacccccacctcccggtgtatgcagtggtgatgcctaaaggaatgtcaagc

SEQ ID NO: 539013 - DNA, 1532 bp, Homo sapiens
  misc_feature (658)..(658): n is a, c, g, or t
  misc_feature (700)..(700): n is a, c, g, or t
gggaggagaagcaggagctgtcgggaagatcagaagccagtcatggatgaccagcgcgaccttatctccaacaatgagcaactgcccatgctgggccggcgccctggggccccggagagcaagtgcagccgcggagccctgtacacaggcttttccatcctggtgactctgctcctcgctggccaggccaccaccgcctacttcctgtaccagcagcagggccggctggacaaactgacagtcacctccccagaacctgcagctggagaacctgcgcatgaagcttcccaagcctcccaagcctgtgagcaagatgcgcatggccaccccgctgctgatgcaggcgctgcccatgggagccctgccccaggggcccatgcagaatgccaccaagtatggcaacatgacagaggaccatgtgatgcacctgctccagaatgctgaccccctgaaggtgtacccgccactgaaggggagcttcccggagaacctgagacaccttaagaacaccatggagaccatagactggaaggtctttgagagctggatgcaccattggctcctgtttgaaatgagcaggcactccttggagcaaaagcccactgacgctccaccgaaagtactgaccaagtgccaggaagaggtcagcacatcctgnctgtccaccgggttcattcaggccaagtgcgacgagaacggnaactatctgccactccagtgctatggggagcatcggctactgctggtgtgtcttccccaacggcacggaggtccccaacaccagaagccgcgggcaccataactgcagtgagtcactggaactggaggacccgtcttctgggctgggtgtgaccaagcaggatctgggcccagtccccatgtgagagcagcagaggcggtcttcaacatcctgccagccccacacagctacagctttcttgctcccttcagcccccagccccttcccccatttgccccccctgtgacctcatcccctgagaccctggtgcctggcttctttcgtgcacccttggaccagaccaacccagtcgggacagccgattaccatgcagcaaggccctgctgccccatctccatctgtcaacaggggcgtgaggtccccggaagtggcccaaagctagacagatccccgttcctgacatcacagcagcctcccacacaaggctcccagacctaggctcactggacgagaatgggaaggcaccacgggaagaaagggataaccctacaccccacgagccccacggctggacatgctgactgtcctctcccctccagcctttggccttggcttttttagcctatttacctgcacggctgagccacactctcttccctttccccagcatcactccccacaggaagagcccaatgttttccacccataatcctttttgccgacccctagttccctctgctcagcccagcttgttatcagctttcagggccctggttcaccattagaataaaaggtagtaattagaaaaaaacaaccaacggggcggccgaat

SEQ ID NO: 539014 - DNA, 362 bp, Homo sapiens
  misc_feature (101)..(101): n is a, c, g, or t
  misc_feature (283)..(283): n is a, c, g, or t
  misc_feature (305)..(305): n is a, c, g, or t
  misc_feature (343)..(343): n is a, c, g, or t
gcggcacggctctatctggcgcctgaccgcaagactggttcttccggcatctggtcgacctggccatcgtgctgctgccgctgatccggccgcttcgcctnctccgtctggtcgtgctggtgggcgcgctgcagaaggccctcggcaacgcatccgcggcaaggtgatcatctacaccatctccggtgccgtgctgttggtctacgtcggggcgctggcggtatacgaagccgaacgcggcgcgccggacggccacatcacgagctttcggcctcgcggtgtngttgggcgatgaccacgatcancaccgttcggttacggcgacatgtattcccgttaacancacggggccgagtcattgg

SEQ ID NO: 539015 - DNA, 129 bp, Homo sapiens
tcttatagtgtgtcattaggagctacgggttcaggcaccagaggaaggggtacatgagctgacatccatgagtatgaacccaattaatcttccggcaagcccatgcggtgggttgataatggtcctccc

SEQ ID NO: 539016 - DNA, 160 bp, Homo sapiens
cagtcttgaacttcttttaattgttttgctttgttttcttttcttgctgacttgaatgccttctcagcagcttcaacagtcttttgtgttttcttagcagcatatctcttgtgatcataatacttgattggcattggcatatgcttgacaaagttgagat

SEQ ID NO: 539017 - DNA, 815 bp, Homo sapiens
cgcctccccgtcagctccaggctcgcccttttctcctttcagtccaaaggcaccggggtctcccttggggccaggggtccttgaatgccgtcaaacccgggcgagcccttgcagcctggcaggcctgggtaccccatctcccccttcacgccgtccaccccgtcgatgccacgcttgcccttctctcccttgtagcccttgggtcccctggagcccttctccccacggctccctttttctcccttcattccctggtacccaacaggtccgaggtccccgggtcttccaggatctccggcttctcccttctctcctgggagccccggcttgcctcgttctccctcaaagccggggtcgccccggagccccggaggtcctcttgcaggctggcattcgaaggagcagcacacttgctccacgttatttttgatcatgtccacgatggtgtcgatggtctggctgatggcctcctctgcgtcgcggctctggccccagtcagccgccgtgaagttgcgccggtacgtgtggtccgtggcgatgatgctcagacgcggctccaggtggtcgggtgtgatggccaccgagaagactttgacgcccaggtgcttggcctcgttcacagcatcctccagccccccacagggttccttgtagccctccagggggtgcccgtcggtcaccacaatcaggtacttattctccttcaggtgggagccccccacgaggagctgctccagccccttcttgatagcgcagtcggtgtaggtgcccttcccaaagtacttgaccgcgtccacgctgcttttgagtgcgtc

SEQ ID NO: 539018 - DNA, 250 bp, Homo sapiens
tcaagcagtcgcgccagaaatcatagaagatttggtctactactctagtacagtagtatctctatagatgacctgtgtagaaaaagcaggaacagatgagaaaatgcttatgaaggtctctccgctgctcttggtgaagtcggtttaacttgaggagttttggacagtaacttcatggctaacaataaattactagcactcctttgtgaggttttgcaacaggataagacctcgtataaccatacatgaa

SEQ ID NO: 539019 - DNA, 264 bp, Homo sapiens
  misc_feature (6)..(6): n is a, c, g, or t
  misc_feature (176)..(177): n is a, c, g, or t
  misc_feature (255)..(255): n is a, c, g, or t
tgacgncatgattcagcgatagagccggaaaatacggggtcaaagccggtatcattaaccagagtcatcgtgacctgtactgcggctggatgatctcctgctactgcaactgccaggcgaccgcggctcccttcaggtagtctgttagtggtcaactaaaactggcctccgcgttnnagtttttccagtatcggttttctgattcgtttggtggtaacccaccattatattcgtgcggtcttagtgcgctgtaanatccaacgt

SEQ ID NO: 539020 - DNA, 248 bp, Homo sapiens
gacctagaggaccccgagtgtcttcagaacaatgtagccccgcagtcagtttttttaggagagatcttttcttttatgacctggcatcagtacctcttccaatagcttgatgtttcctatgaaaaaatgcaaacatcttaagagtggctgatctctaggatatgaggtatagaggtgctcctgtgaggaaagaggactgcactttctatcgttatccactgaaccaaccgagggctactttgaattta

SEQ ID NO: 539021 - DNA, 780 bp, Homo sapiens
  misc_feature (44)..(44): n is a, c, g, or t
  misc_feature (61)..(61): n is a, c, g, or t
  misc_feature (67)..(67): n is a, c, g, or t
  misc_feature (89)..(89): n is a, c, g, or t
  misc_feature (104)..(104): n is a, c, g, or t
  misc_feature (106)..(106): n is a, c, g, or t
  misc_feature (110)..(110): n is a, c, g, or t
  misc_feature (125)..(125): n is a, c, g, or t
  misc_feature (137)..(137): n is a, c, g, or t
  misc_feature (139)..(139): n is a, c, g, or t
  misc_feature (152)..(152): n is a, c, g, or t
  misc_feature (161)..(161): n is a, c, g, or t
  misc_feature (163)..(163): n is a, c, g, or t
  misc_feature (168)..(168): n is a, c, g, or t
  misc_feature (187)..(187): n is a, c, g, or t
  misc_feature (223)..(223): n is a, c, g, or t
  misc_feature (296)..(296): n is a, c, g, or t
  misc_feature (384)..(384): n is a, c, g, or t
  misc_feature (416)..(417): n is a, c, g, or t
  misc_feature (440)..(440): n is a, c, g, or t
  misc_feature (468)..(468): n is a, c, g, or t
  misc_feature (509)..(509): n is a, c, g, or t
  misc_feature (533)..(533): n is a, c, g, or t
  misc_feature (542)..(542): n is a, c, g, or t
  misc_feature (545)..(545): n is a, c, g, or t
  misc_feature (548)..(548): n is a, c, g, or t
  misc_feature (555)..(555): n is a, c, g, or t
  misc_feature (557)..(557): n is a, c, g, or t
  misc_feature (623)..(623): n is a, c, g, or t
  misc_feature (642)..(642): n is a, c, g, or t
  misc_feature (676)..(676): n is a, c, g, or t
  misc_feature (711)..(711): n is a, c, g, or t
  misc_feature (720)..(720): n is a, c, g, or t
  misc_feature (763)..(763): n is a, c, g, or t
tctgctacttctagtttcagctggcatgcgtgactgaagatctnccaataggtctgtggtnttcctngagcctcaatggtacagggtgntcgagaaggacagtntnactntgaagtgccagggancctactcccctnangacaattccacanagtggtttnanaatgngaacctcatctcaagccangcctcgagctacttcattgacgctgccacagtcgangatagtggagagtacaggtgccagacaaacctctccaccctcatgtgaccctggtgcatgctagaagtccatntcggcttggctgttgtctccaggcccctcggtgggtgttcaaggaggaagatccctattcacctgaggtttcacagctggaagaacantgctctgcataaggtcacatatttacagaatnncaaagacaggaagtattttcatnataattctgacttccacattccaaaagncatactcaaagatagcggctcctacttcttcagggggcttnttgggagtaaaaatgtgtcttcanagattgtgnacntcnccatcantnaaggtttggcagtgtcaaccatctcattattctctccacctgggtaccgaagtctctttctgcttngtgatggtactcctttttncagtggacacaggactatatttctctgtgaaganaaacatttgaagctcaacaagagactggtaggacnataaacttnaatggagataggaccctcaagacaaatgacccccatcccatanggagtaataagagcagt

SEQ ID NO: 539022 - DNA, 529 bp, Homo sapiens
gacacatttcttcttactggtggaaactttctgcacagtcctgaggcagcacagggcaacacacggacttctggttgctgctgctatttcaaacactgtcaaggacctccattataatcagccacctcctgctgaggacttctcccctcaaaccagcactcaattcatccagacaagacttttagctgagacatctgtggtctacaatggaatgaaaccagaatcaacaatctggttaaactgcacagcctgtctcatttatatatggttattttggtgcacatttgagctttctttgatttgcaaagtgaaaatgccaactttttgattattaatatatttcaattattttataataagaagaaattatgtatgtgctatttatgggctaataaaaatctcagctgaggtgaaaagatgagcaactggacagattaaactgaaactttctttttaaaaagtttaattgtatgtatttaagatgtacaacatgatatacatcgagataataaaatggttactgtaaaaa

SEQ ID NO: 539023 - DNA, 380 bp, Homo sapiens
ataagaagaagaatccgtcactgtgacctgaaggcatacctcggcggctatcaaaacggcgtgcgcgagcggcgcaaaggctcgaatgaggcgatggcgctgtgcgacagcctgaccggcaagaagcccggcgtcggttttgaaaatgcgcaggcgctcaagcggatacgcgagcagttttcaaaaatggttccggcccgcgggcaaggcgggcctggtgtgcaactgcgcctgattgagggcggcaagaaaggagcgaagtgattatggcaaaaaacgcggacatccgcgacaccaaggtgctgagggaggcgctggcgctggccgatctggtgctggatagcgccaaccccatcggcgagatcgtcggcccggcgggg

SEQ ID NO: 539024 - DNA, 855 bp, Homo sapiens
gcaccattgatgaagtatggatttcctttccccatgcttgttttgtcaggttgtcaaagatcagatagtggtagatgtgtggcatattctgaggcttctgttctgttccatggtctatgtatttttttggtaccagtaccatgatgttttggttactgtagccttgtagcatcgttgcagtcaggtagcatgatgtgtccagcttgttcttttgtttagtatgtctggtatgcgggctctttatggttccatatgaaatttaaagtagttttttctaattctgtgaagaaagtcaaggtagttgatgggaatagcattgaatctataaattaccttgggcagtatggccattttcatgatattcgttcttcctatccatgagcttggaatgtttctccatttgtttgtgtcctctcttatttccttgagcagtgttgtagttctagttgaagaggtcctacacatcccttgtgagttgtaattcctatgtattttattcactttgtagcaattgtgaatggtagttcactcatgattggtctctgttctcttatatggtggataggaatgctcgtgaattcctacacatgggtttggatcctgagacttggtggaggcgtatccagctcggagatctgctgagcagggggtcttccactatccatctggcctcgcaacggagacaatcgatcctcctgcatgggatacgttactaccctcggaggggggcgactccactcaggaacgggggccagagcacccccacggacgcgggaggggccggggagacccgaggaggagcggcctggcacaacgggggcacagcacccggggcgaacaaggcgcacaccacga

SEQ ID NO: 539025 - DNA, 241 bp, Homo sapiens
cacgaggcagatccataaaaacactccatgtcctgatgtgaccctggggacaaatccagggacataatatatccaggtccccattcaggagatccctctggggctggatctgaagaatcttcggatccccaaaacaatcatgagctttgacatcacatataagtctgaagttttttcaagatttgggatatacctatccacctggctaggattccacaccactagaatatgatattcaaat

SEQ ID NO: 539026 - DNA, 278 bp, Homo sapiens
tgaacattcgtgtctcgggtccaggaagaaattaagaggaactctgatgacctgagcagaagattgtgacagatgccctcaagagagaagacaggcaccagtccagtgcagagttttgtggacacaggcacagggggtggcgcgtgggacacacttagacacacagaacaccaacaccaaggtcgaagagacagagaagggggaggggaagaaggggagagaggatacaaggagagcacaaatacgagatacggggacggggggacactgaatgttca

SEQ ID NO: 539027 - DNA, 295 bp, Homo sapiens
  misc_feature (111)..(111): n is a, c, g, or t
taggcgacctaagacccactatcaagcaggctgtgtacaaactctcgcattgatgcttaaatgatttattctctttgttatgaacttagttggtggatatgaattctgtgntgaaatacttttctttaagaatgttgatattgtcctcactctcttcttgcttgtagggtttctgtagagagatctgctgttagtctgatgggcttccctttggtggataatgcgacttttccctctggctggccttaacattttttccttcatgtcatccttggtgcatctgaggatcatgtgt

SEQ ID NO: 539028 - DNA, 1183 bp, Homo sapiens
ggatatttgtgaagaacttcgcctgcgggagcttgaagaatggtcaaggccagagctgctcagatggcaaagaccatgcggtggtggtcggactgcactgccaactggagcagcacacaatggcagtcacagttcgagctgaaaggcaacaagtgccagagaggcaaggcaagaccaagtccagacaatacacaaactaggaagactgggcgaattgacaaacgaacattcgcaggttaccacttgagacaacagggacaccaggaagattgtggccaacctccaggaacgcgcagggccatttccggacaagccttacactgtgttaaccccaagggcatccttggaacgccttttccctgtgggctttccgggtaaggacacagaaaatttccctttgtccggcacaccattaccacggaaccccaaactcttccaaacttgggaccggttttccaacacacacttggcccctgacggttccttatttccagcaggaaggtaattctggggtaacaacacaatgaaccacacatttttgccttaacaaccccgcggccagggcacccaccaacgcctacacttacagcggaccaccaaagggctggtcgccctccaatccagaatttccctctttaacacacagttaccccgctggacggcacgcatgacaccgcccccaaacttcctacgcgaattcggattggcttcgcacttctcaattgcaaacacccaacgtgcggctgccctatccctggcaaaccaccgccggcttgcacaaacgccgcacacacacgctgcgtgccttggaagccaccttggcaccacgccacactcaaacaactcccttgcccccttttcgggccaaccacccttgcgcaccgtcttaactctctggcaaccctcttccatggcacctctttggccacacggacagcacacatcactgcggcaccttgcaaacgttccccccaaacgacaacaacctccccactaactggcgcaaacgcggcaacccacggacggaccacacaccgccgcgcccaccacggagctccgggcgcacaaaacccacagcgaccaccttccgaaaggaaaccacacctggtgacgctccgcggcgcatcctcgggtcccccatcggctcgcgacaacccgttgaccaccgcttatgccaaacccc

SEQ ID NO: 539029 - DNA, 392 bp, Homo sapiens
  misc_feature (269)..(269): n is a, c, g, or t
  misc_feature (280)..(280): n is a, c, g, or t
actaagtccaaaagaacacttgggcataatccaacagaacatgcacaagatctgtatattgaaaactgcaaaatgctaattaaaaaagacctaagtaatggagaggcagtatgctcacggattagaaaagacatattaaaaatatttgttctatccagactgttgatctgtatatttaatgtaattcctaaaacattcctggcaggattcttttggatatagacaagctgattctaaaatttatagggaaagttgaaattatttttttnaattaaaaatnaaatttctaggggaatgcaaaagaactaaaacggttaaacaattttgaaaagaataataaagttggaagaatcactcgatctaattttaacacttactgtacagtaatcaag

SEQ ID NO: 539030 - DNA, 193 bp, Homo sapiens
gcgtttcgagaatggccaacatctattaaaaccagtgagccatctttgagatctccatctcccgaacttccatatccaattatcagcaagtacgattaatgtaaactcctcaatatcccattaatacagttctctccatctccaccctcatccaagccatcaactgcttccacttataccactgcaacgtacc

SEQ ID NO: 539031 - DNA, 163 bp, Homo sapiens
acatgattgtccacgctcccggggcactggagagcagtcttctgagccaccttgttggatcccaaggacctggagccacgggctgcaacgtgcactcagggtactgtgtgtggcattactctggacagtagaagcccaagtatggagacggtggtgggtaccg

SEQ ID NO: 539032 - DNA, 406 bp, Homo sapiens
ttccggccgggcgcggtggttcatgcgtcatcccaactactttgggaggcgatgagtgggctgatctcgacgatattcgtgagctcgatgactagtcctgtctatacttggtgaaaccccatctctactaaaaatacaagaaattaaccaggcctgctggcaggcacctgtagtcccagctattcgggaggctaaggcaggagaatggcgtgaacccgggaggcataattttgcagtgagtcgagattgcaccattgtgacttccagcctgggtagacagagcaagactccgtctcaatagtaataatatcatttgggctgtccgtgtatgtctattaaaaagttgtgtgaggggaatattttgagttcaaggagagggattacagattggagtaggggaaacctt

SEQ ID NO: 539033 - DNA, 1187 bp, Homo sapiens
  misc_feature (523)..(523): n is a, c, g, or t
  misc_feature (930)..(930): n is a, c, g, or t
tgtatctttgatgcatgattcatactggaccaaatgaagtagtcctgttatccctcgtatcaaggtagatcgccagtgggggtcatgatcccatagtcacgcgctactcgttggaacattgaagcgagaccctagtagcaataacttagcgagcctatgtgtatgccatgtgtgtatttcatgcatgatagaatgaaagccagatagaattcgtgcatataggggcatcgaaaacatgttaaccgtcatgaatgatgtctgagtggaaatttggctactatttgtcacgatgattcgtgttgggcattcggactttgcatacgtacacagctatgccactatgagtgagatggacaaagcagcatggtgttacgcaacagatggttgaactcttctccgtgccgacgtgtgcgtctcctatctattagatctataggcggttgacttacatacgcgaaaggcaataaaaatatcataatgcgcgagaaaacgtcaagtgtactacaagccatgtgtgttggancacaataaggggcaaatggtgacgcgcgtttgtgaaaccgcccattctcctgaaagagtaaagcccccgtggtataaaacccaggtgggtaggacttgattgaacttgtccgtaaccatgtcagaagagggatacaaaaggaagattgaaggttgctatggcacatttcccaattatattccaatttgtcgttttcccttaaacagaacaagtcgttccccacaagtcacaccatcgtggaacatggattcccccatattagggttcacaaaatttccttccagaaggaccgagaaatatagccgttaaaggcacattgggtccattttggcgtcccaattgggtgtcacccgcatctgtgggcggcaattgaccaatcaatccaacagatcgcattgggggagtgnccaagtaaggggtgtgttacaaacttagtccacgcaatgtaattggtggggggccaaacactctgggtgggaccgagaacttattgtatctgggggagagtaacacccggcgtgcattaattaaacaaaccccaagcaccttgtgatatatcacgttgacaagggacgcaccaaattaatgagtgctcggtattgacggggcataacaacaagggtgacgacacacatcacaacgggcgtgagaacgaatattattc

SEQ ID NO: 539034 - DNA, 997 bp, Homo sapiens
ggctggccttgtggcttgggcagtgtccgcctgcatcctctttggtgaggcgcgctgagaccctgaccggccctcctgagaggatgccggtgcgtgcgcccgcggacgagggtatgcgagtgggtgggctgctgacggcctcggggtactgggtcccggtgagccgcgcctgccggggtaccctgggctaagcccgtggccggcagtctaactcttggtgatgttggcccccagggaccgcggtcggccagtgggccggtgtcgatcgccgttgtagcaggctggaagggcgcctgggtcttgtgttccagcagcgcagtgtgaacgtccctggtaagggcagctgggcggcgcttgggcggccagtcggtatttgcgctgatctggccatcggctacatcaaggggcatccgtcgaggagcatcaatccacgagccgggctcggatggaggcgccccctcggcaagagtggtcttcctgaggaatccgtatcggttttaaagaagcggatcggaagctgttcacttgacagacgagggcattcagaagagggccagtttggttgtatttgcggcaaagaaagggcacaggtacaaacatttgtgcaatgttgctcccttgtgggcaaccattgccgtgatgggtaccaaatcagtgtttgcttgccttgggaggacgaaaggcgtggagaccggttggtaaggatggcacagagacaattaatgggaaactactggcaaccgattatcttcccaacaaatcctgagacaatgaagaccctgttgtgaagagtgacactccggctccaagaaagttatctcctcagacacaagagctgggttgtgtggatggctgacgaggccacagtagagaaaccgacttgaaagagaggcagggcgtacacagaatatggggcagagcgacaatggtgccacaagtacggggtgcacataatcgtggcgggacacgctagagggaaacacagaatgagagcgaa

SEQ ID NO: 539035 - DNA, 131 bp, Homo sapiens
tatggcgtacccatggccagaatccacagacacacctaagcctgtggcactgggacaaatatagattttccatttgagaggcgacttcctgtgtcagtcgtgtatgaaggaggtggtgatggtggatagag

SEQ ID NO: 539036 - DNA, 534 bp, Homo sapiens
gctcgacctagactgtaagcgatgtgaagaaatgtcggtcgggtgccgtggctcatgcttgtaatccctgaactctgggaggtcaaggcaggaggatcacttgagtccaggagtttgaaactagcctgggcaacatggcaaaaccctgtctctacaaaaaatacaaaaattagccgggcgtggtggcatgtgcctgtagtcccagctacttgtggggctgaggtgggaagaacgctagagcctaggaagtcaaggctgcagtgagccatgatcatgccactgcactccaacccaggcaacagaccgagaacctgtctccaaaaaaaaaaggggaaatgttggataaacgtggtggctcatgcctgtaatcccagcgcattgggaggccaaggcagaagaattgcttgagtccaggagtttgagaccagccagggcaacatatagagaccctgtctctacaagaaaaatttaaagattagccagacatggtgacacacacctgtagttccagctactcggggggttgaggtggga

SEQ ID NO: 539037 - DNA, 897 bp, Homo sapiens
agcagtggctcacacctgtaatcccagcactttgggaggccgaggtcgggagttcaaggccagcctgaccaacatggagaaaccctgtctctactaaaaatacaaaattagccggggtggtggtgcatgcctggtaatcccagactactcgaggagagcgtggaggctaggagaatcgcgttggaaccgtgggagtcggaggttgctagtgagccgaatgcattgtgccattgcgactccagcctgggcgaagtaagagcagattattgccatctgctggaaaaagaggaagcgagcatagaaaaagaggttgtaatccaagctagtgtggatgatggtagaaggaaaatcatgcaggaggggatatcctacaaagaatctgtctattcgaacatggtgcacagtcctaaaattgagaccactcatctcagtccaagcgattatacaacgaatctattaggacagctacacacggaaaagagtaatgcgaacatgatttgatattcacgcattgacctaaattgtgcaagatcttgatagagttcactgaggagtcaggctagtagccttgaaaacaccatggagaggcattagtgatccagaatagaaagatcggtctggaagatgggtaattccagaaatgattttgaatgcatacatgtcatgatgctcctgtggaatttgacagtgaatctggatcaaagaggagaacatggaggtggtattgggaatgagggatgaagagttggggtaaagggcgggtaagattggaggacgttagtgaaaggtgtccgcgctacagggggaggtcaagttggaggtccgtagctggtgttagtaacaaatgggagggttgtgaaaaaaagggactgatacaaagagggggagagggaagag

SEQ ID NO: 539038 - DNA, 242 bp, Homo sapiens
tcagacaaaagtcctcacaaaagaaaaggaatgattccttttttctctcaagtttgttttttctccattttcctccccttttgtgggttgttcagatctctaggcctcaatcgttttcaagaggaaggagaaggcaccccacttatatggccgtaattatcagcattcattgcttacctggagaaaaagttcccatttcatttcctgatgatagggcatctttgcaatgcttcccaaatcca

SEQ ID NO: 539039 - DNA, 120 bp, Homo sapiens
tgatcctccatgatgctgattacatgtctcgatccacttaactatcttgtggctgtgacaaagtcacatggttcacacggcaggcatactccatctttttcagtgggggtgaattcaggt

SEQ ID NO: 539040 - DNA, 312 bp, Homo sapiens
gctcattactttagaatgacccccttgaaactctggcttttcctctgctctttcccagctctctcttaaaaaatattttccctcaaaagacattttgttcacagtttctggaaacgttggtactaaaatgttgagaacactgaaccatgtgtcggttatagcagctgggccagcaatgaggtagatgtgaggagagcagcgatggggatcctagcacgagcctcatcacgagcctcaccgcttacattgatttgttattcactggggcatgcggagctttctccaggagaagaaaaggattgttgtcgacgc

SEQ ID NO: 539041 - DNA, 1192 bp, Homo sapiens
  misc_feature (599)..(599): n is a, c, g, or t
cacccactccctcttagccaatattgtgcctatgccatagctagtctttgccgcctgcgaagcacggtgatgcctagaccctactagtctctaatctccaatcacatatggcctagactactgatacataacctaaaccctatctccacaatgctaagaagctaaatcgtcccgagcaaattgatattagctgaccagcgtgacgagtggacattgtccgaagacaaaccacataagtgttgaagtcgagcacgaacgcacccacaggccgtgagagttattaggcatcgatccctctactattgtcttggtaaccagagatcaagcaacaatccctaatttacgctggttcccctcgagagccctatttgccgtctcgtagcccgctcgttagacaaaggccctcgcattcgcgtaatagcttaagcttaacgcttgactttccatgaactccacctgcgaacaactacaattgggcaaagacgcatactgacccatcttttactcctacgttggaatcccaactttactccaattgaataattatagaacttcctaacgctgcttcttaaataacctaatagttccttcactctgancaacaaattcgtcccgttgaatttcatgaatccattttaccatcatgcaccatctaggtaaaccttaaattccaatatctcttaaattattctatttcgtttcgaaaaaatccgcaacactataattcactccagcctggtgagccctaattcaattccacacacagaataagaagggccaaccacaaggtccctaagaccatctggcgcatggtaggcgtgccacggccattcaattaacttgccgtgaattcctgaacggggcccgtaagattaggggcttcccttttttccccccttaagtttccacttcgggcatccattgacttttaaactacatctatccataaccaaaccccatagtgggtcgttccatcttacacaacgatttccttgaaccttaatcattctacgttcttgcaaactggacgcccaaattgaaatccgtatttcaaagagagttccccttgaagccccaaatagggggtttaattttatgcgagcctaaggcccttataacaccataataaagcttggttttaataatggtaaagaggaataacccttctttttaacggggatcttccccaaag

SEQ ID NO: 539042 - DNA, 287 bp, Homo sapiens
tcactacggtcacacacatccttcctagatagctcagacaccgttctcatattgaactacagtcacagggccggtaaacccaggtccctttgcaactttgtgcctggcctcactcctttccttacagatattcacataatgtctagaataatgaattcttcctgcaggaaaagtttagctaagaggagcatttgcagccaaaggcactatactgaacctgggagaccccattccctggaaaaacaccttccccttagattactgaaatgtcaatcaggatgtgtgcg

SEQ ID NO: 539043 - DNA, 571 bp, Homo sapiens
ccagcgtggcgctcagggaggggagttgctgaatgttctgtctgtaggtgccgactctcagctacctaggagaagatgccaacaggtatatatcactcactgagaatggttactatccagggcatatagagaattgcaaatcagtaagaaaaagaacccagctctcggggagagaactgggtgcagtcctatggctgctttctcgccttcagaggtgaggcaaacctctttttgtattgcccatgagacttccagaccttgtatggaactaaagacttaggctttcagctgggcacggtggctcatgcctgtaatcccagcactttgggaggccaacaggagcatagatgacttgaggccaggagcttgagtccagcctggacaacatggcgaaaccccatctctagaaaaaatacaaaaattagccagaggtggtggtgcacacctgtagtcccagctactcgggaagcttagatggaaggatcaactgagcccaggaggtggaggttgcagtgagccaagatcatgccactgcaccccagcctgggccaccaagtgagatcctgcttta

SEQ ID NO: 539044 - DNA, 164 bp, Homo sapiens
gatcattaattgcaagactctaatccctgtattatgtagtcaagagacagtcttgacatagaaaaactgtgagagagtaaaattacaccatgtagctaaagcgcacattaagaagcgtcagctcacacccatactaaaaatccaacataacgagcgtgcatggt

SEQ ID NO: 539045 - DNA, 318 bp, Homo sapiens
  misc_feature (17)..(17): n is a, c, g, or t
  misc_feature (84)..(85): n is a, c, g, or t
cccccccccttccaaanttggggtggggggttgcgtgggcggtttatataaacccgggtttttttggtacccggtggttttgtnnttggccccccctcccccgtgtgttggcccccctagataacccccggggccggtttcccgcctcggatttttccctgggcggggggcggtttccctttttccccggggcccgggttttccttttggcctttttggggtccccttttggcccagttttgcccaaaaacccggttgggcccgggtcgggttttccggggtttttttgccccccgggctcccgggggggggggttga

SEQ ID NO: 539046 - DNA, 177 bp, Homo sapiens
ctctagttgatcaactacgaggagtgatgtacgctatgatcagaaaactttgttctcagggtaaataactcatgattaaatactgcgaattctgagtcagtgccaagggatctgatagatgcacaggtaatcactggtgtcaatcactgatcacttgaggcaggaccgcgccagtgg

SEQ ID NO: 539047 - DNA, 974 bp, Homo sapiens
  misc_feature (974)..(974): n is a, c, g, or t
gagccatggtataaattaacaggttaagtgtcagtcatcagatcttccttctcttcctaaggatgcttgtgttgcctcaatctatcaatctatctttcttgttagggttgtttctctctctctctctctctctctctctctctccttcattagaagacatggtctagcccatgattgtcgtagatatagggcagggtttattcacagtatgtgatgatagcacactggagcctcaaacctcttaggctcaggcgatccttcaagcctcccggggagctgggaccacaggcacgtgccaacacacccagctctctttcttggtttttcatcatttcatgtatctatcaaagcccagttcatctcctcccccaaacacacacacacacacacacacacacaattaagttgctgcaaattcaagagcttagagagaataagcttcttggtggtgaaactacactctctcatgtgtgctccagttctaaaattaatctgtgtctggtctctgaagccctttcttgctctgtgcctttcagacacattcttaggtgctaacggacatgagctccgactctccaaaagtgagctccactttgtgtctgaagagcccctggagagtacacgctgctcaggtatcatgggcgtaatgatcacccaggctccagggagatctcagtggaatgatctaggtgtatgaaacagaggggacttcagtcttacaggcttggggaaattggactctgtgtttcgcagaaataatttacacgaagcttgatccctcaagtctccaaaaggctggcttaagtggcctaaaaggctgaagtgtcaaaagggttccctggtcttgaaaatcttaatctcgaccggccagcagtcagagggcctaaaaggttcgctcaaaattttgtaaaagggcaatcagccgaccttagcatataacgctgagtgtctctcgtattctcgtgttttcttgn

SEQ ID NO: 539048 - DNA, 132 bp, Homo sapiens
tgattcgaaaaggcctgttctccctgtcaccctgcagtgtaagctcacctccaactctcacacccttcacatacatgctaactggacaaagatatgggtgtggacattagattgccagtctgtaagaatgct

SEQ ID NO: 539049 - DNA, 227 bp, Homo sapiens
tagctatataggatggcaagggacttcctgtaacaacgcatctcatattctggcatgactattcaaaaaaacaacaatgtgcaatcaaagtcctcggacacattgtgaactttgtgggggtgctcgctccaacctgactgctgtcaccttacaccgttccagtttttaaatcctgagctcaagccatataaaaaaaacaaaacgcgcgaaaaacaaacaaagaaaac

SEQ ID NO: 539050 - DNA, 239 bp, Homo sapiens
cggcatggggtctgtatcatttgattgatgtgagagagagtgttcactgctcgtggtagagcctacactgtcataccccgcactgagttgactgacgtccccactacctcctctgccagtgctcttctctgagctgccgtaggacgtatgaccattccctgtagaagaaggaaagaacatcatccggtgtgttgccctccctgtgaaatccagacccagacgtcctgcggcggcaggag

SEQ ID NO: 539051 - DNA, 680 bp, Homo sapiens
  misc_feature (372)..(372): n is a, c, g, or t
  misc_feature (375)..(375): n is a, c, g, or t
  misc_feature (421)..(421): n is a, c, g, or t
  misc_feature (468)..(468): n is a, c, g, or t
  misc_feature (478)..(479): n is a, c, g, or t
  misc_feature (481)..(481): n is a, c, g, or t
  misc_feature (485)..(485): n is a, c, g, or t
  misc_feature (506)..(506): n is a, c, g, or t
  misc_feature (509)..(509): n is a, c, g, or t
  misc_feature (513)..(513): n is a, c, g, or t
  misc_feature (517)..(517): n is a, c, g, or t
  misc_feature (525)..(525): n is a, c, g, or t
  misc_feature (529)..(530): n is a, c, g, or t
  misc_feature (533)..(533): n is a, c, g, or t
  misc_feature (537)..(537): n is a, c, g, or t
  misc_feature (541)..(541): n is a, c, g, or t
  misc_feature (544)..(545): n is a, c, g, or t
  misc_feature (557)..(557): n is a, c, g, or t
  misc_feature (563)..(563): n is a, c, g, or t
  misc_feature (565)..(565): n is a, c, g, or t
  misc_feature (571)..(572): n is a, c, g, or t
  misc_feature (580)..(580): n is a, c, g, or t
  misc_feature (595)..(595): n is a, c, g, or t
  misc_feature (606)..(606): n is a, c, g, or t
  misc_feature (624)..(624): n is a, c, g, or t
  misc_feature (626)..(626): n is a, c, g, or t
tataaggctaggtacgaggcgggtggtgaatctggatcggaggcgagcacctatccgatgatctggagaggagcattgcaacgtagcagtcagcctaggacgatggctgaggttggttcaagtgtgtcatgctcgtcgaggttatcgagactcaggaagtccatatcacataagcgcaatgaagactgcgtggtgagagctgtcatcagagaaattcccaagacttctttcctgtgatcttcagcaaagcctccgagtacttgcagctggtctttggcatcgaggtggtggaagtggtccgcatcggccacttgtacatccttgtcacctgcctgggcctctcctacgatggcctgctgggcgacaatcagntcntgcccaagacaggcctcctgataatcgtcctggccataatcgcaanagagggcgactgtgcccctgaggagaaaatctgggaggagctgagtntgttggaggnntntgangggagggaggacagtgtcttngcncatnccangaagctgntcanncangatntggngcnngaaaactacctngagtancngcaggnncccggcantgatcctgcatgctncgagttcctgnggggtccaagggccctcntngaaaccagctatgtgaaagtcctgcaccatttgctaaagatcagtggagggcca

SEQ ID NO: 539052 - DNA, 681 bp, Homo sapiens
cccacacaataatctgctaggtctgtgcgctcggtgattaatttgtgactgatgtgctggcgaccagattgctatcagcgtgtcggagcgtgaagggcctggtggctggtaataacctgtgaggagcctcgtggcctggtgcctggccactgtgctggagctgacttgtggtgtgcagtgtagcctctgctgtgcttctgtgacctgcccaactctggtgtggtgtgatggcccaatgccaatgaatgttaggaaacaactgctgttttctgccccagcctgacgtgacctctgagaaggatgtgcaaacatgctctggctctagcaaacaggaaatgtttggcctgtgtggatgtatgcttgtcaactgtgcatgtgcatcgctggtggctagcaatgactgtacaacttacaagaagggccagacccataccttggaatgacttccatgcgagttcttgatgtgaatctcatgggcaccttcaatgtgatccgcctggttggctggtgagatgggccatgaatgaaccatgaccatgtggatggccaaccgtggggtcatcatcaacactgccagtgttggctgccttcgagggtcaggttggcacaagcttgcatactctgcttccaaggggggaatagtggcgcatgacactggccattgctcgggatctggctccc

SEQ ID NO: 539053 - DNA, 370 bp, Homo sapiens
  misc_feature (197)..(197): n is a, c, g, or t
  misc_feature (226)..(226): n is a, c, g, or t
  misc_feature (250)..(250): n is a, c, g, or t
  misc_feature (282)..(282): n is a, c, g, or t
  misc_feature (292)..(292): n is a, c, g, or t
  misc_feature (311)..(311): n is a, c, g, or t
  misc_feature (320)..(320): n is a, c, g, or t
gggtcttgaaaataattccatgcatgtgggactttcagaagctctccatgtctgtccagaagggccccccagtatattgtggctcgtgccgaattcggcacgagaaaccattggaaagggagagcattagtacaactccaaaatgtttcttagaaaaagctaaggataaacagaaaaaggtcactggtcataacagnaagaagaaagtagctcttgaagaccaaangttaaaaacagactttatctgtcnagaaatgtaatttatgatccagcatgaatgtnatttcatggnatctttgaggcttacagtnacctgtacnaaaccattgaaatcaactccagtccatgggactgggggattgatccttct

SEQ ID NO: 539054 - DNA, 413 bp, Homo sapiens
agcgggctgcgcacgggaccggcgtttgagtggcaagttgtttgttacagcgaacaccagcaacatccccctttcgcactcctctccctttctttcacctcacactgccacactacaatcatcaccactcgtcacctcaccatcaaccctccccgaatctctctcccctctcaacacttttccgtcccgcacatcactctccacccaacagcatctatatcccacaacatgatgtcattacccctccccccaacaatctcactcacttcaaacttttattttacctatatacttgctcctacctcatccaattatacaacccctccctactacgcccagcctcttcacctcacccctctcatctcagtcccatcctccacatatcacatacaccatcccgacacccctctcac

SEQ ID NO: 539055 - DNA, 233 bp, Homo sapiens
atcaaagacacacaacttcaatgagaacctttctttggattaattaattaatgatatggagccttgatctgtcactcaggctggagtgcagtgcactaattcagctcactaggaatgcatctttctcttctctttctccacctcccaggtttaagcacttctcctgcctcagcctcccgagtagctgggactgcaggcacaagccaccatgctgagctaatttttgtattttt

SEQ ID NO: 539056 - DNA, 431 bp, Homo sapiens
agaattttgattcccagagtaccacatcattaagttcacggtcccattttcaacaagaatcacaaggtatataaagaaacaagaaagtatggcccactcaaaaaaataaatcaacagaaactgtttctgaaaaaggcctcatgataaattcacctagacaaagacttaaaacaactgtgttaaagacattgaaagacctaaaggagtatgtggggaacatcaagacaaaatgtattaacaaaatggaaataacagtaaagagatagaaaacctgaaaagaaaatgaaaaggaattctggagctgaaaagtacagtaactaaaatgaaaaattcaatagagggtttcagaggcagatttggcaggcagaagaaggaatcagtgaaattgaagttaggacaattaaaattattgagtgtgaggaacagaaaga

SEQ ID NO: 539057 - DNA, 860 bp, Homo sapiens
ggttccttgtgtgagctgacgacactcgagagcgccaattttcctagatgtcgatttggtggttggaactgtggtttggaatccagagtagtcgcctcgtctagtatccaatgctccagcagccaactggtgaagaagaccatcgatttcttcgtactcagttgcatttgagagcttgtcaaaaaccagacacaattggagacacaggttcttctatcaaggccttgactggaatggcatagttttcagatatgaccacatgctttgaggaaatgaggctgatgtagcagagctgataaagacccccacagaaaggccagcctacctctggtgtggccagatgagtacatgaccgggaaagagtacgaagagagagaaatctgaacagctgggtgtccgggggagacaatcaatatgtcagcaggttccgtgagtgcccctcaagccacaaaaacagcaagtttattagtgctttcaaaggggagggagtgtatgggtcacagagatcacatgcttcacaaggcaataaaaatatcacaagggcaaatgggggccagacgcgagatcacagtgaccagggcaaaaattaaaattgcttaatgaagctcgtgagcacgcatgtcattgattaccatctcaaccaggaggcccggggtttggagagacggaaatacggtctgactaaaattacttacggcgggaattcctcatcctattaggcggggagttgacgggaaaacgtggtattacgtcccttttttgacggcttagaaagacattcagggggcatttagaaccacaccgggatcagttctcctccaggggggccggcggacaaatcaggaacattcccatggtgg

SEQ ID NO: 539058 - DNA, 120 bp, Homo sapiens
cctcctctgtgctagtccacctcctctgtgctgtccgcctcctactagtgcctcctctgtgctgactacctctgtgctagtccacctacctctgtgctagtccacctacctacctgtcca

SEQ ID NO: 539059 - DNA, 595 bp, Homo sapiens
  misc_feature (513)..(513): n is a, c, g, or t
ctgccttactttcatgtgcacccagaagtcactcgaagcaggctgtttcatattccatgtaattgcatggttttcagtgatttcttagtatagatttctatctttattgcattgtagtctaaggacatggtttgtataatttcagttttgaatgtcttaggattgttttatgcctgattgtgtggttaattttatagtatgtgccacatgtagatgagaaaaatgtatattctgctgttttggagtggagagttctgtagatatccattaggcccatttagttaagtgttgagttcagatcctgaatatctgtgtcagtcctctgcctcaatgatccaatactaacagtgtggtgtcaaagtctccccactattattgtggggtattctaagtctctttgtaggtctctaagaacctgctccatgaatctgggtgcttctgtgttgactgcatatatatttagggcagttaagtcctcttcttgaattgagctctttaccattatgtaatgcncttattgtcttaagtgatctttgtagtcttaaaggttgtattgtctgcaattatagcaaccaagttaccgatcacgggtacc

SEQ ID NO: 539060 - DNA, 360 bp, Homo sapiens
ggaggagtcaccagtaggcacataaaaaaatcatgaccggctgtgcacggaggctcacacccataatctcagaactttgggaggccgcggcgggtggcacacctgcaggtcaggagttcagcgaccagcctggcccatgtggtgaaacttctgctctactaacaatgcaaaaattagccgggtgtggtggcacatgactgtggtcccagctactcgggagactgaggcgggagaatcactcaaacctgggaggtggaggttgtagtgagctgagaatcgggccattgcactccagcctgggctacagagcgaaagtgtctcaaaaaataaatacataaatagagacagggtcttcctgtg

SEQ ID NO: 539061 - DNA, 320 bp, Homo sapiens
ttttctattttaagtagagatgggatttcaccaagtgggccaggctgatctcaaactcctgacctccagtgagccacctgccttggccttgtctgcttattttcatcaccactacggtggtttaaatgtgggtccccttcaaaactcatgtgggaacttaatcctcaaggtgacagtattttttggtttggtttggtttttggagacagagtcttgctgtgtcacccaggctggagtgcggtggcatgatcacggctcgctgcagtctcaacctccccaagctcgggtgatcctcctgtctcaccctcctgagtacctgg

SEQ ID NO: 539062 - DNA, 124 bp, Homo sapiens
gtccctaggtagcagaagcagctagaaaagctcagaaagaacgttaagaaaccgctagctttaaggataaaaaatctcttggacaaaaattaaaagaaatttctactaactttaagaacatcaa

SEQ ID NO: 539063 - DNA, 339 bp, Homo sapiens
ctctggaattgtatacctgctcagtgtctgaactccttccttttcactactaagcattctccatgaagccacacttcattttgtcattgtgaggttgatggacatctagggcaaatctaacttctaaagaccaattcttacgaggtgtcatggtcaagcagaggccatggccggcactggtctaggtggcccatggcccatttgggggccttggtgggcctcgaggaagggcaggtgctggtcagggagccgggtcgctaggcagcaggtgggtgtcaccccagtccacgctgctggggtgcctggcctgatgcaggctgtgcctgagggagcctcatg

SEQ ID NO: 539064 - DNA, 345 bp, Homo sapiens
ctctacacggtccccccccgagaagctgactcttgagaatctggaaaacacccacaaaggccttaatgacctcataggcctctcccaaacctgactacagaactggaatgagaggcctgggtctgtctcctgcctttaggcacgcctatcattttcttgtcaatctctttaattccttgctcacctttaaaggaagcatggagttctaatgctcccataaactatgtatgccggcaagacacttcacatactcccggtctcactttccccatctgttaaacagggtttggactaggttttccctgctattctgtgatctgcctcttgctgccattctttctcacc

SEQ ID NO: 539065 - DNA, 415 bp, Homo sapiens
agtgagtataaatagctcattgaatatcctttgattctgattgaagtataccctttagcatttccgggggacaggttggtatagatgaaattcctcccctttgtgtgtctgggaaagtctttatttctccttcatgatgaaggatatttccaccagatacgctactcaagggtaaagttcagcagtgtaaatatgtcatgccactctctcctgcacggtaaagtttccatggaaaagtctgctgtcagaggtattggagctccattatatgttatttgtttctgccttcttgatgcttttataatcctttctttatccttgacctttaaagtttgattattaaatgccttgaggtagtcttctttgggttaaatctgcttggttctataaccatctggtacgtggggtaggaggt

SEQ ID NO: 539066 - DNA, 1833 bp, Homo sapiens
  misc_feature (218)..(218): n is a, c, g, or t
  misc_feature (1609)..(1609): n is a, c, g, or t
  misc_feature (1641)..(1641): n is a, c, g, or t
  misc_feature (1692)..(1692): n is a, c, g, or t
cccggttgtcacagtcccctggtgacagctctgacctgcggtcggagactgctggcacgagctagcctatcaggtgtgaggcgttccagagaagcttatcgtagttggggacggcgaacaattgagagtggaatagccgtcggcccgtgcacacgtgcgtgcatgactaaatatcagttgcgttctctctaatagtcgggtgcactggatcgactcgntgagaggcgccatggtggcaaggttacacgtatgagacgcggaggaagaggcccgagagaagtctcgtagtcccatgagagccaggatgaatctatcgtagtgtgctacttgaaaccatggagtgagtgagaggagcacgaaatagccatcagagtcccctaaccgtagagagaacccgtgagctggcttcaactcacttgcacctgcaggctccagcgatgggagcacacgtggttaggcatggtaccccgtgaggcttgatccccgtggcgttcatcgaggctagaacacaggacacagatctgtcctagggagaacccgagatattggcgtgaggttccctttatacccttggcaagcagtgtacccatagagtcatagttacatattgtgaccgattcacatccctgtggcattaggactttgcacatttgattatgggcctttgtgtatcctgggaccatgtacggcgaaaccggacacaacacttcgtgggcttttggaggaaaccccaaaggcgaacaaggcggcaccaacacccagttttggacggtaccgaataccggaatttccgcaaacgcaattgccagcgaaagggggcaaggggcttacccatgtgggctcgcggaccttggcggtcggattcccacatttttctcccctttaccaaacaataaaagttctttgaaggccggaccctgttgtgggcaacttccgcggtttacacggaacggcagttttccaacaaggcaatacactaaaaccaatggggtcctttagtaggaatttggagccgaaaacgcccccatggagattagcgccgcgtttttgaggacaacgtacaaaggagaaatgttgcccccggagcccaacactctccgcatctacttcgagagggcaccaaaattccctcaaatagtgaggtggacattgcggcgccgagaggcaagagaacctccaacaaacggcactgttccccacgtttctacaaattacagcgggctagacagcgcgagaggccatatgaacaagctgccggtacatacaaccccaaaccgagagagagagcgctgggcggaaaaggaaaacataccggggaacgcgctggcaccagcggcgtgtgcctctcgtgcggctgacaacaccacgcgtcgggcggcaaaaggggcacagagtaacagccccgcgtcacgtacagtattaccgcgacgaaacctgccccacggcgggcgcccccgcaggtactaattttggccggtacaaactacgagagtctccataatcgatctcaagtaaaaacgggggcaaatcttcacgaagcgtattcggtgaggttacatccgctacacccacaaatataaatcaccctggagtgtgcggccccgcggangcgttttgttgatggagaccacacccgtgatncagattgtcgtcgcctcagccccacgggtcattcatcacgagggatgatgntactccctcgcggtggcgacccccacacgtggatgaacaaagcaagagtcagccgactacagtgcagaaaagaggcccacacaacgtatcgatacacaactgcatattcaagagacttacctgtagtatatatttgctaac

SEQ ID NO: 539067 - DNA, 80 bp, Homo sapiens
gtttggggcgggtccgaggccggaagtgcgtgggctgcgggctggccagcttagggttttcaggaaattggaagctgccg

SEQ ID NO: 539068 - DNA, 920 bp, Homo sapiens
ggttataacatcctactgtgctcaaaaagctggggtctctgtagtgtataaaacaaggttcctacccaagaggatgtacaccctcgctaataatatagcaaacaggcatgtgaaaccataagccatttattgaagtcacttaaaaagtggcaagaaatagcattaagtgggctaaagcaggcgttacacgaggggaaaattgtcgtaaaggatacatttgtatatatggacccgtgaatggagaataaaagtcctatataagttgctctgaaaggtgataaaggtattccaggcaggcaaactggtatatacagtatgcattcgagagatagaaatgtgctgagtcttatctgacacctagtagaagtaaaccagtttgtagactcatgtggagtattggaatggaagaggaaatctgagaggactcatccgatagggagtcagggaattaaccgagcccaggcttaaggagtttggaacagggaatccttaaagcatcttttcccagaaagcatattctgaggttaaatatgtgtcgcatataagaagggggatgggggagtctgaaatccggtaagctggagaaagattaggtgccagcaccttgaatatccgtgggtacattgcccagttgcccattcgcatatatagtgtcagaggtccgaaaacttgcatggactgggggccaacagaaatgcacctacagttcaactgtgacaacagtttagaacaccaactggaaaggattgaggggcatgatggggtcacacaaaaaaaaaaccacaacaactggggcgcgcccgaaaaacacacacgagcagcgcacagaataaagagcaacaacacagcgacgagagaggagcacaaaagggagcacaaaagcgcaaacagaaaacacaacgcaagaaacaaagaaaaaa

SEQ ID NO: 539069 - DNA, 550 bp, Homo sapiens
cggatgcagcacactcttacatcccaagtcacctccataaccagtcaaataaacgtactgtctttaataggatcttttcaggaacaccataacttatggtgctttttcaaggtgaaatcgtgctgttatacctaagatgtttccaatcgaggaacagcataagttcaaataagccaatgtgtgatggatttggcctaaagtagataaagcaaattccactaagtcctgtaagagggttgacttgaagaaccacttcttctagtcatatatagtagatatgatgattcagcagtcataatttaggaaggcaacagtatactatacatgtcattattttcctcttaagtttgcatttatagaagaaggtggtgggggacaatttaaacttgagttctcaagttctaccttaatgaaataaaacaccattggataagtagtggagatgctaatttataaaatattcaccttcatcaaatttctttcattatcaactttttcacggatagcttctaaaattactattcttttatgcggttaatcttatgagaaa

SEQ ID NO: 539070 - DNA, 200 bp, Homo sapiens
cccaaagggggggggggggggggtccccctttggtttcccattcaggggggggggggggggggatttttcccccccccttttaaattgggccccggggttaattttctttttcccatttttccccccggggggggggggggtttttttaggggggggtttctttattttttggggcccaattattggggggccctgggga

SEQ ID NO: 539071 - DNA, 261 bp, Homo sapiens
ggggggggggggggggtcccccccaaaacccttttttttttttaccccccccttttaagggggggggtttccggggggcccccccccttcggggcccccccccccccctttttttaaagggggggccccccccggggggcccggggggggtgccccgggtttttttttccctttgccaaggggggggggggttttttttttaattttaggccccccccccctttgggcccccccccaaaaaaaaagtttttttggggggga

SEQ ID NO: 539072 - DNA, 380 bp, Homo sapiens
  misc_feature (270)..(270): n is a, c, g, or t
  misc_feature (346)..(346): n is a, c, g, or t
  misc_feature (362)..(362): n is a, c, g, or t
tggagaaggcgtcttgctttgtcacccacgctggaatgcagtggcgggatctcagctcaccgcaacctccacctcctgggttcaagtgattttcctgcctcagcctcccaagtagctgggaatacaggcacgccaccatgcccagctaatttttgtattttcagtagaaacgggatttcaccacgttggccaggctggtctcgaactcctgaccgcaagtgatccacccgcctccgcctcccaaagtgctgggattacaggcgtgacacncgtggcccggcccaaaggggaaactcttgtggggaggagcagaggggctcacatctcccctctgattcccccatgncacattgccttatctnttccccatctagccaggg

SEQ ID NO: 539073 - DNA, 480 bp, Homo sapiens
ggccctcatgccatgtcacaatggcttgtttcatgtagcgctcaatagcctgcagcatggtgctatcagtgatctggcagagggctcgcacggccgggccccggtagttgtcttctctcccagtcatgtctttgttaggctgcagggaagaaggcattgtcagcatgcagagagcctgggcctgtttactcctctccagctcccaacaccacccttgcccagattactacacgagcctcctaaccagtgctctccctctattcctgcccctccaagcctaactccacacagctgctggagggagtttcataagactcaaaaccaaacaggtcatccccctgcttttgctaaaaagtttccatagcttcctactgccagtgacctgaatgtaactccttgaacttccctaactggctatgctcactcctctccagcctttgcatgtgctgtttcctcagcctgtagcattcctcacccctc

SEQ ID NO: 539074 - DNA, 207 bp, Homo sapiens
acttctagctcggtaccctaatctttatctaccgtcaggccacctatataatatgctcagggagtgtatgtaaaggtttttctgaagatacaaaggccaagatatccagtatgcctctctgaacctcatcaagttagaggcaagcatagggttcccttccataaatttttgctgaatcacttgggaccactggctccacgactaggg

SEQ ID NO: 539075 - DNA, 893 bp, Homo sapiens
cggagtggtgactgtttgttctccactgtatctctctaccacaggcgcctctctcgagagctcgtgacccgcgttctttgggaagccctggttccgtccacacggcaccgttgggcctcgcggggcgcatctcaaaaaatccgtgccatcacgggtcctttaaattccataccacgggggttctcaaccgaggctctccacaaggaaatgtgccgctcgaaaaccagcgcggcgtgaccccgtgttaaagtataaccgccgccctttcccgcaacaacggttagggggaaattctcccgggctgggtggcaccccaacggaccaccccgggtggtgatttccactcgaggcaagcaacattgtgattgtttcccccgctcaaggcagacccagcagaaatgtgtagtcgtagcccccagaccatgaatcccaccgtttgggaaacaaacagcgggtacctctctccccctgtctataacagtctggtaacgcagaaaaaccccttgagggacaattagcgtgaaacccgctcgtttcataacgcagttaatggacgtggcgaagttcctatccacaatcaaaaagcacgtccttttgcactcccacctaggtgccactcgattggagcgcaagacgggcctcctcgatcttccccaccagggaaaaaatatctggtgtgcgagggtacgaaagaacagatgcggtgtttccccccaggacctcacaaatatctgtgttcaaagacgagctccagcatgccagtcgctcttctttagagtccattccacgcttttcttcccccacaggtatgaacacccgctccggttggccccctgttattcatttcaggcgggctttttttaaataaacagggtttaccgcccacatgtcag

SEQ ID NO: 539076 - DNA, 356 bp, Homo sapiens
tcataggtcgcaggcaggctagtagcaatcagattagaacagagggtgaagactccaggaacatatctccggggaagaaaatgaagctgtgaaatacttgatatacttgacaactgtactagtcagaactgtgttcagcatatatatacacagaaatatctagcttaggtagctccactaacatgaaaagttgccccaaacgactttgtttttcagcatctgtccaccccgcagaatatagttttatccttatgcttgtaacatgactactgcacctctaatcatcacacatgcattctgggaaggaatcatgagaaagggcaaagggtaaaatatacatacctgcgaacctatga

SEQ ID NO: 539077 - DNA, 941 bp, Homo sapiens
gaggtcaccatgtcatcatttgatcaatcgcagcaatgcacagtagacaggatattgccttcgtctaccagagaaggaccaaaaaggaacttgcatcagcatctgaagttagacttatctggccacctggagacggtgattctgtggcctattgaaggacacctgcgtcagtgatgacgcttctgagtctacaagcttccatgaggggccgctgggaaccgacagtacggactctctcatgtgagatcatctgctccagaaccaaatcagtgagctgctaggaaattaatagagtctacaaggaaatgtactatgagtgatctggatgaatgacattatttcggacacatctggtgacttcccgtcaagcttgatcggttgtcccttggcctagggtagaaagaagccgaggatggatctgtcattgattcatgactgatgtgaccatgatgctcgggatctctatgacgctggagtgaaaacgccaaaggaacctggtgttcccaattgtgtctgcatcatgaccgagctgaagttgcccactccagaaagtctttgatcgcgtaccagaagttcaggctcttttcaccttgtctggaaaagcattccacgcatacgaggtttcgttgcagcctggaaaactggcttcctgtaaacctggcttatggcctttacggaaccagccgcctgtttttggctgattcggctgtattaatcccgtaacgtgaagcggtacgcaaaataggcgcgtaccgcaacatggttcccccggtaagggtgaactttgcacgcgtgctgtgtacgcaatagacggcggggtccgtcattatttccgcacacacagggcggttccgacacgccggcccggtgtggcacgagaccacggctgcttagaggctcctcctggttcaacgcacaccggcagtgatgaaagccacgac

SEQ ID NO: 539078 - DNA, 817 bp, Homo sapiens
aacaaatcaaggttctcttaattttttggcttatatacaatgaagtaaaaacttgataaacatggtttcaaattgaggaggagagtcttggatgtatgttttaatatgtataccttataattctgcctctagccaaatgctatgttgcaaaatgtggcatctgttagtttttatgtctgtgtcttcttgtttatatacctgggtaatttgtgttaccaaaaaaaaaaaaaaaaaaggaagttgtaatgtgtcagacacacaagaaaacgcaaactccaggtgtgtgtaagcttaaagttacaattccaaaggctcatttaccaacagacagggtttttttgtaatacttataaaaacattatatgctacattattcattggccatttccatattttgggggtttggctactcttatacaagggaattcacgggaaatgtcatccagccacttgatttggccattattatttctaaaaacggtttctaagatgacagttatcactatttggttatatctccatgctgacttttgaaagagggtactagtatccctctagccagatggcttagtttccgtgggtaatccaaaacaacggtggtcctaagggaatagtaaagctaggacctaatcaggaatcatagtttgcctgcatatatggtcaccaggtcgtgttgctttggtttcacagtgattgcttgaagagggctgcacaagaacttatgtgacatttccaggtgttgaactaaaacaccttcttggctagcgtaggagagaaccagaaacggagttaccacatcatggcgagtacaaaagac

SEQ ID NO: 539079 - DNA, 159 bp, Homo sapiens
cagccgggtacccttctattacgtagcgttgtttgaacctcgcattgcttgagcacgtatatcgggtccactgagtgctgcatttgacacctcgcaactttccatttgggctacgcgagaacttaacagagagtggttgtgcaggttccactatccaaa

SEQ ID NO: 539080 - DNA, 1074 bp, Homo sapiens
  misc_feature (739)..(739): n is a, c, g, or t
  misc_feature (1074)..(1074): n is a, c, g, or t
ggcctatggaatccctgtatcaaaagccccaaaactggggaagaaaaaacaaatgggcaatgcctggatcaaaggctgaagttcggggtgcatgaaacatggtcaggataagaatactgagaaacacactcacataataattaggggggacagcagggggcagtgttctgttagagtgcttagaggggacgcaaagcagggtggggaaactgcttcacatgtgaatgcctagctatactccatggctcccgttgcttgcttccgagaagcttgcagaataccatgcaaggtacgtcatggcatggtcccaagctactcagaggtgcaaagggttctccccattaacaggcatggagcatcccttttctcgcctgtcccagacatgggatcttctatcgtctgcaaaggcctccagggaatggacgcgttgttctcccaaccagcagttctcaggtctcaccattcaggacggtttggactctgaatatcgtaacatgccagccaggatggcagcatcagtgtcctcatgattctgctcctcgagtgagacgacgggagaaccggatgctagatcgacctccaaaggaattaaaggcccttcagagacttagggcctgcgtgtgggcctccccagcgcttctccaagtcatcagggacacagaagtttcttgagaaagcttggattagccagcaacttgatgtttaaacttgcagctatgcatctttgttggtagcaagngtgccccgtaggataaggcaagacctcctgccatggtggggatccatgagagcccacagactgaggcagaaggtcctgaaagagtccgaagagggcgtatcagcttcttgaaccctggtaactggaggcctacaagggttcgtgaaaccagccaagtctcaagcttgagaaggactgggcatgggattccaatcaattggggtccccttgactcctgtgccagaaacgttcgaagggactgaagcattagaaagctcctggcaggccaatttactccaaacaacacagttacattcattagaggcaagtgtcaaagctggaaatgtgtggaaaan

SEQ ID NO: 539081 - DNA, 482 bp, Homo sapiens
agacagagtttcgctcttgttgcccaggctggagtgcaatggctcaatctcggctcactgcaacctctgcctcctgggttcaagtgattctcctgcctcagcctccggagtagctgggattacaggcatgtaccaccatgcccagctaattttgtatttttagtagactagggtttctccatgttagtcaggctggtctcgaactcccgacctcaggtgatctgcccacctcggcctcccaaagtgctgggattacaggagtgagctaccaagctcagccagtgtttgtattttcagtggacaagttttttacttcctgggttaattttttcctaggtattttattcttttgtatcctatgggaaatggagttgttttcttaatttccttttcacgttgttcattgttagtgtatagaaatataactgaatttttgttgttgatgttgttgttttgagatggagtttcgccctttcacccag

SEQ ID NO: 539082 - DNA, 151 bp, Homo sapiens
  misc_feature (131)..(131): n is a, c, g, or t
ttgtgcatcctaagcgctcgaagtatcaaaataggaaaaaaaaaatcttggaaatagccaattaagttgaataaaaaaatccacacgaatgcggttgggtgtggggcaggaatccactcctatgtgcctgngtaatctggatcccgcgtcc

SEQ ID NO: 539083 - DNA, 625 bp, Homo sapiens
cggagagtagtccacaactgccaggggaactgaattattcagaggatgaactcacgtcaaatacgtgtggaaaagccaaattctttaattactcagagcttcattgtattacacaaatgggtaccagagacggaaaaaatgccacaagtgatgccttaacttcggtcttgacaaaaattaatcgaatagatatagtgacactgctagaaggaccaatcatcgattatggaaatatagcaggcaccagaagtttggcagatgagaacaatgttttccatgaccctgttgatgtcagaccaaatgtactgtcttccataggttatccttcccttcaagtggaacgggcaacccccacagggttgcactacacaccacctacccctttccagcaagatgattattgaagtgatatctctagcatagaatctccccttagaacccctagtagactgagtgatgggctagtgccttcccaggggaacatagagcattccgtagatagacctccagtcataactgcagaagacgcttccttagaagacagcaaactggaacactcagtgcctttacagaaatgcctaagcagtgatgtaaaaagacccgtggggaagttttctaataggaa

SEQ ID NO: 539084 - DNA, 143 bp, Homo sapiens
cggcagtgtcaacgacggcagtgttaacgacggcagtgtaaacgacggccagatgttaaacgacggccagatgttaaacagcacggcagtgttaaacgcacggcccagtgttaaacgacggcctcgtgttcaacgacggccag

SEQ ID NO: 539085 - DNA, 600 bp, Homo sapiens
ttttgttttgttttgagacggagtcaagactcagcccctaggctacagggctatggcacaaactccgctaactggaaggttgttgccccatctccaaagcattctcatgcctgaaactgcgacagctgcgacaacattgtgcatatcacaaaacctggcctgggacagagccgcgacctcaaactgccttgggaacccctgggggggccctggaagacctaaaagcatatgaccagtgaccttagacgcgagccttttaacaagtggggttgttttccttggtgcctttggcgagcaccatgcttgctgggtgccgttgccagacaacgagggcacgagccgccccagtgtcatccctttcctatgtaccatctgaatagatacattagcaccctaccggagacatgagtgcttatgaggcttgttgatcaggcctctttagggattgatctctattgcaatattatcacaatatgggatctgcaggcataacctaggaggaaccatgccatacagtgataaagagctgcaaggactcggtgcgaattgccaaaagacctagcgtgctgccccaaagttaagcctgacaaggccaccagg

SEQ ID NO: 539086 - DNA, 857 bp, Homo sapiens
gatttgggtggagtattatgtttatatattataatttagaaataccattttataattttactattccaggtgacataatgcatttaaatttgggatttgggtggagtatgatgttaactggagttgtattatgattccctcagaaaaatgacgcgtggctgatagttaaataagatgtttggcaggtttcctacatactttgtgctctgcctggagctgtatccagtatgatataagacagcaagtgtagtattccattactatgtggcttagggatatatttgtccctaaaatcaaccatgttagctgggattagactccctaacagtaccttcaactggaaaagtaacatttaaaaaatcctttgggtaattcacattacagcattctaaaagagcttaagatctggctgtattgttaatgcttctgttctattccagcaagcattaaggtaacccattgccaagatatcattcttgcaaaatatgctttcatatcacctgaacagtgcttaataaaacaagcaggtacttacacatcatacctgccacgaacgctctcaatcgcgcggtccaacacataccattgacataccacgaactggctgcccaaactgcacgcacaatactccatccaatcgtttctgtacgcatcgcattctaaaaactggaaatatacttcaatagacctattaaaacgttatcaacaacatcaaaccgtaccttcaatattacgtcaaactaacatacaagactaatcaacaacctaaactaatataaacacaatacagcaaaatacacatacacactcaaacaatctactcctcatattttacttcctccactctctacacatta

SEQ ID NO: 539087 - DNA, 1006 bp, Homo sapiens
cggacgcgtgggtcgacccacgcgtcggggcgcggtgcacagggtgccgctgaccgaggcgtgcaaatgactccagaattggaggcatgatgaagactctgctgctgtttgtggggctgctgctgacctggtgacgagtgggcaggtcctgggggaccagactggtctcagacaatgagctccaggaaatgtccaatcttgtaagtaagtacgtcagtaaggaaattcaacaatgctgttccacacggggtgaaacagtatataagactctcatagatgaaaacaatacgaagagcgcaagacattggttcagcaacctagaagaagccagagtaggacgaagaggaggatgccctaacatgagaccagggaatcgagtagaagcaagcttgatggagctcccgaggtagtgtgcacagtgaggacctatgcatggccctctgggaaggagtgtaagccctgcctgaagtgtgcgctgctgatagttctacagcgacgcgtttgcacaagtgtgcgtcaggcctggttggcccgccaagcttgaggagttcctgaatcagagtctcgcacttctacttctggatgcactggtgaccgtatcgaatccctgtgggatgaacgacccggtagaagacgcacatgcgtggatgtactgccggaacatttcagacggcgcgtccaagtatcatagacgactcttcaaggagaggttatctacccgggagcgccaggatacgttacagtaactgcgcttaacctgcccacggagctcaacttaattccaagtcccaatgtcgagatgatcgcctcctttcgagaacgagactacacgccagttcacccttcttaaatagaagggtctaggcggaacgtcaaaccggccagtcaccagaattcacagggcaatcctgttgtaaatgtcagatgatataaatgatatgatttggtgcacgcttctatgcgcaactagaggcaattcagtcactaaggtcacatactcaccaaa

SEQ ID NO: 539088 - DNA, 285 bp, Homo sapiens
accgtccgtcgcgacatcgtcgacgagggcgggatcagcaacttcacaggcagcgcgggatttgcctgacccgcacacccttcgcggtctcacggaagtgccagaactacctgatccgaagccagtcgaaggggtcgtctgcccaaaaacttccagtgaccgtcactgacgtcgaggggagcaaggtgacgatcaaaagcaccttgagaattctcgctcttgaactctacggcaccttgtcacgcaccctcattgaacttggattgggcgacaagatcggcgggc

SEQ ID NO: 539089 - DNA, 163 bp, Homo sapiens
ctcccatgaagcacaggtgtcagtttcgagaagctatgttagcagctttccaggcggccaggggagtccacggtgaaggtgccaaagactccccatttgatggttttcggtgagagagcaagaagttgagagatgtgatgggacatgggaacacattggagtg

SEQ ID NO: 539090 - DNA, 659 bp, Homo sapiens
ggaaagcagagactcatctcgaatttgaagtgaaagatcctgatctggagagcccaggggagatgacatgttagtgatgatccggatgctgtggagatgacatctgaccacctggtgcgcaaactggtccataaaggagtagtcctccagtgaaggtagggtttggagccttctcagagcactgcatgccaaagtgccgcatggctgcgaggacatagaatttcctgacatgttcatgatcggaaatctagatgtgtcgagcttggaaggacctgttgtgtgcccagtgcctggttctccgagcactcagctttctaggcttctctgcacccacaccaatccaaggccctgacctttggcacctgccatccgtgacaaactgggacagtccttgtgggctgcgtgagacaggaagtgggaaaactcgttgcctttgccatcccaagtgattcatgcggtgttgcagtggcagaagaggaatgctgccctcctccaagtaacaccgaagcaccacctggagagaccagaactgaggccggagctgagactagatcaccaggcaaggctgaagctgagtctgatgcattgcctgacgatactgtaattgagagtgaagcactgcccagtgatattgcagccgagggccagagccaagactg

SEQ ID NO: 539091 - DNA, 853 bp, Homo sapiens
  misc_feature (72)..(72): n is a, c, g, or t
  misc_feature (843)..(843): n is a, c, g, or t
ggcttgcccagtagaacagaccaatggcatctagactgatgatactaagtttagcagacactagtaagtggntgtatttaaccataatgatgaagcagacagatggaggcacagattttagtggcttgtggcaataaatagggcatggtgtgccttaggaaaagaatgtttataaagggaattataatgaaattaaaggaggcggcgtgaagaggaaataattctcttctatctaaatgatatacatatgatattcgagatttttataacagcagtggaaacacaacttctaggtagagtacgaaaagaggaaacgtttctaacgaccttataaaagattctgtgtgtgacaaatttatttgggtagcaacattctcaaagtggttacctgctatataagggtctgccataatagagtttgggcactattttgctaccaaagttgtgattcatacattctaaaaccattggtagttactgtgtcagggacttacgtgtgcaacactcattgtgccaggccaacatagattatcaacttttttttactatcagcatatctgggtatttctaaaaccattttacgatgactttacacgtattatttaggcaggtacccttatgaggttccaagtgggacaatttctggtaattagcgccttcactcgataccttggtccccgggttgtcaccatggtccttttgtgggcgcccttgaacccgaggtggtttccgacgcacttcccaacactggtcttagaccctacgctgggggaactctccctttctgggaacaggcgtgccataataacgggcacatcccattcttctggacggacggcgtcngtcaatgtgg

SEQ ID NO: 539092 - DNA, 415 bp, Homo sapiens
tgttcatccagtggttgtccatttagtatatgtataaaggtttcacttatattctcatggctcgatagctgatttccttttagtgctgaatattattccatggtctagatgtaccaaagcttacgtatccattcatctactgaaggacctcttggttgcttccaagttggggcaattacaaataaagctattacaaacatgggtggtgtgcatgtacgttttcaactcagttaggtaaataccaaggagctggcatagctggagtgcgtggtgcagacagtgtgtagtttggttagaatctgccaaactgtcttccacagtggccatcacattttcatttctaccagagccaggggcacttcactcatttatggatccttattcccaagaatagttacggagcatctacaatagg

SEQ ID NO: 539093 - DNA, 145 bp, Homo sapiens
attgctgtcccagttcttggtgaggccgaggtgggaggatcacttgaacccaggagttcgagaccatcatgagcaacatggcgagacttcatctctaaaacaaaacaaaatatctatcctccacaatgttttgaagcaaatagta

SEQ ID NO: 539094 - DNA, 349 bp, Homo sapiens
  misc_feature (341)..(343): n is a, c, g, or t
ccattgaattgggataaaaatgccttaaaaggctgggccccagtggctcccaccctgtagtccccagcactttgggaggcaaaggcgggaggatcacttgaggcccggactttgagacccagcccgggcaacataataagacttttctctactttaaattttttaaaaaattagttgggcatagtggcacttgcctgtagtctcagctacttaggaggctgaggtggcagaatagcttatgcctaggaggttgaggctgcagtgagctgtgattatgccattgcactccagcctgggtgacagagcaataccctgtctttaaaaataaaagctattacccnnntttaaa

SEQ ID NO: 539095 - DNA, 405 bp, Homo sapiens
gggcccttaaccctgagctcacagaaacatgtgttgtatggaatcaaggtttaacggctctagggctgtggaggatgtgccttgttaacaaaatgtttacaggcagtatgcttggtaaaattcatcgccagtctctatagaccaggggcacaatgcactgtggaaagccgcagggacctctgccctggaaagctgggtatggttcaaggtttctccccatgtgatagtctgaaatatggtctcatgggatgggaaagacctgaccatcccccagcccgacaccctgaagtatctgtgctgaggaggattagtaaaagaggaaaggctcttgcagttgagataagaggaaggccactgtctcctgccttgccccggaactgaatgtctcggtattatactcgattg

SEQ ID NO: 539096 - DNA, 127 bp, Homo sapiens
tgaagaacgtcactgggatgagggatgtcactgggactgacggaacgtcactgggactgaggacacgtcgactgggatgacggaacgtcactgggatgaggaacgtcactggagactgaggacacgt

SEQ ID NO: 539097 - DNA, 231 bp, Homo sapiens
  misc_feature (61)..(61): n is a, c, g, or t
gcctactactactaaattagcaggcggtcgacagccagcctgaccaacatggagaaaaccngtctctactaaaaatacaaaaatttagccgggcgtggtggtgcttgcctgtaatcccagcatcgggaggctgaggcagaattgttgaaccaggagtcaagttgcgataccgagacgtgcattgatccagcctggcaacgagtgaacactgtctcaaaaaaaaaagtcgac

SEQ ID NO: 539098 - DNA, 1109 bp, Homo sapiens
gggagcaatcatcggggtctccggcccgtcgactgcgctcgcatgatggcggatcgagccggtgcatttagcgctaaccgaagtttagggctggagtggaatgtctgaaatacgggttctgcgggatggacgagtcatgtggcttgtgctacgagagaaaataatagacgaggacgtggttccgtcgtcacctcgtcatacgggttcggaccggggcgagaatcacgaggacacgattgtggaccaagccgagactagatcctggtgatctcccttggggttctaggacataggaccgtacaaacaggcccaatgcgatagaactcacgccatggtagcataaccttgcggaccccagctctcagtaacgggctggggtgcaaaaggcaataaggttgggaaacaacactcttgggattggggctcggcagggcaaaaaacatgtcctagggaacccatagccttgatgacacggggaatgggaagccccctgccgccattggggtagcaccccgtgggacatggattgggaccatagtaggggacccggggccccacgggggccttacgcaacgtggcaaactggctcgcacacgggggcgggcatccccagggtgcatccctgaaaggcacacgggcaaaagaccgtctttcaccggaacaatctccgtcccacattggcacctctagagttccctttatgaattaatatacggggctattgcaaaagggcccacgccaattagggtttatgcgacatggggaggtatagacggggatgtaagtatcgtgtgccctgtgggatatagctattatgggcgttgtttacaaagacacacaggtgttcatgaaatcagtcaattgattgggcagaaaatgctaggaggaaaaaccattgccgccacccggcatggctccactccaacagggcccgcgccagaccacgcacaggccagcgcacggcgatggaaccctgtgcgggcacgccgaagaccctgcaccaacaaccgccgaaccacacccgaggcgccccgccaaacccggcccaaaaggcaacacgaccaggcagaggccccaacggaccagcacccccagggcgacccgggacg

SEQ ID NO: 539099 - DNA, 238 bp, Homo sapiens
ggtgacttagaggatttagtcggcgccctttttttccccgtcatgcaactcacagcttgctatatatcctctccctgtcctgcagaccggagtttagagatcaaggcatctcagggctgtgctccctctggaggctctaggggaggatccttcctgcctctcccagctcctgggggctccgggtgtccctgggcttgtagccgcaatcactccagatctcgtgcctccaatcatccac

SEQ ID NO: 539100 - DNA, 449 bp, Homo sapiens
acaccggatcaggtttgccatggccatctttttctttgagttttctctgctcatgggcaaagaaaaaacaaggggagagcttcgagcgggagtacacaatgggttttggttcttcaaaattgctgcccttattggaatcatggttggctctttctacatccctgggggctatttcagctcagtctggtttgttggtggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaggttcttcatcagtattaacctgatccttt

SEQ ID NO: 539101 - DNA, 249 bp, Homo sapiens
tttttaaaacccccccccggcccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaaaaa

SEQ ID NO: 539102 - DNA, 977 bp, Homo sapiens
  misc_feature (1)..(1): n is a, c, g, or t
  misc_feature (132)..(132): n is a, c, g, or t
  misc_feature (748)..(748): n is a, c, g, or t
ncctttttgattgggcccaccttttctgggagcgccacgaattgccttagaggtatccgcctcctcccttggccgctgccgtgaaccccaacaattctctccgggggttaaccccccggtggtcgttgtaanggcaaccacggtggagcccggtggtctccgtgtccccgtcgccccccgccgtgtctcccttggcgcgccgacggcggttctctcggcgaatccccaccgccggtctttgtgcgcctttctcgctgcgtttgtgtctctagagccaggggagccccacacgccgtagtgtgacgtgtctctctgagcgaccgccacagcgccctccgtcttagccccttgcgttagtctcagcttgggccgcccagccggaccccctttctccgcgcacacttttgtcgagatatctgtaccacaggtgacctccgccctcatgtgtaaccacagcttgagcagtccccagccccggctttggtctcgcttctttttccccacggtgcccgcgttgggggagtgacgatctccggtcgagcccctacacatctgttccccacccagcgttctttggacccaatgcgggaacccgtgtttgaagatttgtgcggccgcgcccctgttcccacccccgagccagaaagcggcgttctcccccacaccggcagacaccctgcggcttactcatgagacaccggttaccagaggacccaatccatagcagccccaccatcatggccatacntacattaagagagaccccgcagatgtgcgccatattccagagccataggggattgatcggccgccagagttaagaacaccgctcccgaggccccccctttggggtctgggccctgccttaggccagcccccctctttggccccctcccctcaggccccgggcttggaatgaaaaggactctcaggtggtggggtggggaatgtgaataaacctgatttcttgcccggga

SEQ ID NO: 539103 - DNA, 753 bp, Homo sapiens
  misc_feature (294)..(294): n is a, c, g, or t
  misc_feature (296)..(296): n is a, c, g, or t
  misc_feature (317)..(317): n is a, c, g, or t
  misc_feature (412)..(412): n is a, c, g, or t
  misc_feature (568)..(570): n is a, c, g, or t
  misc_feature (572)..(573): n is a, c, g, or t
  misc_feature (576)..(576): n is a, c, g, or t
  misc_feature (582)..(582): n is a, c, g, or t
  misc_feature (589)..(591): n is a, c, g, or t
  misc_feature (597)..(599): n is a, c, g, or t
  misc_feature (607)..(607): n is a, c, g, or t
  misc_feature (614)..(614): n is a, c, g, or t
  misc_feature (617)..(617): n is a, c, g, or t
  misc_feature (620)..(620): n is a, c, g, or t
  misc_feature (625)..(625): n is a, c, g, or t
  misc_feature (628)..(628): n is a, c, g, or t
  misc_feature (648)..(648): n is a, c, g, or t
  misc_feature (650)..(650): n is a, c, g, or t
  misc_feature (664)..(664): n is a, c, g, or t
  misc_feature (671)..(672): n is a, c, g, or t
  misc_feature (676)..(677): n is a, c, g, or t
  misc_feature (682)..(682): n is a, c, g, or t
  misc_feature (698)..(698): n is a, c, g, or t
tgaccactcggtgaccgtcgatcgttttggtgatgatgaggcatttgaagaaaacgtacgcctggaaatggagcgcaaccacgaacgttatgtgttcctgaaatggggaaagcaagcgttcagtcggtttagcgtcgtgccgccaggcacaggcatttgccatcaggttaacctcgaatatctcggcaaagcagtgtggagtgaattgcaggacggtgaatggattgcttatccggatacactcgttggtactgactcgcacaccaccatgatcaacggccttggcgtgctggngntggggcgttggtgggatcgangcagaagccgcaatgttaggccagccggtttccatgcttatcccggatgtagtgggcttcaaacttaccggaaaattacgtgaaggtattaccgncacagacctggttctcactgttacccaaatgctgcgcaaacatggcgtggtggcgaaattcgtcgaattttactggtcggactggtctggatcccactaccgttggcggatcgcgccacattgccaataatggtcgccagaatatggtgccacctnnngnnctnctcccnaatcgannnctgtannncctcgatnacatgcngtntancgcgngcncagcgaacatcaggtcgagntnggcccgacaaaatnatgccannagcnncaggngcattgtggccgtaancccgggcgacagaaccacatctaaacaagcaccctacagacctggcattgaatgc

SEQ ID NO: 539104 - DNA, 397 bp, Homo sapiens
ctagagtttccccaccacctgcgtcatggtcagcatcgccagccacttgatcagatccattttggtgtcgcgcgtatgcaggctcacccgagccacccaagagggagcgcagcaaagcgcagatagcgcgcggcctttgccagcgtcacgatcaacaggaagctccagaagggttcgcgcataacaccggctaccacggtaagcggatcaccaatgatcggcacccagctgagcagcagtgaccagcgaccgaagcggtgataagcctgctgggtcttttccagtttgccttcgctgacgggaaaccagcgtttgtgccggtagtgctcgatagagcgacccagcagccagttcagcaccgagcccagcacattacccgtgggactcaggtggtgtg

SEQ ID NO: 539105 - DNA, 281 bp, Homo sapiens
cagtttacagtcagggattgaaggtgttgggttctactggatgaagggcttaaaatcttcacactactaatttgggatatgtgggtagatatttctaaacctcaatattctgtaaaatgggaaaaaacaaaaacatttaccttaccgcattgttcaaaggcttaacggaaataatccatgtccgatgcctaatggaaaacctggaaccaaataagttctcaattaactgtaactattaacttcttattatgcattggctgtccaagggaaactgcatttta

SEQ ID NO: 539106 - DNA, 258 bp, Homo sapiens
ggtcgacaatttggttttttttccttgctgatatgagttccctgtagattctggatattagtccttacattcattcttaattctattttctctcttcattcttgttttatggtccttatttgataaaatgctatactgcgctgagcatggtggctcacacctgtaatcccagcactttgggaggctgaagtgggccgatcacctgaggttgggagtttgataccagcctggccaacatggtgaaaccctgtctctacc

SEQ ID NO: 539107 - DNA, 335 bp, Homo sapiens
aactttggagtttttatggtagtaaaatgccggaaaaaaaattttgccttgaaagaatgtttaactgctttctataatgatccagccttttatgaagaatgccaaatggaatacctgaaggaaagggaagaattcagaaaaactggaattccttcaaaaaaaagggtacagaagcttcccacaagcatgtaggcagatactccaatggccttcagggactttaatattcatggaagtccttttatagtccttaaataatgggctcaagcatatatgtttgctttcccttaattatggaaatattaactttttttgaaataaaaattttttttcca

SEQ ID NO: 539108 - DNA, 422 bp, Homo sapiens
tactaagaatctctgaatttaggaacatagatgtaagcgcttgtatatctaggttttccagttcccagggccattaaacatttttttcctttcctttccttcttccaaaaaaattggtgattcccctgggtccctgtggtttaacctcacaaaaggtccatgatgacaccctgttacattgttttgtcgtagttaataccttgttatcctagttgctcagtccgtttttgtgagagattcagggatattaataaaactgtgctgctactgctactaacatcttgcataaaagccctattaattaaaatgtttattttgcatgtgatttgaacttgtaatttttattcaaagtttttcaacagagatccagaaaagaccctccttatatttttagttttgtgcattgcaacactttctagtaa

SEQ ID NO: 539109 - DNA, 219 bp, Homo sapiens
tgtaggaggagtagggggtgtggccataggcattgccagagtatgcacttcctgtgtggagtgcacagaggggagaggcctgtgaggtgaagggcatcaatgcagggcttgtggtgtgtgaaggtctgtagggctgtgcaatgggcaagctcagtgaatgtgggtggggatgacagttggagccacggtagtgagaatggatgctcagaaggtccgtct

SEQ ID NO: 539110 - DNA, 299 bp, Homo sapiens
ccttgaggccaccgtttgaagaaaataaactatgttaacaggaacatccagaatttgtaggctgagtggtgttgggggagggtaggatggagtcgggagactggaactccttggcacacacaacagagctatctctaaatgctattggtaacagctccacagacaggaggcctgcagatgccttcctcttgggggtaggaatgttcatttcagttagagaaacttgataggctcctattagtggccaacatagtagccagggctgatggtaggagaatatctggaggcggtatgaaata

SEQ ID NO: 539111 - DNA, 188 bp, Homo sapiens
tatagtgtgagcaaaggtcctcctctgtaaaagtgaattgcacgctcacttgaaactatcgttgagggactaaggtgtacaactcctggtgcttatgacagtatgagggctctagtgtagacagcgagctggcttgtgaaacttgtacgattccgtacactccgccctttcgtggcagttctgggtct

SEQ ID NO: 539112 - DNA, 310 bp, Homo sapiens
gtttggtttatttggctccctttaaaaaaaccccgtgggggaaggtcttttttttcccctcctttaaaaaaaaaccggattgcccttttggccagggaaaggttttttttgcccctgcccccgggtttgttttttaaagtacctggccccctaaaaatgccgttggttaccgggtgataaaataagcaggtttttttgtttttggtttttccggtgggggggggtctgtatttgtgtacatggtgtgtccttgcactcacacccaaggtggattaaaatacaggcctgcaaactggcctgcactttaaaa

SEQ ID NO: 539113 - DNA, 244 bp, Homo sapiens
cgacccacgcttaatggaatccccttaacgataagaagcagtgaataaataagactgcagaagataaactccctgaatgtgaagcagtatgtggaaagcccaagaatccggcaaacccagtgcagcagatcatgggcgaacacctgaatgtcaaagccagctttccctggcaggctaggctggtctaccaccacaatttcgcctcaggggtcacgttgataaatgagccgtggttgttgctcgc

SEQ ID NO: 539114 - DNA, 758 bp, Homo sapiens
  misc_feature (45)..(45): n is a, c, g, or t
  misc_feature (60)..(60): n is a, c, g, or t
  misc_feature (71)..(71): n is a, c, g, or t
  misc_feature (107)..(107): n is a, c, g, or t
  misc_feature (321)..(321): n is a, c, g, or t
  misc_feature (371)..(371): n is a, c, g, or t
  misc_feature (436)..(436): n is a, c, g, or t
  misc_feature (485)..(485): n is a, c, g, or t
gatctccctggcctccggtcccaacttcgcttctctgctgacccnctctcgtcgccgtgncgccgccgagngccaaaatgtctacaggtccaactgctgccactggnagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccgaagttgaagaggaaatattggtggacagaattgcaagatgtgggcaantcgggattactgttctggttatcttcatcatcatcatcatcgtgtgggtngtctcttcatgaagaaccagcggaactcaaaactgctgttcaagaaacctcttcaagactttggnacttagaacctgctatattatcaagcttacctactgttatctctaaaantttggtgtaactgtacacgtcgaatttctagggaaacgtgccttgggttttaatattgcactccaaattagaaggccgcgccgtccacattttgacacagtgccttaaccgatttaggtatggcctgatgaagaggcttcttagttccagaggctattatcctgatgtcatgttgcctaataattgcatacccccagtagttaccctgtcaattggcactatttcagaacccatttaaacttgggtaacagattccactatagctccagaaaa

SEQ ID NO: 539115 - DNA, 868 bp, Homo sapiens
caaccccaccagcgaacaggagagattaacaggaaacaacagcggcagagagaccatacagtgccggggcgctgtggtttccagacgtaaacaaggttgcgccccctaagcggtgtcggcacaccgcctgaaggcccagtttgcaagcacgggtctttctcacgcccccctcctcggctcatggcaggtcccgcaaattgctggcggtgcccaaccagggagtgtggtcccgcgagcccagggccgggtaaccagacaaagcaggaactactggggggagcccccagggtccacaaagggtgccaagttctctccgctggcggcaaaattttccgagcgaccccttctgagagtcgcccccgcggtccgtcatcaacctcgggggtccctaagccacacatcacccaaggggggcaccccccatctggacggccggctgatgaacataccatcaccaagggcggggtttggcggcacaccacaaagagaccgtgctgcttctggacgacaaaccgcctgtgtggcgcacatccatcgtgagcataaaacggcggccaacttcccaggggagcctgaagtccattcgaatgttccaaactctgtgcaacagcctctcaaaaggcggtaaataattccccgcgggcccacaaatagagcgtcgccccccgcgcgtggggagaaggcagcgaaaagcccaccccccttggtgcaaggcgcgatgatcttcgggctcacacggcggaggaggccccctcggcccaccggcgttcaattaaagaaaagaccacataccaagggggcgtccccaaaatattttttaccaccgggggggttaacaaaccggaaccagtttcccaataaaaaaaca

SEQ ID NO: 539116 - DNA, 736 bp, Homo sapiens
  misc_feature (45)..(45): n is a, c, g, or t
  misc_feature (60)..(60): n is a, c, g, or t
  misc_feature (71)..(71): n is a, c, g, or t
  misc_feature (107)..(107): n is a, c, g, or t
  misc_feature (321)..(321): n is a, c, g, or t
  misc_feature (371)..(371): n is a, c, g, or t
  misc_feature (436)..(436): n is a, c, g, or t
  misc_feature (485)..(485): n is a, c, g, or t
gatctccctggcctccggtcccaacttcgcttctctgctgacccnctctcgtcgccgtgncgccgccgagngccaaaatgtctacaggtccaactgctgccactggnagtaatcgaagacttcagcagacacaaaatcaagtagatgaggtggtggacataatgcgagttaacgtggacaaggttctggaaagagaccagaagctctctgagttagacgaccgtgcagacgcactgcaggcaggcgcttctcaatttgaaacgagcgcagccgaagttgaagaggaaatattggtggacagaattgcaagatgtgggcaantcgggattactgttctggttatcttcatcatcatcatcatcgtgtgggtngtctcttcatgaagaaccagcggaactcaaaactgctgttcaagaaacctcttcaagactttggnacttagaacctgctatattatcaagcttacctactgttatctctaaaantttggtcttgtgttgacatgtaaagttgcacagtttgctaggaagacgtgccttgtgttggtgtacatatgcgactccaaatgagaaggccgggcccgtccgacatttatgcacaggtgcctttagcagacttcacgtatgggctgactgaagaggcctgcttaagttccagagtgctataaatctagatgtaatgttcgtcactagattaattgccattactcccagttagttacccttgtccatttggg

SEQ ID NO: 539117 - DNA, 779 bp, Homo sapiens
gaagccctcccttattttaagtaagtgattaaatcttatgtgagttgccagttgtaatttttcaaaggaaaaatttgatggggtggaggaatgaatgccagataatctttctggaattccgagagaattccaaagagggttttttttttttttttaaaggacatctttggatacctttaaaagaaccacggtcaagtaatccttaaaagaatatctgggaaagggacaacagattttttccgggtgtgtaagcacataagtgacgttactttggccctaaccctagggatgattctttacccagtttaaagcccatcagggtattctaagggggtggaccccctccatcctcagagcgggtcgaacaattttaaatagacgggggactctatgaggggcagccggggcttttggactacagttggctattttcggggactcacatttagtacgggtcaatagattctatcttaataatcctgggacgaaaccgcttggtcagttgggaatttcggtagaccaatggttggttttcagacgccatgggttgcagaagggtggctccacgtggtgtgtgatataggcttcctggggctgggtgggggagacctccatcttccaggtggagcggtaagaccacggtttggggccattggcatgcccggtcttgcttccccaagttggtctttcacttttttcccggcgatgacttccgaccatacggggctagctagccagggttactcccgcggggggcctcgtacctgtctcgtctgtca

SEQ ID NO: 539118 - DNA, 880 bp, Homo sapiens
  misc_feature (1)..(1): n is a, c, g, or t
  misc_feature (3)..(3): n is a, c, g, or t
ncngaatatgaatttgaataaagtagcggaataagtagcagcaatctcgtcttgtccacaaatcaccgcgattcttgtgagacatatttccgtggcatggatattctctaatgggtgaggaccctccatcgcgcttgtggacttattgagcccctggaaatttccgatgagcacccgccgttttctgtgcctcctctgtggttactcgccccaggtctcggttgtattttagccctgcaagtgggttcaccgagggcccacctggagacgactctcacccaatttctaggctgtgcttcctcctttgccccccagcgggcttgctcccccgcataccgccctgtccggctccactgcacccaacaccccaagttaagtgtattcccccgcacgatatggcagagccgcaccatgctgtttgcaatttcccaccgaaccagaagtcctgtgcttgttcccccccagggtatcccgttgcccttccccaccagggaggtagataacctcggacccactaaattttaatatggaaggcaacacaaagagagggtcttagaaaagggggataaataaccacaacaccgccgcggaagcaggaccacatgcgtgcgccacccccccagccgaggggatgctagcaaggcgcctcagaagagccttgagcagtcatggtaactggtaaccgcccccgcatagcagtagaggaacacactcggaaagcagcctgcagggggcgctcagaaaacgcccaccaccggcctatcctgctatgctgactacccgccgcgtatctccgcaacggtgaactagcaacaaagggaaaaaaaccaatacaagatcaagagtaaaaacaaaaaaacataacggcccaacaaaaaca

SEQ ID NO: 539119 - DNA, 360 bp, Homo sapiens
atctacaggatctccgtagcagcgcagcacataatgaaaacttccttaatacatcttggagctccccagctggcatgggcagtgggctctgtgatccgagtgatgaatccccttcacaggaacaccactggaccttgtccagctggaacagaataaaggcagttttaagtgtggcttgtgtgcaggttttccaaacactgggtgaagactggtatagtgctggtgggtgtggcccaggaccagatactaaacccccgatctgtggcagggggcttcgtctatacttaccagcttgttgaccatggggaaaaactagagtttttgcacaagactcctgtggaagaggtccctgctgctatt

SEQ ID NO: 539120 - DNA, 640 bp, Homo sapiens
  misc_feature (35)..(35): n is a, c, g, or t
  misc_feature (63)..(63): n is a, c, g, or t
  misc_feature (128)..(128): n is a, c, g, or t
  misc_feature (136)..(136): n is a, c, g, or t
  misc_feature (148)..(148): n is a, c, g, or t
  misc_feature (182)..(182): n is a, c, g, or t
  misc_feature (226)..(227): n is a, c, g, or t
  misc_feature (229)..(229): n is a, c, g, or t
  misc_feature (234)..(234): n is a, c, g, or t
  misc_feature (284)..(284): n is a, c, g, or t
  misc_feature (306)..(306): n is a, c, g, or t
  misc_feature (309)..(309): n is a, c, g, or t
  misc_feature (311)..(312): n is a, c, g, or t
  misc_feature (322)..(322): n is a, c, g, or t
  misc_feature (343)..(343): n is a, c, g, or t
  misc_feature (346)..(346): n is a, c, g, or t
  misc_feature (362)..(364): n is a, c, g, or t
  misc_feature (383)..(383): n is a, c, g, or t
  misc_feature (558)..(558): n is a, c, g, or t
  misc_feature (634)..(634): n is a, c, g, or t
atgacgctggacaaacgagtcttgcacaaatgtancgacacatttccacagttaatcgtttanggttataaaagttaaaaagttctattagataagttttcataagcagttggatttctgaaaaatanagtaacanaattttattaantactaaaatttctttaaaactccctatcaatctnaagaacaaactaaaaacctgtttattacatgaatgctacttatnngnatttnaaatatgggttcacttcctattttcaacaagtctttggcttgtttatttnctaaattaacagaacgtggggngcngnnttttaagttngcaacttccttagggttactnggnagtagagtaattatgnnnaagggaacacttcaattantgtataaaagattgctttgcatactgattacttcttgaaccccaaaaagtgctgagtttagaggcaagggcccattttgtgcccattaaaagaaatatacaggggaatgtctgtctcatccctctaatcatatgtaataaaattatatcgctgtcaataacagcaaagataatgntatattaattttaacagcagtcagggcgcagcaaggcaaaggctgcttatacagaaaaacatacaaatatgtaggnagaact

SEQ ID NO: 539121 - DNA, 320 bp, Homo sapiens
  misc_feature (60)..(60): n is a, c, g, or t
  misc_feature (102)..(102): n is a, c, g, or t
  misc_feature (176)..(176): n is a, c, g, or t
ctatatatacacataacattttctttcttttcttgggtctcgctctgtcacccaggccanagtgcagtggatgacatgtagccccactctcctgggctcaancagtccttcctgcctcagcctcctgagtagctgggactacagacacatgccactgtgccttggctgattttttnaaaggcatggtggcgggcgcctgtggtcccagctgctcgggagggtgaggtaggagaatggcgtgaacccgggaggcagagcttgcagtgagccaagatcgcgccactgcactccagcctggacgacagagcgaactccgtctc

SEQ ID NO: 539122 - DNA, 355 bp, Homo sapiens
  misc_feature (321)..(322): n is a, c, g, or t
ctacattagtcaagttacgcttacaaagatacttaatatttttggatcatcctactccaaatgcacattactgaaattcccataaaatagaactgtcctgtttataactaagtatcaaatctccaggttgatctctaagatttcattaccaaatacctttttatattatacactatcaaaaccaaaaaattccattatcagctgcgaacaagcttaaagaacattccataaaataattgtgctcagtcagtccactcagaggtgccatgtaacttttaaaggcagagttggaaattatgtaaaatgggtcaggatagcaanntgctgaaccaggcttcagataatgttagagata

SEQ ID NO: 539123 - DNA, 930 bp, Homo sapiens
gtccaatgcgagctcgatgatcgaaatgacggcgcccgcccgtgagttgagccgcatggtaaagcgaggccgggctcagggggagggagtactgagagacggcggcagaggcgcggcccgggagcccactcgtcagggcctgtgagcagaccgcagggggcgagcggcccttcagctgggagtcctgggccaggcacgtggacgtgccggcgggcaggctgcgcagtgatgctattaccttcagcgctcccttgcttcagtactttttcttaaccggttgcagccctctttccatcggagcttcttccctggaaaacggggacagggttggaaaagcccggctgggggcctcagcgggacgaggaagccgcggggcttagacggggcaggccggagcgacgccagggacggcgacggggcaaaccctttccaccggcctccactggggaaacgcccgggcagggacgacgcgaagcaacaagccgagctggggccggacagagaccgggaccacgacgagggccgtcgcctttggtacaacgcatcttcccaaagggggcacacgagggacgaggtcactcagcaggattacagggacccttgagttacaaagcccaagtgttttacaccaacgggggccttgggggaacaccgagcccaggagaaagcaaaggttacagaggagacctatccttctaccccaccacgttttttccagttaaccgtgtgggcaccttttcccaaatagcaaacggggaggcgagtgacagacgtactagtggccagaagaacgagggtcacaccaaatatccccaacacgggggtaaacaccccacgaggggagcccaggggcgtatctgaccacaggacacccagttctcccccaggggtctcccgagcaccgcgagacagagccgagagagaacgccc

SEQ ID NO: 539124 - DNA, 116 bp, Homo sapiens
tatgcttgaggtttgagtttctccaacagtatacatggaaagctatgcttccacctggagcctgagtccaagcacacagccagtcctgcacacgctatctgtgcaaacagtgaatc

SEQ ID NO: 539125 - DNA, 826 bp, Homo sapiens
  misc_feature (433)..(433): n is a, c, g, or t
  misc_feature (460)..(460): n is a, c, g, or t
tctaatgctctgtgaggccaaacatttatgtctcagatggaaatttaaattaatatcattcaaaaggaaacaaaacaatgttgagttttaaaaatcaggatcgacttttttctccaagaaccatacatttatgggcaaatggtgtactttatcacttccgagcaaatactcagatttcaaaattactttaacagtcctggtacttaacaggctaacggtagataaacaccttaataatctcagttaactactgtatttcaaaacacatttaactgttttctaagtgcttggcattattcagttacaacctagaagagatttggagcctcatatttcttgtgatactgtgaaatagagggagctagaacaccttaactgtctctaactctgttaaacctgctgcaagagccataactttgaggcattttctaantgaactgtggggatccaggatttgtantttcttgatctaaactttatgctgcataaatcacttatcggaaatgcacatttcatagtgtgaagcactcatttctaaaccttattatctaaggtaatatatgcacctttcagagatttgtgttcgagtaagtaaagcatattagagtaattgtggggtgacagatttttaaaatagagtttagagtatttggggtttgtttgttacaaataatcagactatatatttaacatgcaaataactgacatatgttgcactgtttactaaggtataggtgtccatggggtcagaggcagcacacatccccaatttttgcttagggcccggggcggcccggctgggctgtttttcggcgggggccccctc

SEQ ID NO: 539126 - DNA, 261 bp, Homo sapiens
tgtctaagttacgatgtctcgtggttgcctcgaataggaggtgaaagtgatctggcgtacaggagcttgtaagccgaaaagggtgaggatcagcttctacagagaaggagcctcggtccatcacaagtcaccattaaatatataggggttggtctccgagggttaaccgttaagctcgaatatgttgaggaggtcatagaactggcctgttttttaaacgcttactgtaatcttctctgtctctttgagtgtggttccacg

SEQ ID NO: 539127 - DNA, 1115 bp, Homo sapiens
  misc_feature (67)..(67): n is a, c, g, or t
  misc_feature (726)..(726): n is a, c, g, or t
gcacgacccgtcgccaatagggccgtgatgatccgcggcactgagtgaacggcgccgagtcctctgntgtcgccagatgccagcactgtgccaatgcacctgataataggcggcgtgctggcgctctagcaacggctctgatgtggatatctccgcttgaatgctgggcaacggttggtactatcccacaagggctagtcagtcagagtgatcatacataccacacgatccgcggaccgactgcactgcacctctggcgcacaaaggctagaggtcgttccaggcgtatcccgtgtgagtctggctttagatgatagagcggaggacgagtgagccgtctgagcttcattgtccgcatctgacagactgcgaggcagttatcaactagcaatacggaccactgcttattgtgggtgaatatggcaggtcaacgagatgggacacaagcatgccaatcatgtgcgcgaacatcgtagcatcaccctgtgagtggtcacgcgagtgccctcgatgtggtcactaattgcggatagtcggctggcactccgtgagagggatgaagattccgagagagaacccggttggaataaagagtctaggtgtccagggggcatctagggaggcttatgctcacacgattactctacccactaatcgctgaggaccatagaacagaccgcgatgctgacagctggtccctcgcggtttacctaagatagggtcatntctctctcgagtgcaaatcaaggagtcgttgtgcgattggagttggctgtgatgtgagggctggtccgcatctttgacaccgtccctactttagcacgcgatttgttactggcctttaccgaaggatctccaggcggtgaggcgaccctggtgtcccacagagtgacgggagttgtcgttgcgcagatctcatgcgcgagtatccctatgggtgatgtggccctccatcaagtgtatggggatgccccttcatccatccctatagatccccttgctgtgctgtcaaacgatggggacttgggtgtccgccgcatggatgtctctcgccacctatttggggcggagaagcaaccttcatgggtgcgggccacaaaagttggttatggccc

SEQ ID NO: 539128 - DNA, 549 bp, Homo sapiens
agcagatagaatgcatgaaatcgttttcaagaccctggacatcagacaacaaagaacaataatctctgagagggaacgaagcaagccctataattaccccagcttactgtcttgaaagagtttctaggccatagctcaaggaagagaacagagaagagctctttagaatccttgagttaaggagatggcactgagagtcaggtgacaccaagggaactagacttcatagaacagagtacctgagtaaagagagctgcaaagagagagaaccccagatatctacagaatctaccccttgagtattctccagaatactaatcagcatgtacatgtgaggaaattatccaaagccaaattatcgagtcatctgaaaaggtaagacggaagtgtgtctggaactcacataggtccaggaatagtatctgttcccatcaaatatgctggagaaactcataattcacagggtattgtgaagagtactcaggaagaccttcccttaatagtagattatgattagcctagacggctccattctgccaaacaaattat

SEQ ID NO: 539129 - DNA, 157 bp, Homo sapiens
tagcgaagtaccctcggataagtgcccatcaggagttgaccttggccacatcaatgtcatacagcttcttcacagccgtgtttaatcttggtgcttgtgggcttatcggaggggcgatcctcataaagtctgatcctagcaatgcatgcaatgcttg

SEQ ID NO: 539130 - DNA, 876 bp, Homo sapiens
ggcaccaaattgcggatgacgccggtgcagcggggggtgccctggtgggccctggtggccctgggatggggaaccgctggtggcttccgcggaggtttcggcagctgtgcatactggtggcctgttggtcgctggccgtggactgtgtggcctggtggccgaggccagctgtgacgcatctgctggaggagcaaggccatgaggatcacgtgacgtggacttgccctgtcaaccacagttagggccgctatggtcaagggacatagaagatcaagtcccgtgtgaggacgatctatctcttctcccttgacgcgattacaggcaatcagggaggatccattggcatgtctttcctggggggcctacgtcgtcaaagggaatgcagcgttgtgtgacggatatagtgccgaggtgcagtcgaagcgataaccgctgtgcccggacccaagtcgacacacccaagcggttacaagagtggcaatactgctgggcatagatcgaggggcacctaccatagtaggaccaagcgattacggagtcccttgggcgcttgttacaaagataggctacgcaaagtgacgcggttggcgccagcccggctgcgattacggccgtatagtggcgaggccgacaagttccaacgtcgccttggcgtaccccgaaacgcccggtccttccgcaagttcagtgtatgccccacagcgggagtggagcgcagcccaggtacagtgacgcataaaccgttgcgtggcggggtaacacccgcacaccgcgacttctcagtggtcggaacgagggtcggcccgcgtaagcgcgacctttgagatcctgcccgaatttgtccaacaaatggggattggacaaccaagagtggac

SEQ ID NO: 539131 - DNA, 114 bp, Homo sapiens
caaagaccacatcatcgaaaccgcaaacatagtatacacaaacgcctgagctctatctagttatctcatcggctaacctcccggacaagcggcctaatagcactcggaataatt

SEQ ID NO: 539132 - DNA, 590 bp, Homo sapiens
attgatacgatcgagctcgtgacccggaagacacttacgtaccagagggctagccacggaacaactgaaaatacttctatatactcccacattgagtcatattattgggaagacccattacaagaacacatagttgaaggaatgtgattagtaaatgagtgaatggctgtccctcttcgtacctcccctattcaggtacaagcattggctatgagaaatagaagagaaagcatacgtaacaagcacatcctcaaataaccaggcttgtgaaaaaataagtccttagaaggacaaccggagagccacagatgtgagtgatcagaacagtgtgttggacatacctgaacatatgacctcaagtggctctccaatccttcctcatggcactgggcaagcacatgaataatgaccctacacaccacaggcgtgaatcaagcaaagaatatgtaataatggaaacattgcattattatcacagcagtagtagaacaatgatgatgctatcagcacttaggaaccaaggagacaaggaattagatggggtccccacacatggggatccaagacatttcttgaatgtaatgttcagc

SEQ ID NO: 539133 - DNA, 161 bp, Homo sapiens
cctctagaggatcaggtattgagtcgcgatatcatgtgccatatggcagatcgatcataagtatgtattggcatgtggaggtttgttgagggtgtgtggatggcatgtggctggtgtgtggatgatgcatgtagacgatgtgtggctggtgtgtggataat

SEQ ID NO: 539134 - DNA, 870 bp, Homo sapiens
taggaatttctgccccgcccccccccgcccctccgtggagggtgaaaggtgtccggtgtacccaaacggcaggggggggaacaaaagtgtctgcggtcaagcgagacaccaccacagcgacggagggtccccaccccaccaggcgaaggaggttaaccacaagcgaggcgccatggtactcctccgctgggatctttatataaaaaagccggcgttccccccccgccattggggtagaagcccccttctcaggaaactcctggttattacaaagacagaaccccttgtgctcacgaagaaggaacacaccacgcccattttggtgctacgctcccccccctctcttataaaacatagtctcctggagacacccctgtcctaacaacgtcaaaccttttacttattctccccccctttataaataagcaaatcttcgcgctcccttctcggttgcacccacacgcgaacgaaggtctctctcgccacaccctaaaatacccctccccccccttgtaattacttgtggacaaattcaaatcatcacctccgaaaaatctgtgttgacaacactccaataaaatctttcataagagaaacccgtgggaggagaacttctcttaaacgggaagcaaataagttaatctcttgtctcccccacccctatgtgtagtacaatccacgcattgtgaattaatggtgctctataaatttttgatataggatagttataaatgtctaaaacaccccgcgcattggataaaacacccttctcatcacagcgtctcccctttcagcgtatttttcaaaacagcgcccttttcttcaaacaccaaaaatttttcaaaaaacaacccctcccccaacaaaaca

SEQ ID NO: 539135 - DNA, 407 bp, Homo sapiens
gacgggtggccatgatacaagtggaactcatcaaataatttaaaccaggcgatacaacgctatttcccatctaaactcatttaagccttcacaatgtcgcaatggattcagttacttacaaacgatcccgggttgtcatacagatacttgttttttacacatacacgctgtgccatcccgttccttcactgccccaggtcaggtttcctgatagttggaccgacaagggagatagcattttacgaaatgcttccattcaaagacagacagtgagaacagaaagagagaccctgacggccaggaatctattaagacctggatgtgtgcgcaaatagggacgggggaaggcaggaactttgacaaggattaaacgtcttcctttagcgccgatgatcacgctcggggac

SEQ ID NO: 539136 - DNA, 183 bp, Homo sapiens
gctgaaagaggagcagaggaagcttcgggaggagcgccacacggaatacttgaagatgctggcaagagagagaagaggctctggaggaggcagaagagctggaccggttggtgacagcgaagacggagtcggtgcagtatgaccaccccaaccacacggtcaccgtgaccacaatcagtgacc

SEQ ID NO: 539137 - DNA, 112 bp, Homo sapiens
aagaaatctcctcttaggagatcatggtgtcacagtgtttggtcttttgttttgtttttaacaactgtctccctcatacacaaagtacaatatgagcctcatttatctcgca

SEQ ID NO: 539138 - DNA, 276 bp, Homo sapiens
ttgctgatgatacctacccccgatggtcactacagccagcctcctggactatcacacctgtaatcccagcactttgagaggctgaggcaggaggatcccttgagcccaggagtttgagaccagcctgggcaacatgacaaaaccccatctctccaaaattacaaaaattagccaggcatggtggtgcacacttgtagtcccagtaattagggggctgagacaggaggatcacttcagcctattgagtttgaggctgcagtgagctgtgattgcgcc

SEQ ID NO: 539139 - DNA, 181 bp, Homo sapiens
ctcggtcccccacgtgactattacgagcgttttagcctgctgagcgggcaaaatgcacgtagtctattgctcggtgcgcgcctggcgacggttcatgaagaacgcgacaaggccgcacgttttggccagcaactcgaacgactctatcccggtacgccggaatatcagcaatacctgtcgg

SEQ ID NO: 539140 - DNA, 179 bp, Homo sapiens
accacgggaatggtctctgacgagtctctagcagaccaccaatacgtacctccaggatccctgtgagcggcgcgggcttgcacagaggtgctagtagtagcgtggacgggaacagggcccggcacacggcgggtgcatgaagagcagacggagagaagccgacaacgcagctcttactc

SEQ ID NO: 539141 - DNA, 145 bp, Homo sapiens
cgggtggaccacttgaggtcaggaattcgaggccagcctggccaaaatggcgaaacccggtttctactataaatacaaaaatgaggtgggcgtggtggtgtatgcctctaatcacaggtactcgagaggctgaggaagagtgtgc

SEQ ID NO: 539142 - DNA, 878 bp, Homo sapiens
  misc_feature (364)..(364): n is a, c, g, or t
ctaggactggaggtgttccatgcaggcagctgccctcaaaaatggcaaggtagtaactcatgggggtagagttcttgcgagtcacagccatccgggaaaatctcatatcagcccttgaaggaagccaggaaagggactagcgtgcgtataaagttgatgggagcaagtttataggaaagacatcggctttcgtggcatagctttcctccagtcgaagcccaggtaagaacttctaagcataagttagctgttagtgccatgtcagaaactgcctaaatggctatgtagaacatttcattaaccctataagtcattcagtatcttgtctctctggtgggactgatacagtcttggtttgtattangtttgaatcagaaggtggttatagcaatatctcaaagttaaatggacaacaaacttcgatgatagcgtaagttaggaaagtttagcaaaatcacagtggtactgattttatttgtgtccgattgattgtagtcaatatggttgaattttttttaacagggtcttcctctctcgacccaagttctcatgcctcaggctcccaaatagctgggagctacaggtcagcaggcctacatacctggtaagtttttgtgtatttttgtggagatggggtttcaaccagtgttgccaaggcagtctgaaatcctggggctcaagtgatcctcttgttgtggcctcccaaaagtggctgggaataatagggcgtgagccgtgactgtggctgatactgatttttattcccttgggttatcacatacgtgttcgtatttggacaacactaagttcatggttttatcaaacgaactgaagatgaagaatacgggggtcattctaacctttggtaattgagtcta

SEQ ID NO: 539143 - DNA, 345 bp, Homo sapiens
  misc_feature (149)..(149): n is a, c, g, or t
  misc_feature (319)..(319): n is a, c, g, or t
ggagtcgcagcctccactcttgactgttactctattttgcctccttggggtacaaggtgaaaaaaccctcaaccctggtctggagggcctggaactccagctgacacccaccacagtgtgagtgatgaggaaaacacaaggcaactggntccagtggcaaatctgccattttaagggggatgattatcttgtcttttcttctctgaggaaagaggcttctaggaagctgtacctggtggctgtttgttcatgatgctactgtactgataaactcagaccttcctaggtgggcacgtaaggcctgcttatcccccagctnagggtgagcaaacctcctggtttgcc

SEQ ID NO: 539144 - DNA, 332 bp, Homo sapiens
tacttatttccggaatgtaagaagacagcagcagcccctgctagccaaaagtcatacaatcctgcctggagaatgtatactcctggaactagacaaagaataaagccttccaaactctaccatttaatttatatttaagagtttaattaaggccaggcgcggtgactcatgctgtaatcccagccctatgggaggtcgaggtgggcagatcgcttgggctcgggagttggaaaccagcctgggcaacatggcagaacaccatctttacagaaacaaaagccaggcatggtggtgcacgcttgtagtcccagctactcaggaggctgaggtgg

SEQ ID NO: 539145 - DNA, 142 bp, Homo sapiens
ctgctgtccgggttgcagtccgacgcagaacgggcgtctgtcgatggggcaacggccatgcctgccaacgcccgtcggatggggggaggatgagcgatgcagtgtattggcgggactcctcgatcgggccgtagcagcgatg

SEQ ID NO: 539146 - DNA, 545 bp, Homo sapiens
tctattgccatgtcttcccacagtggcatgtggaagaccagagtcgtgtcccagagacttatcttataccccgctagctgtcggtcgtcacatcagtggaagggtgatattatgacactgacactgctattttgaaacctgtgaggatggaaaggtgcaaaaatctatcaccagcaacagaaggtgcagactgtgctcgttggcggtaattttgtccatcaaatgcatatgtgtgaaaacattccctcctttggccctacaggtcagaatggcggccgtggagcatcgtcgtgcctcagaaattgaccctaccggccctacctcacagctgaaactttaaaaaacaggatgggccaccagccacctcctccaactcaacaacattctataattgataactccctgagcctcaagacaccttccgagcgtctgctctatccccttccaccctcagcggatgataatctcaagacacctcccgagtgtctgctcactccccttccaccctcagctctaccctcagcggatgataatctcaagacacc

SEQ ID NO: 539147 - DNA, 533 bp, Homo sapiens
  misc_feature (31)..(31): n is a, c, g, or t
  misc_feature (37)..(37): n is a, c, g, or t
  misc_feature (67)..(67): n is a, c, g, or t
  misc_feature (99)..(99): n is a, c, g, or t
  misc_feature (161)..(161): n is a, c, g, or t
  misc_feature (176)..(176): n is a, c, g, or t
  misc_feature (214)..(214): n is a, c, g, or t
agccagttaaacaactgccaagggtaacatngccggnactggcttccctggtccagtgccctccccnatgtgcatggggagaagacccattggtccccngctttcatgctgacttccttctccagcatgtgaaagggtcacggttgcatctgatgccagangcaagcactacttanacttacgctttgcagacgaattcaacaggttggtaganactttctacagtgaaagtccaggagacagaccgctggtgtccagcagattctgtgttaaaagatcatgtcattgcctgttacctggatgctccaaaatgccttcccttgcttttggcctcggctcacagacaggcctgccaggctttctatcttccctgcaatgtgactctatgcaaacaggaaaaatagcataccgaaatcaggttatagcttcaatagctgaagaaacatgaacatttccatttttaacattaactctctatcatcgtctatgagtaagttcttaccatgatttgttttcaaataaaatttatggga

SEQ ID NO: 539148 - DNA, 2187 bp, Homo sapiens
cagctggagctttgccgcatctgcgttgctgtgcccgcgctcttcgggcgaggaagtcccttctggtggagggagaaaagggttacatgagttagattaccatggcagctcgagccaggctctccacttccgtgagccttcctctaagtgagatcgggggggagataatgaaggccacaactcccaggaggctccacgccgggcggtcagggacgctcgcgaggacgcatgggcccccaggaatgggaactggttagatcccaggaactccgtgccggagacgggaagagaggatgcctagggccctaaatggaaaggccagagctggagacctagcacccagaagatgagaccgcaattcgagaatcaaagggccgggagcgatggtgagcgcctgtaatcccagcactttgggaggttgaagcgggaggatcctttgaggccaggagttccaggctgcagtgagccgtgatcgcaccactgcactccagcctgggcgacagagcgcacaggtgccagcaaggagcacaaataccagcatgcctggtcttccaagaattcggggaacccaggagctttggcctggagtgggatctagactacagatcccagcatgccctgtgagacacacacacacacacacacacacacgcctggagtgggatctagactacagatcccagcatgccctgtgacacacacacacacacacacacacacacgcctggagtgggatctagactacagatcccagcatgccctgtgactgacacacacacacacacacacacacacacacacacgcctggagtgggatctagactacagatcccagcatgccctgtgactctctcacacacacacacacacacacacgcctggagtgggatctagactacagatcccagcatgccctgtgactcacacacacacacacacacacacacacacacacacacacacacgcctggagtgggatctagactacagatcccagcatgccctgtgactcacacacacacacacacacacacacacacacgcctggagtgggatctagactacagatcccagcatgccctgtgactcacacacacacacacacacacacacacacacacacacacacacgcctggagtgggatctagactacagatcccagcatgccctgtgactcacacacacacacacacacacacacacacacgcctggagtgggatctagactacagatcccagcatgccctgtgactcacacacacacacacacacacacaccaggcgggggaagagctggggagtgggggcggggaagtcttgtgactacaaatcccagaatgctctggagctaggaaggaacaggacggctttggggaggggtcgtgggactccagatccgggcgtgccttgggacaaggcagggacagaccggcggggggcggcctggtacttcaggtcctggcacgctggggactggcgctcaccttaaaggagtccacaaactcgtcactcatcctccggagctcgcggccatagcgctgtgctgcccagaggttggggggcgccgagcgcgagcggccccgaaaggggctgggctcctcccccatcccttcgtcgtcctccgtccccgcggggtaggagctgtggcgactccggatctccacagccccagcgcctgcagagggtcagtgggtaggggggcgacgttaatctcagctcctctaagcccctggccctgcctgaaccctccccatcagctctgcaggcccactcgtgggtcttccaggggcgcatcacagcccacctctcagagccccagtcccttgtatgtgaatcgaggggaagctcaggggcctttggtgaagatttaggttaacttctcattaatcccacgaatccttaccgagtgccaataatgggtgaggccctgtgcctagcacaaaataagggcataagaaatactagttacatcacaaggtcaggagatcgagaccatcctggccaacatggtgaaaccctgtctctactcaaaacacaaaagttagctgggcatagtggcacgtgcctatggtcccagttactcgggaggctgaggcagaagaatcgtttggacccgggagggagaggtcgcagtgagccgagatcacgccactgcactccagcctgggcgacaggctttttttctc

SEQ ID NO: 539149 - DNA, 222 bp, Homo sapiens
atccccacctgtgtgctcatccccacctgtgtgctccaacactttgggaggccaaggtgggaggatcacctgaggtcaggagtttgagaccagcctggtagacattggtacttgggaggctgaggcaggagaatcacttgaactcaggaggcagaggttgcagtgagttgagatcgcaccactgcactccagcctgggcaactgagcaacactctgtctcat

SEQ ID NO: 539150 - DNA, 265 bp, Homo sapiens
cgtcgacacaggttgtctgctgtgtgtgcttgttgttgttgttatattgttatattgttgatgcagggtcttgctttgtagttctggctggcttcaacctcctaaagacccacctgtctctgcctcccaagtgctaggactaaaggcatgtgccaccacacacaaccctgggacagacattcagtatctgtacatgaatacccagggcagggctgaggatattgggtttgctctccagcaccacatatagcacagacgtcgacgc

SEQ ID NO: 539151 - DNA, 130 bp, Homo sapiens
attatctatcttcagcctatcaggatcacagatttaaggaagacttggatttgttgaatatgacaacgaaatctgtgtgtatcagattttatttgaagcattcatcagcagcctctcctctctgcgtatg

SEQ ID NO: 539152 - DNA, 124 bp, Homo sapiens
ggaattattgtatgaaatattacaaagcgtagactatgcattgttattcattataatattttttgctgtctttatgaggcgattatgacaggtttcaaccattaaaatatgttcttccttaaaa

SEQ ID NO: 539153 - DNA, 424 bp, Homo sapiens
ccggaaattcggccattatggccggggtttcaatttatgttccaaagggaaaaaaggggtgggaaaaaatattggatttgaaaattcaggaaagggtttaaaacccaaggatctccgggacttgtttaaacacaaccttgacctggggggaaaggaagggacctgaccccgatttaaacctggttcaggatgggaaccatctaaacctttttaagagggcaataacccccagggggcccaccagcctgggggcaaaattcaggggcccagcagggaccaaagtcagcagggattccagggtcaagcctgtcagttgtccaaagaagggcctggccattaatttaataatgggcatatgtggaggagccagcctttggagggcctttgtggaactgttcgttttctatatcaccaaagggatagc

SEQ ID NO: 539154 - DNA, 470 bp, Homo sapiens
gctcggtaccctgccatttactccatggccaggcatagctgatcaggccatgtgtatctccccattttactgttgcagcaatgctaggtataatagggacaaacctgtggagatgcccggtattccagcagctcaatccagtctgatttttgttttagctgcttccccctagtgttggggaaggggagttaggatgtataaattctcatgtctcttgaggtaaagagataaggctgttctattctttataaatatactgctgcaggatgtgtgatcctatcagccttactaaagaaaatgcatttctcaaatcttagagaatatttttgcatcataccttagagctataaaggggataaaatgaattaaaaggtaatgtgaaataatagagcctctagaatcccacactattttggctctgctactttgtagccatggagtaaatggcagggatcctctagacgacccac

SEQ ID NO: 539155 - DNA, 441 bp, Homo sapiens
ctgatttgagatctttcttggaggatgatggtggttgcttagatgataactatgaatatgataggctttgaagaagggaaagagttgatatgaaaccataaaggccgaaggaagagaaaaaggaagagacatcagtgattggtagtttataaagcacatctacattcatttattcaccaaaattaaagtatgttttaggaaatgcagcagtgaacaaacaaacatgctcttactttcatggtgcttaccttctacaggagaagagagatatctaaagaaatcataataagtcagatgataactcctgcgaaaaagcatgaatgaggatgaaggtaggaatatttggaggggatgtctcagcaggcctgtctgacaagctggtatgtagtagagacaggaatgaggtaaaggagcatgctcttgaggtatttagtggaggag

SEQ ID NO: 539156 - DNA, 463 bp, Homo sapiens
cacgaggttatctcatttaccagggtcaccttcgccccacttcccgcgcctgacgcgcaccttgcggtccaatccagagctccagcggctcgagtctcgccgtcttcttcgactggtggcgatccatgcgatggagcacattgtcgagaaaacgcactgcctcgacgatgaatggtcctttgttgagcatcacgcattcagcgcgctgcgccatggccgcatcggttacttccgcccggctgggtgctccttcttccaccatgccggccaagacctgggtcgcccagatgaccggcacatgggccgcctcgcagagccacaagatgttctcttggacttcgctgatccgctcgaaaccaagttcgaccgccagatctcctcgcgcgatcatgaccgccagtggctgttgcccggcgccatgcacgaccagatccggaaggttcctgacagcaagcgcggtttc

SEQ ID NO: 539157 - DNA, 204 bp, Homo sapiens
gtaggaatcgaagaagtacgtgccgtccttcgacatcgacaccgtatggtcggcgttctcgggcgtgagcagggtgagacccttgccgtcgaagcccaccttgtagaactgctggtaatacggatcgacgcccttctcgcggccgacgccacggaaccagatcgtcttcgacttcggatcgatgcgcagcacctcggtgacgtt

SEQ ID NO: 539158 - DNA, 870 bp, Homo sapiens
actagttctagatcgcgagggccgcccttttttcttgttgtatggttttatgacatgggatcgactgatggcttttaatttagagcacaaaaccaccgggaatctagcctgtggccaccccggaaatgacacgagtgctcacatgactctagacatcttggtggacaagtgacggcgagaaaaacaatgacttggcgccaattacacgactgcaatagcttagagctgccaacagggctccagtgacgctgtggcttctgtagaacgtcctaaggaagcggtacgaactccacggtcggtggggcgctaactagcagggacccctgcaagttgtcgtgtcgggggccctcagagctgcctgagctgacacgagggggatgggcgtctgtgtacgccaacgggtagaccgaagggcttgcctgcccacagtttacttggccacaggggtttctgaagttcctgccggcaaacttagaccttggctgcccagctcctcttcaattctgaggagctggtttgtactgggccaaggtgctcagaatcggcaaggggcaccagtcttgatctgcccgagtgcacagcccccaaaccaggtcagcgatgaaggtatctgaagatctcccccgaatgattgagacaccatgatgccccaaccatttggcctgtggccagcttgcacgcctgaagagactcggtcaacggagccaatcgtggttgactttgaaccaggaagcagttgcaggactttctcgtccacggccttggggaacctcttggggttggcactgttgagaaaatcccgcataccggatcccgcactggtgttaactttgcaaggtccaagacaccgggcaaaggatctcataaacc

SEQ ID NO: 539159 - DNA, 1381 bp, Homo sapiens
gaagggcgctgagaggcgagccgtgagcccagacgactagggagagtgagctcaccacgcgcagcgccagtgaccagcaagggtcccgaggagtgtacgttcatccatcggttgactctcttccggcagttacctgcgtgttgtccgcacttgtccagcccagagccctgatctattggatgctgctgtggctttctttgacggagacatgcccgccatgctgggtcctgggctgtcagaatggtactaggtggcagcctggtctatgtggtgaaccgtggttgacctgtctcgggcaaccaaccaccgtacgagtcatccctcacaatcgtgtgcattcgaatcgtactcccatccacggactgctgagttagcacatgatcgtgtgccataagggatatcattgtgggtaggtcaacgggaccacctcgtatttggaggagtcctttttcgaaacgtgaattttctggaaggggtcattacagtcgtgagtgctcacgggtgcttgcacgccatgggaaccaatggagacgcttgcaggtgcaagccgagtccctggttgaaccctgggtaaaggccctgttgaaagcggaggggtcttgggaaaagggtggtggagggggtccatcgccgaggttccacaccacgaagtaagacgcgactctcatcgaagtggtactctgttttggttcgctctgaatttgatggggatggggcttcgggggcgatactactcctaaacgggacctatggggaagccgtgggtttactgtttgggcaaggccggtgactcttcgtacggttttccgctagccggactccccttgggaagtggcgccgacggggccctatttgtggcccccattgggcaatttgcaaggggggccggaatgaggtccgctacaattgccctccgatctggggagcttcgccccttgtccacacctgtgtgccctttgtatatcttaagctagaaggcctgaggaaggttccccgctcgcggattggtgcgatgggcagggggggttctacctcccaaagaccgaaccttgggagggaagaggggcccctatggaggccccaagttggtccctttgctagcaagacccatttccgatttggcggggaaagcgggaaaccagaaccaagcgtccaattgacccacggagcaaaggaacaaccggctcgtggaccatccacaaccgggttttggttaaagagaagcgtgtcctccaatttacctctgtggggtcagagtttcccccgtgggggaacacaacaaggggggacaagtctgcggccgacggaaagtggcctttggactaagggttgcaataaacgctctccacagagccttgggaaaaacagcaaagggtggggg

SEQ ID NO: 539160 - DNA, 945 bp, Homo sapiens
  misc_feature (216)..(216): n is a, c, g, or t
  misc_feature (281)..(281): n is a, c, g, or t
  misc_feature (498)..(498): n is a, c, g, or t
  misc_feature (540)..(541): n is a, c, g, or t
  misc_feature (660)..(660): n is a, c, g, or t
  misc_feature (755)..(755): n is a, c, g, or t
ggtcttcatctcttgacaagtgtgggactggtgattcgtgactcgggtgtctgcttcgtgtcagattgcgccatccgtgaatcgcgctgatgcgcaggtatgctggtgaatgcattgtacgtctcacgtggcggcagcgcgtggctgctcatgatggtgcaagtcggccgtgctcggtgcaggctcctagcatggtgcgtggagacacccaccggncactcccagtgcctcgcatgtggtgcgacgaactgctcacagatgcatctaaacgaacgcgagtntgcgagggaccggccgtaattctgatcatgcgcctgttgcagacaacagggcctttggcgttttctcggtgggacggtaacagggggggcggcttcggtggcgaaaagaagcacctggtaagcgcaactggggcgggctcgggtgggtttcccggtgagcatccttctccggaggagaacaccgagtgaaagatgccgaggtttgcactttgaaaantgattttggacgagcttgggcagcgcatgaagcagtggccannggccttcgttccagccaccgcgtggagaagtcgaggcctttccaatcccaatgagaggccaaagggaacacccgaattggccttcgccgcaagggttaacttcaccttagcccccaganggcgtgctcaacgtaaacaaggcctatcctcctggcggtaatcgcgagacgggcgtcgacattttcgattcgcgtctcgcttcgggttagagaancgcccgcaatcttttgcggcaggaagggttactcgggacgtagagccctattgtgtgcaatccgcggggtgcggtttcacgggccctttgatttggtggttgctaccaaacaagggatttttagggattgcgtgtggaaacccttggcgtttgcttgggtgttttaaaccccttcccctgttgtcccctg

SEQ ID NO: 539161 - DNA, 125 bp, Homo sapiens
  misc_feature (12)..(12): n is a, c, g, or t
  misc_feature (14)..(14): n is a, c, g, or t
gagagagagagngngagagagaaaggaaggaaggaggaaggaaggaaggagaaagaaagaaagaaagaaagaaagaaagaaaaagaaagaaagaaagaaagaaagaaggaaagaaagaaagaaag

SEQ ID NO: 539162 - DNA, 141 bp, Homo sapiens
ccgtattcccagatgcactctgacctagctagtgcctggtgccagtgacctgggggagcctggtctgcatgccctcactggttccctaaaccttgtgtggctgtgattcatgtccccagtgtgtggactcagtgtaggagt

SEQ ID NO: 539163 - DNA, 260 bp, Homo sapiens
  misc_feature (43)..(43): n is a, c, g, or t
  misc_feature (51)..(51): n is a, c, g, or t
  misc_feature (147)..(147): n is a, c, g, or t
caacacacacggccccacccgcaggaacatgttcctaatattncttaacanataaagatactcagaagatgacggaagctgtgaagaacagcataattcagaatagaaaagcccaggccaggctcagcggctcacaactgtatcccnacctacttgggaggctgaggcatgagaatcacctgaacctgggtggtggaggttgcagtgagccgagatcacgccactgtactctagcctggctacagagtgagattcgtccc

SEQ ID NO: 539164 - DNA, 322 bp, Homo sapiens
agcgaaccgcttaccacctcgttttccagcaccagcttaacgttattgataatcatgaagaggctcccattgggtgcaggcggtcggcgacgtcattacgtacagcttcgtcatggaagatgcctacgatggctgcgccacgggttttggcttcgcgaatcagttccaccaccgcggcgctgtttttggcgtccagcgaggcggtaggttcgtcaagcagcagaatggggtagtcgacgataaagccgcgggcgatgttgacgcgctgctgttcgccaccggaaaatgtcgatggtgccaggtgccacaggcgttccggcac

SEQ ID NO: 539165 - DNA, 220 bp, Homo sapiens
aatataattagaaataaaccctataccaaacaacgactagaaccaatattttccaaaaaatattggcactggaagaatttttaccaaccatatatttataaaatgaattcaaatgtaacaaaaattatataactctctgttttctgattctctatcaaattaaaatccaattatttattgtagtttaaaataggccaatatctatagctgaaataatctg

SEQ ID NO: 539166 - DNA, 1690 bp, Homo sapiens
  misc_feature (519)..(519): n is a, c, g, or t
  misc_feature (881)..(881): n is a, c, g, or t
  misc_feature (1082)..(1082): n is a, c, g, or t
  misc_feature (1100)..(1100): n is a, c, g, or t
  misc_feature (1333)..(1333): n is a, c, g, or t
  misc_feature (1360)..(1360): n is a, c, g, or t
ttttgtgatgtccttttttcgtctttgtctgtatatattagtcggttgcgctattcgtctctctggcttactttgtctattctgcttctgtctgtgttagttttcgttgtttctgttgcgtttgggtgttgtttttgttgcttttgtttttttgttggattagtgatttttgtcgtttgcattctgcttatgtggtgtttcgtttgtgcgtcttggtcagtactacttggttatgtgtgtttttgttattttctgtgttgttgttcttctccggtctgcctggtctgatcttctcgttctatagcctaattgtactgtatgtgtatgtggtggttttatgatttgttgtgttgtttaattattgttgtattgtatgttatgattatgtttgtaggtgtgtgtatgtgttattgttatgagtgatatgttatgtatgacggaatggttgtttttttggtatgtgtgtaccttgtcgtagagttgatatatgtaggatgagtgacactgctaccaaatttnttattaaccgctggacccccggttgtaagggggttagtgcccaaataaacacaacagataacccgaattttttaaaaggggggaaccaacgccatttagttaggggaaccctttctggggaaaggggaagtgcgcccaaccacaagaggttggtggtgcatcccagaaaaaaatagcccacgggccccttgttagaaaaactcgctccgccccccacgcgtttaccttatttatacgcgcgggttctcttaaaaagggtaattctcgaagagccccctcgtgggttggcccgcaaaatttttgcgcccccacgaaagggtctttttttttttctacgcccaaagatgtctctcactgtaggngaagtagggtgcaaacacacattcttgagagagaatgctctgaggtggaaagcctcgtcacggagagacccccacacagagaggggttggccccccaagaattctctgctcgctctcacagagagatagactacacacaggagcagaaacccacagagaccctggttgagatggacactctgtgggagagagacactgtgnggccctgagatagtggcncacatcatggggagagttgtgtgcacacatcgtagacaacattgtgtgagaaaaataaaaaatgtgtgagaattcacgcgtgcacacgtatcacgtgggagaacgtgcgcacacacaaacgtggggccacactgtacacacacaaatgtgagacgcgcgccacatttttgtgtggtgagactttcacatgtgaggacacaccacgttatacgctgagaaatgaggccacaggntgtgaaacccactccacaaagagaatntggggtgagacaacacgctgagccacacacttgcgccacaagaatgggaggcgccccgcgaattctggcttgtgcggaaataattcttctttgacccagcaccacccctcgggagagaccacgtgaataaatgaaaagctataagcctccgggctaaatttccccactaagccgctggggtgaactttccctggtgcacccaaggcacgtgcacagcacatgttggggtttccccttacacttttctataaattgtaccccaaacaatccaacttaagattttttgaattggacccttcccttccaaataaagaaaatttgggaccccca

SEQ ID NO: 539167 - DNA, 137 bp, Homo sapiens
agagcattgggtcacgcatacttctgcctcatgtctctagtagctgggcccgccatacgcctgggtaattttttatatttttagtagagacggggtttcaccgtgatagccaggatggtctcgattctcagacgggt

SEQ ID NO: 539168 - DNA, 311 bp, Homo sapiens
gtggacagcccctgcccgtcgtggcggcaacgtgtgcatcaactcctttggcttcgggggctccaacgtgcacatcatcctgaggcccaacacgcagcgccccctgaccgccccacatgccaccctgccccgtctgctggggcagggagcacccctgatggccgtgcagaagctgctggatgcaggggctcgggctatagccaggacctggttttcctgagcatgctgacacgacgatcgtggttgtccccgccaccgcatgccttccgtggctacgctgtgctggggtggtgagcgcggtggcccagagg

SEQ ID NO: 539169 - DNA, 213 bp, Homo sapiens
  misc_feature (118)..(118): n is a, c, g, or t
cgatctatctacagcatactgatcactacttcgtactagttctcggacgatatctatgatcatatcaaggaatgatagcattgaggctcgtgtatctaacagcatactgatcatactncgcatagttctcggacgatatctatgatccaatatcaaaggaaatgtagcttgaaggactcggggatatctaacagcgaattacctgattcaact

SEQ ID NO: 539170 - DNA, 873 bp, Homo sapiens
cttgttctccccagccccttccatatcccttatcagaagtaaccattcttttagttgtttcttatggatatacctacatcttttaaaataataaatctatcctgcaattaaaaaaaatttttttgagaccctgtctcaaaactaataataataataataatcactatgaactcttgcatttttatttatttagtgtttcaaaataggttatagtcattaatgtttctaatgatcacattattttactcaggctctgtggaaaccctttaaactgactctaagtccattggatgtgtctctattagcctttgagcacattcttgccttctggaccaccaagatgtaccgggcttgtcttatattttccctgctgtatccctggaatcagccattcctcaaaggatctatggttttttgtttgtttgtttgtttgtttgtttggtttgagacgaagtctcgctctgtcacccaggctggagtgcaatggtgtgatctcagctcactgcaacctccacctcccaggttcaagtgattctcctgcctcagcctcctgagtagctgggattacaggtacatgacaccacacctggctaattttgtattttggtggagacggggtttcaccatgttggccaggctggtctcaaattcctgatcacatgatctgcccgcctcggcctcccaaagtgctgggattacagcgcgtgagccatcgtgcccctgccaatctctggtttcttatagtgggaaaaacgatttaagaaatcagaatccggccattaggttgttgtcaagaagcattttttgtggtagatattgtgagacggcattcgctcttgtcgcctaggtgggagtgccaatggggtgattcta

SEQ ID NO: 539171 - DNA, 292 bp, Homo sapiens
gcatggctgtaatggtgaaagtgttcgctgcagagatgctgaactttagggttggtaaagtggtcactggtccttggttggaaatatatcactcttcaataccagagatattgtttaccccgtaattctttaaggagaactgaagtttttttgtcatcttggcgtgtggggtgttctatggaaccaaccttttttcctttcctggcgaaggcagttccctttccccaaccaattggggcaaccttggttggcttggaggtttgggcggaggtttttccctgggttccatgga

SEQ ID NO: 539172 - DNA, 235 bp, Homo sapiens
  misc_feature (53)..(53): n is a, c, g, or t
  misc_feature (102)..(102): n is a, c, g, or t
  misc_feature (105)..(105): n is a, c, g, or t
  misc_feature (108)..(108): n is a, c, g, or t
  misc_feature (161)..(161): n is a, c, g, or t
  misc_feature (171)..(172): n is a, c, g, or t
  misc_feature (192)..(192): n is a, c, g, or t
  misc_feature (209)..(209): n is a, c, g, or t
ctagtgaaggcgttagaaaagttgctgcatggtactgtaattgagcatccggnatatggagaagtaattcagctacagggtgaccaacgcaagaacatatgncanttnctcgtagagattggactggctaaggacgatcagctgaaggttcatgggttttnagtgcttgtnnctcactgtagcttaagtgcnggatttccttgcaatgngtagaatttcccttctctcccttgtc

SEQ ID NO: 539173 - DNA, 655 bp, Homo sapiens
ggacatatgggcccttattcattcagatatactactcattgtcacgtcttcaaatatagtgcttacacttgattttaaatgttaaatttttattataatcttttctctaattttctgcctcctctccatacagagtagacaatatttgtaagatattgtcccacttttacgtccttgtctatataaacatctacttgtctgtataaacatctatatagatgtctattttaatatctactagtgggcatctcttacagtgttttgtaaaaattccatcagagagtctattacatggataggcttgatgctttgaaaataaatttaacactcttctgtctactgacttcccatccaccgagctatcacagtttttagctgttaatagcgtcaatacttgcagcatctctgataagaacaattctgcttcacctccctgaccagtaataagttttagttttagtaactgatgccttttacaaattgacttttgtatggtctcttagtattgtttctccaatgccaagattcacatagcagtcagattaaatttccttctactttgaccttcttaaataaataccttaaggatacggaactgcctataatatgacctctattcagcttagctttattatgataacttacattccttggg

SEQ ID NO: 539174 - DNA, 366 bp, Homo sapiens
ggtcatttgggtcccttttcccttggtccccccccttgggggaaaggaaggaagggcatgtttgggaccgggccttactggaaataagggttttaccccccttaccccccggcttcccccctccccccaaggtgaagtggggggggctgtggttagcgggcccccccagagctgcggggcccctgggggggtccgccccccctcccctcgtagggaagggggggggatttttttgtagtttttaattggggggggggggggggcgggggggttttttttaacctgtttctttttttgctggggggggggggtcccccccttttaatcagggggtttgtgtttttgtttaataaaaaaaattttgta

SEQ ID NO: 539175 - DNA, 150 bp, Homo sapiens
acacgttctccggcaccaagaaacgtgatcaatcatcacgtgattagttgtctgcttcgtatacgaataaacgtcagctgtccaaaccccgtcggtaatgtcacgcttatttttgcgcgcaaaaccaccgcacggtaaggcccaccggta

SEQ ID NO: 539176 - DNA, 127 bp, Homo sapiens
ggcaaattgtacattggattaaacctacaatacagatgtccctctggctttagtgaactcttttaacacgggatggtgataccaaactaattactacagaagtccaatcattcgtcgtgtgaataat

SEQ ID NO: 539177 - DNA, 104 bp, Homo sapiens
tattttttatagtcaggacctctgacataagcttggtattttctatttctgtattcttcaaatgtaccttataaagttaccttttcatccttctctgtctatca

SEQ ID NO: 539178 - DNA, 616 bp, Homo sapiens
  misc_feature (7)..(7): n is a, c, g, or t
agcctgnttgaaagcaccaggaagatttagaatattccataaacttgagttgacaaagcagcagggggtgaaagaaatgacaccaatgttgaaagcagttctactgtggataaaatggtattaaacagtaccgcatgctatatgaaaatctttcatgaaaggagagtcaatccatgtggcaaacttcatcatcttattttaagaaactgccaggttgggcaggcgcagtggctcatgcctgtaatctcaaaaaaaaaaaaaattgccaggttaccccaaccttcagcaaccaccacactaatgggtgagcagtcatccacatggaggcaagacactctaccagctaaaagataatgacttgctgaaggctcagatgattgttagtactttttagcaagaaagtgttttttatttaagatgtattcatggttttcttagacataatcctattgcacttaatagactacagcataatgtaaacataacttttattttattattattattatttttttggagacagactcttgctctgtcgtccaggctggagtggagtggcgtgatctcggttcattacaacctctgcctcctgagttcagcgatttactgctcagct

SEQ ID NO: 539179 - DNA, 398 bp, Homo sapiens
  misc_feature (208)..(208): n is a, c, g, or t
  misc_feature (267)..(267): n is a, c, g, or t
gatctagaggatcccgtgcgtacggacgcgggtcacctcaaaatagcgccatcgtccacccgcttgccatcgacacgctcggccatcaggtcattcggcgcttcttcctgcaagccgatccaggcttcgctggggtccgccttggggatcgggccggcgcaggccgacagtaaacagacaaagccaaggacgggaactaacaacagtngtttgagtgacatgacagggctccaaagggcatgaatgaaaagctcgtatccgatggcngacaagcttgatgagccgcccttcctggaacaaatgaatccctatgaaagtatcttcagcccttgactaaaacttccttcacctggctgaaaggtgcgtgttagggcgtccgtagcggccgggtaccgagc

SEQ ID NO: 539180 - DNA, 397 bp, Homo sapiens
ccctgggattaggatgcccccggaggaaaaaaaattggccccaggggaattttggccttaaaaaggaaaaaaacccggggaggaattaaaccctaaatgggccacttctggggtcccagttttcctggattttttaaagggcctctttcaggcccctaaaaacctggtagcctagtggttactaacccggaaataaggaggagccttttaggggccaagggtttaaaaaacaaaaccccctcctttttggagtggaaacgaggagggttaaacctcccttatggtccttacatgcaggagatcccaaaaaagtcagggtccattcccttaggaaaaaaacccaaaaaccttggtttttctccccttcattaggaaatggggcctaggaaaccctgga

SEQ ID NO: 539181 - DNA, 939 bp, Homo sapiens
  misc_feature (51)..(51): n is a, c, g, or t
tgttttccacccttcaaactatgtaacacgctggtcctttatcagcaaaantagggggtttgttcactcccgccaggttatgtatactttacaagcgggccccataattcccatcctttgtcgccataccagaaggcagaagttgtaatggttcctcccaaaaaacctttcttggtgttcgcatccatgataagtgtgcccctttgtgccgccaaacaagtgtgttttcccccgacgtgtgcctgtgcctgtgtaccaaaccccccaaacatcctggggcagaacgccaggccacttgtcaaacccagaggtcccctttccgtccctaatttatcgttgggtgggcaaccactttaaaccccctggtgtatttggatttgtgcgcccccctcaaaaccaccttctataatcattgcgccgggggaacaaaatttcttataaacgactgttttctttggtgaaaaaaaactgtgccacaataccgcgcggcttaccatttttaaatgttataggcgccacctttccacgacgtctatttccatactctcgaccatttggggactcaatacaatggtacaataatacgacggacataaccttgggaaaaaaaaacaattggtaatatatacccttggttcttgttctaaaaggaaagtccacaactttgttccaaaaataactaaaaactttttgggtaattggggcccccaccccaattagtgcgttccccgaagcccctgtataacatatgggagttaggacgaaacactttttgtgggataaaatgcttttctggcccaaacttgttaacaagaacacaactctctgggggcaaaaaagttaaaaagcccggaaaaaagatatttagggtacaaaggagtcccccgtctctgtgttttatccccgcccaaaacaaaaatttgaacaacccaacaagca

SEQ ID NO: 539182 - DNA, 706 bp, Homo sapiens
gctgcagctgccggacccaggtgcggaacgtgcgagggcccaggtggctgaaggggccgttaggaacatccaagcggtggggcacatggcagatccccgatctgagctggaccacccttctcctcttggcccgccccttcaactcgcctccgcttaggtctggattggcccgtcccctgatctgagcctggtccttcttcaggcactgacccttgacctccggtggctcccccatctctcaggcgcgagtggcgtacgggacgctggagtgtagcgggacattctagtaactcggtgggtccagaaggggatgcaggcctctgtggaccatcagcaagaaggacattatcaagcccggacaagaaaaaatccaagaagtcctctgagacagctgactttcaagaggcgccgagggtcatgcacgcgggaagtctatgccttggtctactctgacaagtaatggatgcagccccagctgctagcccagtgacactgtgccagggatagcgtacagttgaaggccaagttgggctccaagaatggtgcggtcttggagacgtggatgccattcagcaatgcgcggccgcaaggacggacgcacatgttcttccagtggcgacgtgcagctggaggagggcaaggactacccctttgccaggttcaataagactgtgcaggtgcctgtgtactcggagcaggagtacca

SEQ ID NO: 539183 - DNA, 146 bp, Homo sapiens
ccctagagcacttgatgtttgaaaatcggcttgaaggccattcttttcctgaccgaacggccgaaacagagaaagtgccctgcactgtattggctctcaggtttaacttgcacagagcaaaattttatatcaaaatctggttatca

SEQ ID NO: 539184 - DNA, 211 bp, Homo sapiens
atagaactgtaatcatcccaatttatcttcgaagggtgatcgaccatatttcattgtgatttctatcacccgacatgacttgctccgctagatttacactcacgcttctaatgaaagaggggcagtagtgactgactctgcccctagccaaacggcgacggactggaggtcacatcatcgtcgtctatcatcgcaggccttctacgatgag

SEQ ID NO: 539185 - DNA, 946 bp, Homo sapiens
gcccaggagtgagtagctgctttcggtccggcggacacaccggacagatagcacgtgctggacggcccaccagccctagccctccaactagtcagcctgcgcctggcgcctcccctctccaggtccatccgccatgatggccccatgctggcgccgtcgtgtctctgctggccctgagccaggccctgccacattagagcacgagaggctactgggagcttcacccatggacgactgggccatatacatgatgaacgatcgaggaagcatacgggcgctgacacgtcaggcgtcctggacccggactactgacacacccacctacagcgccatgtgtcctctcggctagcattgccacctgccgggtggccccacgctgctcccgaccctgggctctcgacagtctgatgccccaaaagacgatctcccactgacacccaacggctgcctagcgacccttgccagaacacaacggaaccaatctcccgagtcatccccatagggactgaccttccaacgcggcgtcctcccgccacccctcttacagaccccccatccgcaacccatgaccttgcacacgaaccaaagcactccttcccacacgaacccccaatgcaagccaacggcccctatccagaccccccacctagcccgacaaccaacccttccgctccaccgccttccataaccacctccttacacacatcgcacaccccaccccatgcaaatagcccccgacatcacccctccccccaatcccctataccgcccaaggcggcgatgcacgcccaatggctccctcgcagacatcccctacccgcacctccttcagcgcagccgacatccgacctcccccggcgccccaatcacacgaggcatacccgcgggctggtgtccccccaccacggggtgccccagcctggactgccccacatgacgaagcggc

SEQ ID NO: 539186 - DNA, 447 bp, Homo sapiens
ttcggtagaggattcctagttcctggggggctaattaaataaatcattaatactcttctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaacaaaaaaaaaaagaaacaaaattgggccgaataagccaaaaaggcctagtcgaaattccattaaaaatgaattggccatggatttaaaacgatgaaattgggaaaacccggagttaacaaaccttaaacgcctcacaataaatcccctctggccaatgttgcataggaccttatcgggacgtaacttagagcctttccaaaaagtttgttagccaaagaggggctaacgggaaatggcaagccgcgaaaaattctggcaaaaaacatgtgaagatatgggggaaaaaagc

SEQ ID NO: 539187 - DNA, 267 bp, Homo sapiens
atagcagcatgtcattatgaaactaacaggtttgtgtgtcacttcttttatactcaacttcttttttttattataaaaggtacacttctgtttatatttaaacaacaaagaacaaaagctactctacacacttaaaaatcttaattacaatattcctcaaatctatttcacctacattttaaaactactacatacagcaagccagacatgcagcagttaagaaatggaataacggtgcgggagacagacggggaccacgaaagaaaa

SEQ ID NO: 539188 - DNA, 102 bp, Homo sapiens
  misc_feature (33)..(33): n is a, c, g, or t
tcaaaatgatcactgagccaaaagggcactggnctatgcttttgcctggcaggtaaccaggacaagaggaaggaagtactcaagtcacttaatgaggaagct

SEQ ID NO: 539189 - DNA, 260 bp, Homo sapiens
gggacggacagtcactatgagaatcgtacgatgatggctgcaaatggagaactactttcactctttttcccccctctagagaatcaattgatcttttacttactcttggcaaaaaaagaaaaagaaaaaagtccttattcattctggttctatatagcaaaactggatgtccaaagtaccttctgtccacacacacaaaatctgcatgtattggtggggggtcctgtcccctaaagatcaagctcgtcgagctcgtcata

SEQ ID NO: 539190 - DNA, 162 bp, Homo sapiens
tgtgactctagacggatcccccacgtacttacttgatttttatttgctcttcaaactattacaacatttttgtcccttaataggtttttttgggcagataatgcgaggtccgtggtgttaccttttatatactcctattaccttatgtggtcgtcaaacatg

SEQ ID NO: 539191 - DNA, 237 bp, Homo sapiens
tacctacaggatctagaaaatagcctcaaaagggcaaatctaacaaaaaaaaaaaacgccgttaatctaatcaagcctatattaatttacaaaaaaaaaagggccagaaaaatattggggcttgcacaataagaaacatctgaactgtggtaacttctacagaaaaccctgttttcttcataaaaagggaaggaaggaaaggagaaatgtgaggataaaaaaatttttctaaatacc

SEQ ID NO: 539192 - DNA, 447 bp, Homo sapiens
gatcccctgtaacggcgtgattgcccttagttgatcactgtgaaaaaaccgtagtggggattgttcaagaagatcgtgtattacgcgtttcagaactattgactctgaagccgcactcatcatgatcttagagctaccttggaaagatcgccgtgaccagagtccaaatattccactaactcctgaacctgactacgagtcatttcctcttctgagcacatgattttcctagtgaaagccccctacctattatttgaaaatttgacagtttatacaaactgagccaagattattatcttcaaagggactcttgtacaattccactgaaagacttctaattcttgatgctcagagcagctaatgaagggagatgcctttgactctccagcgccaagaaggtgcctgcgtcagtagttattttgaacactccctccacaattacttcaa

SEQ ID NO: 539193 - DNA, 104 bp, Homo sapiens
gaattattagcccttaaaattgattgtgcttgagctgttatgcccataccctggctgtctgcctggcagtcgagatgtggacgggagctggagggggccgcgcg

SEQ ID NO: 539194 - DNA, 432 bp, Homo sapiens
ccgtcgcgatgtagctcatgcctctagcaataggataactttgcacgagtttaggcgtccaatcatagacaggctcacaggcagaaaaaaaacagagctgcagcaatggcaaacaatttacaaaagggaagtgctggacctatgaggctttatgtgggctcattacacttcaacataactgaagatatgcttcgcgggatctttgagccttttggaagaattgaaagtatccagctgatgatgtacagtgaaactggtcgagccaagctatatggatttattacattttctgactcagaatgtgccaaaaaggctttggaacaacttaatggatttgaactagcaggaagaccaatgaaagttgggcatgttactgaacgtactgatgctacgagagctagttcatttttggtaggtatgatgaaggacgca

SEQ ID NO: 539195 - DNA, 1041 bp, Homo sapiens
gtgcggccctcggcgaagttgtgtttggtgtgggttcttgtgcgtgtgttgttgtctcccccccgcgcctcgtccgtcgtgggtgttcgttcttttcactttggtttttatctggttgttgtgtcggtcgtttgggggtcgtgggttgtgcctctcgtgtgagaggggggtggtgttgttgtgtggccgctatggtgtgttgtgtttctcgtctcgctgctggcgtgtcgttagctcgcctctccttttttttttgtttgtggatggttttgctctctccccctccctcctcttgttgcttctgtgaagtccgcgctcgcggtgttcgtggtggaggtattctccccccactccgtggtggtgggcgcgctcgcatcggtgagcgtgccgcctggctctctgcgtcttggggctggtgtgctccactctgtggtgacacgcccacgcacgcactcacgcggcggttgtgttttctcactcgtgacgggtctcttgcgtgcgacacgctctcttgctctgtctcctcgctcttgcttcttctccgcgcgctcggtagcctctctctctctcctcgctgcgtggtctcctcccaccgccgcgcgtggtgcggcgtcgcgtcacggcggtgggcggttgtttcactctcacgggtgcggtgagtgcagcacccactcatgttggctctacactcattctcttgctgtcttgtggttatatacacccaccaccgtcaccacgcaatgaggaccccccccatcacacacacatataagaggagagggttgttttgtgcggtgagagaggacccacagagagagaagaggcctcgttttgccgtctccccccaccccccctgggtttttctctgcctccttatacctggtgtgtactcctgacccagcttgttctcgccgcccccagaagtgtggttgctgccgcccttcttttgttgttttttcttttttttttgggggggggttttgcacaccccccccctcacccacatcaggggccccccacaaaaaaatattttttttttta

SEQ ID NO: 539196 - DNA, 110 bp, Homo sapiens
  misc_feature (3)..(3): n is a, c, g, or t
gcntgaccctgcctggcacacatgtgcccagacggcaatgtcctgtgactatgccattgtgaatgcactacactgaatcccatgccagtgatgtgacttgtgccctgcct

SEQ ID NO: 539197 - DNA, 481 bp, Homo sapiens
  misc_feature (37)..(37): n is a, c, g, or t
  misc_feature (228)..(228): n is a, c, g, or t
atgggattgactttttaaatactgtatgaaataaggntccaaatatgcatatctaatttttgaatttttagcaaaatttcccaccaacatttattgaaaagttcatatttgctcacataacttgatttttttacctgtaacatatatgaaatgtccatgagcaattatctggcctctcttccatcttcagttaacttatttacttttctgtactatgatgtaaaaagnaagtttcacttccagtatggtacaaatattgttctaacttcttcatttatttaataatatcttagctattcttgactaatgtgttatttaaaactttgaatcatcttattaacttccacaagcaaataaatgtttagtctcttgttgacattgtaataagcctccagatcaatgtggggagaactaaatgtttgacaatattgagattccaatgcatgatcataatatgaatttcccacttattaatagcctt

SEQ ID NO: 539198 - DNA, 570 bp, Homo sapiens
gggagatcggcgagctgaagtgcagtgatggagggcatcaagattgagcaccagctggagctgggtaacttgcagtgccaagcatgacctggagaccgccatgcacgtgaagtgagaaggagtgccctgctgagagaagctgcagtgaggcccagtgaggagctggctgggcttgcagcggcactggcgggcccatgctggagtgtgcaagccagccagcacctggctggagcgtgcagtgaggcccaggaccagcgccggtgatgccgagctgcgtgtgcactgagctggaacaaactgtgactgtggagtacctggtggccagtgcgcagtgctatcgacgttcctcaagtgagcagatctcgctgtgccgagaacgacgatgttggactacgagctgtgctgcagcgggcagaagcccagtggcaaacaggaggtcgagagtttgcgggagaagctcctggtggctgagaacagactccaggcggtcgaggccctgtgctcctcccagcaaacccacatgatcgagtcgaatgacatttcagaggagacgatcaggacgacaggaac

SEQ ID NO: 539199 - DNA, 185 bp, Homo sapiens
agctggtcggtgtctccttctacccaccctcacactaagagaggttctgggggtcacattttttgttccactcagtcctctctcttggagtggtttggggcaatcctgatcatcgtctgtgttacatgtttccctgtcccccttccccagggtggtttggtgtaggtccttctcaaaacacactg

SEQ ID NO: 539200 - DNA, 255 bp, Homo sapiens
ctcatggagattttcagaggaggaaaccaaaggaccagcaaaaactagattcaatagcagacatgaaggcgtttgttgagaattatccacagttcaaggaaatgtctgggactgtttcaaggcatgtcacaatggtgggggacttctcgattggtcagtcacggatcttctgggggttcaggggtgaccagactcgcctctaaaatcccatctggtctctcggatataaaggctctcgccccaaggtacatattt

SEQ ID NO: 539201 - DNA, 1545 bp, Homo sapiens
caataggaactactggtttgctgtgtaaatgaactatgctcacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagagagaggagggggcgggcgcgcgccgttgtcttgtcttctcttcgtgtggagggcgtcactgcacacgacgccaccccattcattttttgagcgcgagaggggcggggcagcatcattagtgggtgggtgattgtattatatatatatatagcgggagggtggggtggttttattgtatatataaaacaaatagaggagtgggggagagagaaagatgggaaggtcaggggagattatttgttaagagaaagaataatttttgttggggtgggggagagagaagaataggagggggagaaaatattaaatataaagatgagaaggtataatgagaggtgatgatgggtggagtggtttattttatattatttatgattgtgaggaggtggtgggaggagggggaggaaaaacaaatgtgattgaagtgagaggtaggagagagaaagataagagaagatgtgagaggagtagaagagagaaggagaagataatgagaagtattataattatttatattgtgagcgagggggggaatctgttgtgttgtttgtactattagagaagggagaaaggagaagagggaagaaaaggaggaagagaggaatgaacagaaagagaagaaaaagaaaaggagaggcggaggggcggaagcgacaggggacggcgcaggacggaacagggccgggagggagaaagaagagaaaagagaggagaagaggagaagagcgagagaaggagaagagaagggcagcaacagaaacaaagaaacacagacagagacgaacagacaacagaaacgaagagagagaaagcagagacggagaccggacgagagaaaggcgagcgagaggcaccaaagggagcgaggaggggggacagaggaacggaacgaagaaggagagagcaacgaggggaggacaaaggaggaggagagatagggagagaaggaggggggagaggagagaagcaaagagggagagagagagagagggaaggaaggggcgaggcggggagagagggagggaagaaagaggtggcgagagagaggaggagaggaagagaggagcagggaaagaaaacagaaaggacagaagaaagaaaagaaaagggagaaaaaaaagaagcagaaacaaggaaaggaaaaaagaacaggaagaagcagaaagcagacaaacgaagaagaaaaagggaacgaagcacagacggagagaaggggacgagagaaggagaggagagagtgagccgaaggcagacagacaacagaaaggggaggaagaaagagagggagaggggaaaagacagaaggagagagaagaggagcagggaggaagagcagcagaagacggatggaacggagacgcacgagaggagcgaagagacca

SEQ ID NO: 539202 - DNA, 365 bp, Homo sapiens
cacctctgacgagttccatcaccttgttccacaggtacaaattcataaactcctgaaaagtaaaaataaataatattgaagtgcctaactttaaaaaatttttaaattcaaaagtaaaaattaaggaaagagtagccacagaaaccttaaaggttgctttctgaatgcttacccatagagattatgaagaccttggtgcattgctattgatgtgagtgtaaattacatgtacataataaaaggaggtacagcggtattcagctgagttgtctcactatcaagggtactcgacactgagtgtttgagttccacacaacctcgaagtcctcccttattcacagtcatcctctcattcacaggggaca

SEQ ID NO: 539203 - DNA, 217 bp, Homo sapiens
agaaagcctgctctcttgcaaagacagcttttgatgaagccattgctgacttgatacattaagtgaagagtcatacaaagacagcacgctattattgcattaactgaggagacacttgacattgtggacatcggatacccaagggagacgagctgacgcaggagagggaggggaaaattaaccgcctcccaactcttgtctgcctcattctaaattt

SEQ ID NO: 539204 - DNA, 399 bp, Homo sapiens
  misc_feature (53)..(53): n is a, c, g, or t
  misc_feature (295)..(295): n is a, c, g, or t
  misc_feature (317)..(317): n is a, c, g, or t
aaaaaatgtgccggggcctacaaacaagaacctgacctgtggcaacaacaacngcccatattattcggatttagcccttaaggatgagccataaaccctatcctaaaaaaaagattggttaaaacatataaccccttctctggtgatttaattcccattccttaaaaatttattttcaaaaccctaataaatttttctgaatttcagctttttaatctaaaaaatgggtgagtcgaaaggagattgattgttagctatagaacttggtctccttccccacctttacatttagagnacaactaaaagtagtactaggnaaaatggtgagtagcctgtccccctaacaaaatgcatgatgtcctttaggtgctcttgagctgtttaaatgaaattcataca

SEQ ID NO: 539205 - DNA, 137 bp, Homo sapiens
ctcatatgcaatgaaacaatcatgtagtttatgaaactaactctgtgattaaatgtggaaagtatgtaaacaactatgtttatgttaaatatttataatgatgcattgtgaccctgaccaatgtgaaatagaatgtt

SEQ ID NO: 539206 - DNA, 500 bp, Homo sapiens
  misc_feature (397)..(397): n is a, c, g, or t
tttctttcgcccagcgctgccgttgttatgtagggccacatctgccagagcctggagtctgcgaaggccgggatccgcgttccccggacccaccagtgggtgctgtgcaaacccgagagaactgtgttgcaaattcgtgactggtcagcctcttgtgtggcagctgagtattggagccaggagcctgccatgaggttttgagaacagagtgctgttttagagctggcagcagcatctcagcccaagagaaggttatattcccagaggatgtcagtcccaaggaccagtagctgccatcagtttggattctgaaaactaactggcatcaacactgggtgtagaaacatgcttgccttatgtatcagaggacatgctcagcagacccaagagatatatntggcaactttttctagaaaaggcacattgggtatcattcattacattcttgagtttttttgggtttttttttttttttttggaaacagtcttgctgtattgcc

SEQ ID NO: 539207 - DNA, 284 bp, Homo sapiens
gcagtctgatggacagagcaggacttgttcgaggactcttgtagtgctttgatttgtttgtttctgaaaacactcacataccttaccaactgctgggagggtgggactgatccagttcgtttgctgaatgaatatttgtttaaatctgtacagtttcacgtgtttacttatacagagtgtacatactttgaaataattaatttaaaatgctttatattatttagctagaaattgctgtttttaataaataaatttttttaaaaaataaagatctttgcttccta

SEQ ID NO: 539208 - DNA, 208 bp, Homo sapiens
tatgggaagggggggaccctttggggggccccccggggcctggacctatgcaggggggccacgtcccccccccccttttttttttgggtccctgcccccctttgggggggtgtgggggtgttttaattttctttttgggaaaattgacaaaaaaaaaattggggggggggttttttactgcaataaaactgccccatttggccccccc

SEQ ID NO: 539209 - DNA, 113 bp, Homo sapiens
tagcacttgtcccgtccggagtcacatatgatgcgactagtgcgaaccgatcgcataggataagccagactctggctcaggatctccagctcatgctcccgagtagccggact

SEQ ID NO: 539210 - DNA, 107 bp, Homo sapiens
gaggctgggcccagattaagatgtcaataaacggtgacaactttcaaaaacatcaagtctgtgaccgaactcaacggcgacataatcaccaataccatgacattggg

SEQ ID NO: 539211 - DNA, 816 bp, Homo sapiens
tccacccgcgtgttcaaagggcctggttgccccttctgggtattcggaccgagagttggcgcgccaatatctggttctcaacttattgagacctagtggcgggccaattgttgccccgatgcgtttagtgctaatccccgttgctccagcctggcgttgtgccgctccccccgcgcccgattgtggtgccgccggagatcctgcgggcgacgacccaccaggttgtgtctatcctgccgcacccattgagccccatgggctcacgcttgttcttggcgcttcacacccttgtcaacggaatcgggttccattgtcccccccctcggaagccgctgggcgctccacagacgcccacaagacgtggtgtacgcctgcccgtctccgcgcacagagtgaggctgtccctcatcattcagacacacctcggcagacactccgagggggtgacagtcccctcgctcgacgcgccagccgtgccccccgcctgcttggaggggggaccacctgcgagccgaggcgtggacccctctcgctcctcggcggagcacatccttgggcccgcctgcacgccacgagagggcccggcgccccacatggtttgtggcaccggcgccgcctattcttctccacggccaccgactgttcacacgccggcgccatgacgcgatcacgcacgcgattttgctgcgggcagcatcggtggtctaggagcactgcctctggtggctcacgctcctcgggcgacgacgttgccctcctcgctcgacccctcgcgtcaaggagaaaaaaattagcactggcccccccacatagacg

SEQ ID NO: 539212 - DNA, 213 bp, Homo sapiens
agaccttggagagacaggttgcaggccagactcggagccggcgccacacccgccagagctctgagccccgaactgctccagggcctacaacggcagttttctacatgtcgtgaaatttttggatgccgtaagaaccatcacagacaaatggttggtgctgggaccatcatgtgacagatcgagacatgagagcattcaggaattgagcatgca

SEQ ID NO: 539213 - DNA, 580 bp, Homo sapiens
agaggtattctggtttaatctcagaaagagcaacccagaactgttctccctatttttgcttgtggcaaagttgtattaacaggtgctaaagtcagagcagaaatttatgagacctttgaaacatctgtccctattctaagggattcaggaagacgacggaaggctctcatggacccgtcctcccccgcccccttcttttttttttattaacaaacaaggttgttttgggacctttaaaagggggggttgtgaaaaaatggatgtttagttgcagggtgtggccccaggtgatgcccttttgtaagtgccccccgcgggaaaccgggaaggggcattatttgtgcatttagaaccccgggcagggtgactgtgagttggtcaaaccgggatgctatttgggaagcgctgcccatttatttatatgtggattttaaacccggctgttgtcaagttgggttgagggagaaaactttaagtgttaaaaccccctttataattgattggactttttaattttaaaggttttccccaaggaccccagtttttatatttttaccagaaaagtaaaaattttttttta

SEQ ID NO: 539214 - DNA, 383 bp, Homo sapiens
gtttcatctgtctcctcttatcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagaaagtaatggagttgaggaatactgttactttctgcagccaagcttgattccttgaattatagttttctaagaaaaaatagtttttaataatctaaggtaaatttgttgcaattattagcagcagcataataaggctttttgcgcaaatgaatgttattaggctagggttattccaaaaaaggaatgaaggcacaatttttgc

SEQ ID NO: 539215 - DNA, 445 bp, Homo sapiens
  misc_feature (26)..(27): n is a, c, g, or t
  misc_feature (146)..(146): n is a, c, g, or t
  misc_feature (149)..(149): n is a, c, g, or t
gaaatacccaactccaacctgctctnncctttctgtctcatctaagggggataaaccagtacaaaactcagaagcacttgtgagggtcacaatttcactgaaagactgagacatactcataagattatgtgatgtttcccctcccngcntatcttaccccagcactagagatcctgaatagttaggggagaatataactgaaagaactgtgtgtctcaaacttcaagaagtctctaggataacccaaaggcaacaagggagaccaaaacaagggcgctggagacattttagcctctgatactgacagctgcagcaaacagaaaacgcagcctaaccgcgggccagataaaaacctcacactaaaggcctaactatcagttccttttaaccagtgcatcatgtctcactttcaataaaatgttaccacacgttctagacacacaaa

SEQ ID NO: 539216 - DNA, 239 bp, Homo sapiens
ccatgtggtctgtagaacgtgccctgacacattgcgaggatccaccttcctcatcctcccaaaatgctttgattacatgcgtgagctattatgccctgcccagcctcccttttttaacctgtgaaagttttgtccagctacctcatttttaggctttgtttgcaggtagccactccagtcctgactttattattctccactctttcctagaacccactagaagctgatcccatgactaa

SEQ ID NO: 539217 - DNA, 117 bp, Homo sapiens
actgcgtatcaccacctgtcttccccatgctttcttctaaaaataagttggaattaattttagaagaaagcattaggggtaggcagggtggctcacgcccgtaatcccatcacttga

SEQ ID NO: 539218 - DNA, 652 bp, Homo sapiens
cccccagcaaaaggaaaaaaaccgccaaaaaaaagggaaaaaaccggtcctaaaaagtttcactggggaaaactcacttaagagtattttcaaaacatacaatttgcaaaaaacttggggagtattttgtgaagagctaaaatttttttaaattaaaaatcaagtgaaaacccaaaaactttaaaacacgatccgaatttgtgcaatttctaagtatcaaatttgttctcccttcatttaacaggtgttatcagtctctcctcctgtaagattctgtccttcccctaatgacaagccaatagttcttggtggggttgcatgtctcctagagccccaggacccctgtcatgtggggaaggggggagggcagaagggtgggcaaaaaccagggttgagggagggagttcaaagaaaaagtgaaaatatgggtttatataaacatatttaaaacagtttagcaaaagctttctcgttgaacagctttaaaaacaatgtgaatgaaatcttagcaacttggttagtaatctgaaaagtctattaatggatacttgaaattctgtttggataaaaatgcattttcccctttattttaacactgtgtaaaagaacattatgcatgtaagtggtttaaaaattaaatggtttaataccc

SEQ ID NO: 539219 - DNA, 250 bp, Homo sapiens
aaagacaaccagttctaagagcgagttttgccccgaggtgttgtcaccatttaccgagtgacgagcggcctgcctacaggcgtacaggccggcacagatctgatcctggccattcacgtgcctcaggacgtgccccttgtagttggtgggaatgccgcccatgttgtaatgcacggtggggaggacggggatcggctccttcgtgacgtccacgccagcgaagatcatgggtgtctctgaaatgccaggc

SEQ ID NO: 539220 - DNA, 314 bp, Homo sapiens
  misc_feature (97)..(97): n is a, c, g, or t
  misc_feature (167)..(167): n is a, c, g, or t
  misc_feature (204)..(204): n is a, c, g, or t
  misc_feature (212)..(212): n is a, c, g, or t
  misc_feature (237)..(237): n is a, c, g, or t
  misc_feature (276)..(276): n is a, c, g, or t
  misc_feature (281)..(281): n is a, c, g, or t
ttcggcacagcttggctcatctgcaacctccacctcctgggcttgagcgatcctactgcctcggccccccaagtagctgggaggacaggcgcacacngggcactcagctaatttttgtatttttcgtggagatagggtttcaccatgttgcccaatttggtctcganctcctgagctcaagtgatccgcccgaccttggccttnccaaagtnctgggattacaggcatgagccaccntgcctgggccagaaaatttgtaaacacacacaaactctnaagtnggcctaattccctctcaccaaaccaattcacaa

SEQ ID NO: 539221 - DNA, 119 bp, Homo sapiens
tatactagtctgcacggcggcttccttccttgttactgtccgatagtttaccacatctttgcttggaaaaccccttcgagaagcgccagaagaacatgtctgtacacctgtccccctga

SEQ ID NO: 539222 - DNA, 1018 bp, Homo sapiens
gaaagaattcacccaatgtttacatcaagaatttcggagaagacatggatgaatgagcgccttcaggactctcttggcaagtttgggcctgccttaagtgtgaaagtaatgactgatgaacacgtggaaaatccaaaggataggatctgtaagctttgaaaggcactgaagatgcacagaaagctgtggcaatgagatgaaccggacaaggagctcaatggaaaacaaatatatgtaggtcgagctcagaacacaacggtggaacggcagacggaacttacgcgcaaatttgaacagatgacacaagataggatcaccagataccagggtgtaaatctttatgtgaaaacatcttgatgatggtatggatgactgaacgatctccggaacaagagattatactccaatagaggatgcaagacaacaaaatgcaaacaggtcaactacaatggcaagaagacgagaacgacacaccaaaaggggaaaacgagaacaggacaatgaagacatacagaaacacagaaagacaagccaacaaacaagaccaaaaaacagaaaaagagaaacgggagagcaaaaagaaggagcacaaaaacaaaccaaaaaaaaaagaaaaacatcaaaaaacatcaaaagaaaaaaagaaaaaaaaaaaacaaagggaaaaaaacacacacaaaaaccacaaagaataatgacaagacaaaaatggaacaaagagaaaaaaagagagagaacaaaaaaacaaagaaaaagaaaagcaccataaaacaaaaaagaaaaacaaaacaaataaaagaaaaaaagcaagcgggcaagaaaaaaaacaaagaaagaacaacaaaaaacagtgaacatacaaaatccaaacaaaaacatagacaaaaaaaggaacaaaaataaaaagaaccaaaaaaaaacgacaagacaagtgatcaaaggaataccaaaacacaaaatagaatacaggagaaaaaaagacaccggacgaagaaaaacgaacccaagaaagacatac

SEQ ID NO: 539223 - DNA, 418 bp, Homo sapiens
tcctccccctttctctctaaggatgggccagaaggagaagctcctacccctggccctacggccgagcagacggctccatgctgggcctgaggcaccgctgtcccgcaggcgagtcctcacggagaagagtccgtgtcacctccatcatgcagctttgcttccgtcatggtagacctgcttccaaatgtccgagcgcgctagctagcgtgcccgctgggacagaaggtgatggagaatagcatgtgggacaccgcgacatcttgaacggcggcacttcacaattgatgagcttgtgagagttgggcgtccgtctggggcagagagggcaacgttgtggaagacgtgtagcttggcgtcgggagaagacaaggccatttcattcgtggggctcgaagggtcctcttcgaagttcccacga

SEQ ID NO: 539224 - DNA, 662 bp, Homo sapiens
gagttactgagtttatttattttgtttgtttattttttgagacagagtctcactctgttgcccaggatggagtgcaatggcgccatctcagctcactgcaacctccacttcttggattcaagtgattctcctgcctcagtctcccgagtagctgggattacagctgcccatcaccacacttagctaatttgttttttttttttttttttaatagagccggggtttcatcattttggcctggctggtctcgaactacagacctcaggtgatctgcctgcctcggccttccaagatgctgggattacaggcatgagccactgcacccggccggaattactgagtttagatcatacccatttactagacattctcatacatctctccagtgtggttttcttcatatattttcccatcacttctttttgaaagttcctattttgtaacatctttatcaacatttagtattttcagtctttgtaattgctgtaaatcccccaaatataaaatcgtatcttaatgtcgggtttatttgtccttctttgatgaccaataaagttaaacatctttttttacatttgttgaccatttaggccttttcttttctcagtgattgttcattatttttccctattgtcaatagaaagttgtatttaaaaaaaaaa

SEQ ID NO: 539225 - DNA, 140 bp, Homo sapiens
ccgaacatcctggaatagctgccaatctctattactaaataatttacagtatgataatgacatactgaaacatttatccagacgagtaatgcccttgtacgattcagtgactgcttgattaatgtgaaggttgagaggga

SEQ ID NO: 539226 - DNA, 847 bp, Homo sapiens
  misc_feature (98)..(98): n is a, c, g, or t
  misc_feature (126)..(126): n is a, c, g, or t
  misc_feature (181)..(181): n is a, c, g, or t
  misc_feature (230)..(230): n is a, c, g, or t
  misc_feature (244)..(244): n is a, c, g, or t
  misc_feature (251)..(251): n is a, c, g, or t
  misc_feature (298)..(298): n is a, c, g, or t
  misc_feature (304)..(304): n is a, c, g, or t
  misc_feature (316)..(316): n is a, c, g, or t
  misc_feature (319)..(319): n is a, c, g, or t
  misc_feature (324)..(324): n is a, c, g, or t
  misc_feature (335)..(335): n is a, c, g, or t
  misc_feature (342)..(342): n is a, c, g, or t
  misc_feature (347)..(348): n is a, c, g, or t
  misc_feature (363)..(364): n is a, c, g, or t
  misc_feature (378)..(378): n is a, c, g, or t
  misc_feature (451)..(452): n is a, c, g, or t
  misc_feature (467)..(467): n is a, c, g, or t
  misc_feature (485)..(485): n is a, c, g, or t
  misc_feature (497)..(497): n is a, c, g, or t
  misc_feature (505)..(505): n is a, c, g, or t
  misc_feature (517)..(517): n is a, c, g, or t
  misc_feature (521)..(521): n is a, c, g, or t
  misc_feature (531)..(531): n is a, c, g, or t
  misc_feature (591)..(591): n is a, c, g, or t
  misc_feature (606)..(606): n is a, c, g, or t
  misc_feature (642)..(642): n is a, c, g, or t
  misc_feature (644)..(644): n is a, c, g, or t
  misc_feature (651)..(651): n is a, c, g, or t
  misc_feature (847)..(847): n is a, c, g, or t
gactcagtgcctgagcccggccctgcagccccagccgcagtgtctgaaggccacctcccaaagggagcacgttgccttttcaaactcccgtgccgatntcctaagagcccctagtccaagcctctnagatgaagctgaggagccggcctaggatcccttcccagctctgaggacgggctgnagagctctgcaggtgtggattcaccttacgcccctacagcaggctcagnccttcccaccctgnccgatgnccagcagcacaacacggagtgagacaggatgccacggtgactgccgntccgtncgtgcacacacnagnggtgntcttctccccnttagacnccacnntgccaacccaagggnnaaagacagagaaancaggtccccttgcagatggctctcccatcttcctgcaagtcatctgtcacacacagtggcagcacatagcgtnnccttctttcagaaanattcctcttctggggctncagaaagctggnaaggccantagcagagcttnggtnatgccccagntgcttgggagctaacagctgacctttcgggaagcccacagacgctggaggaatctgagtntctccaaactgccgntccaccagtgcccttggacagccgtgcctgttcgcngntctcccntaagtctgattctcatcgaggcccctcgttctatgactgtgcttgcagaagagtaaacactctcggatgacgtgttctgggggagccgcgggaccctgtgaatgtcgatacgacgtggccattctttggcccagactacttgtacagcttacctgcaaggtggctacactgctgtctcaacctcccttgcattacn

SEQ ID NO: 539227 - DNA, 1020 bp, Homo sapiens
  misc_feature (472)..(472): n is a, c, g, or t
gagtggtgtggtcccactcagtcctcgcctccggtccagggtggtcttgcgaggagaggtccaaccgtgtgtcctttctccctccgttcccgggtttactgtgacccctagcttggggtattttttggcaaatgggctccatcccagagttttcttccagagattttgtggcggagatttctggtgcccagaatggcccccatgggagacacggtctcccttccccggtgtttttcctcccctctcccgcgccccttttcctccgcgtttttccccccttttgtggggttcgccccccgccgctccctgtgctgagagcaaactgttcgttgccgtgtgtggcgaaatgttcctccccctcctggttacgaacactcgttgatgtgggccccccctctttttttctactcttctggatactccccacctccttcttagtgttttccccgcgccgccccccctcgtggtgttnttggtagccttctctgagcgtatgccccccctctgtgggtccctcctttccttgtttctctgtatttgtagtaggacacccccctctctcgcgggggggtttccactccaccccgtggccccacaagaggctcctctctgtcgtgtgctaagggttccccaccattgtgctcccagagagagctctcccggaggcgctctatcaggcatctttttctcccttcattccctccgccccccccccccttcttatccacttgttggcgagagccgcgttctctcaggacagtgtttgttcttctctaagtggcccgcctttgagtgtgttgagtgagattgaaagcgtgtgtctttcttatcacccaatggtttcgtctcaccccttcccttcgcagggaaggggaattattttttttggcgcccccctgggttttttttttgcggcggggccccttttaattttatttttttaaacaacctttttttttggaccccctctcccccaaatttttccccggaatttggggcccccttaaaaatttaatggga

SEQ ID NO: 539228 - DNA, 369 bp, Homo sapiens
  misc_feature (345)..(345): n is a, c, g, or t
agtctcggagtttgagaccagcctggccagctgggaaaccccgtctgtacaaaaaatacaaaaagttagccaggcatggtggcatgcgcctatatcccagctactcgggaggcagagggagaagtgcttgaactctggaggctgaggttgcagtgagcctagatagtgccattgcactccagcctaggcaacgagggcgaaactctgtctcaaaaaaaaaaaatttagccgagttgtggtggcacattgccttgtagtcccagcttactcgagaaggctgaggcaagaagattcacattgaaccttggaagagcagggggttccaggtagaggcaaggatcacanccacttgcacttccagcctgtggg

SEQ ID NO: 539229 - DNA, 429 bp, Homo sapiens
tccaatcatctgcacgatttgcttcaatcacactaacattcatggaggagttaccatatgactgctgttacacttgccagctgtgagtctttgttagcttcaatgaaaattcagcttaatacatagacattcactgatgatcatgtcaggagccttgatcagaagactttcaatgtgtgttgctccacgtttgtagtaggcaagctatcaagtaaggctaagacagaagagtgtatctactgaagatgtgatctaagaattgccttctacagaggcgacttatattctgtagaaacctagctagccaccaaagatgttcacaataaaggatagcttatactagcaaataaacatgtataaaagggcttagccaattagagtaatattcatgagtacaagcataataggttacttgccttctccagataa

SEQ ID NO: 539230 - DNA, 153 bp, Homo sapiens
gatcattctatttgtcccgtctattgcatccccaccatccaaatatctcatcaataaccgatctaagcgccagcctaacaatatcaaccattgcccttccctctacacttatcatcttcaaaattctaattctactgatctactaggaatggg

SEQ ID NO: 539231 - DNA, 202 bp, Homo sapiens
gacggacccacagaagaccccaagtagccggagcaatactgagcaaagagaacagagctggaggcctcacactacctgatttaaaaatatactgcaaagcggccgggcgcgctggctcatgcctgtaatcccagcattttgggaggccgaggcgggtggatcacaaggtcaggagatcgagaccatgctggctaacatggtg

SEQ ID NO: 539232 - DNA, 976 bp, Homo sapiens
gactcttacgaagggacggggccccacgctgcgcaacgccgacggattttgctcatggcggatcgcagcagcaggactggcggtggtgggctggcgtccctggagtcaggcaggattccagtgcatgttccgggcggcggaccacgaggccctagcatgtgaatgcattcctgactattatgtggcatgcatacagcactggataacaagcatatgataaagctgtggacgttcgtttatagcatgctcgtcaaagaatggtgacatttgtgaaacttcgggtaaaccaaaaaccacacctaacaagcaaaacctgctaagcacagcaataacaagccaaaagcaagaatactgcagcttccttacaacagtggacaagttggggacaaatgttctgccatttggtcagcaagaacggttgcatttacccagctaccattgcttccaatatgatattcaagaggagaaacctgtgttgatggttataacactggatcatggaaatcagagaggagcaaaatctgtccgatctaatttacccaatctgtgaagtagctaataatatagaacagaatgcgtcaagagaatgacaatgaaagccaagtttcaacagatgaaagtgagaactccaggtctcctggaaataatcagataacatcaaggaccaaaatctgctccaatggacctcctttatgctccatgcagaagccccatgcagggccaagactgtgaccaggaaagcaaggtcaaaatcatggaccaacaacgaaacagaaaacagcacaacgacaataagaacaatgaggcatgatcccatagacgtccggagcgcgcaaaataaccgcagaaccacccataaggtacagaatcacagaagaaaaacaagggggaaagaatgataagaacagggacaagagaggaatacaccagcgcaagagatacaacgacggatagacgcagaagtgaggacgaaaga

SEQ ID NO: 539233 - DNA, 401 bp, Homo sapiens
agaaacaggcgggcccggtggctcactcctgtatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaataaaaaagaaataaaatcaaataaaattaatgacagcaacaaaatgacagcaatattaataagagccgctaagctttatcaacccttactgtggttcaggatg

SEQ ID NO: 539234 - DNA, 373 bp, Homo sapiens
cacaatttttccggcccccccgggggtggggggggtttccccccccaaaaaaaatggggggttaaaaccccccccccccccccggggttgtacccggggcctccccccctttttaaaggggcttttttgttttttccccccccctatttttggcccggggggcgcttccccgtttgggtttttaaggggggggccttttttttccccccccccaaggggggtttgcccccccctttttttaaagggattttttccccccctgggcccttgggggggggggggggtttggggtttcccccccgcggggggtttttttttgccccccgggggggggggggggggtgtttttttcccctttttcccccctttttta

SEQ ID NO: 539235 - DNA, 264 bp, Homo sapiens
ctgcaggggtgagggttttatccccagtctgaagatcttccgtatgccatgggtgtgaccataccaaaaaatactgttattctcttttttaaaaaactatgtggctgtatttcttcttttggtaggctgtggcacagttaattagcatgggaagtacccgtaatcagggttaccgaaaaagagtaataactattatactaacactactcacaaaggtaaccctagactccctactcgtactaatcgcattctgactaccccaac

SEQ ID NO: 539236 - DNA, 685 bp, Homo sapiens
  misc_feature (354)..(354): n is a, c, g, or t
agagaacaggacttacagggggcccagactcaaactatactacaagggctacagtaaccaaaacagcatggtactggtaccaaaacagagatatagatcaatggaacagaacagggccctcagaaataatgccacatatctacaactatctgatctttgacaaacctgagaaaaacaagcaatggggaaaagattccctatttaataaatggtgctgagaaaactggctagccatatgtacaaagctgaaacttgatcccttccttacaccttatacaaaaattaattcaagatggattaaagacttaaacgttagacctaaaaccataaaaaccctagaagaaaacctaggcnttaccattcaggacataggcgtgggccaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagcgggtggacatgaacagacacttctcaaaagaagacattatgccgcccaaaaaatgctgaaaagc

SEQ ID NO: 539237 - DNA, 267 bp, Homo sapiens
gtggtgtaccgtagcctcactggtccatctccgtctcctttgtcagcgcttcctcttccatcagctcctaagtgctgggcttccttactgctctttcctcatcctgtggccagaaagcaatcatttaggtccagcccaggttcagtgggttggggtcacaccaaggccttgaattggaaaagatgggcttcgttgaagggccatcttatgaaaggccctccctgtggtcttggttttctccatcccagggtaacaaccacaagaacg

SEQ ID NO: 539238 - DNA, 697 bp, Homo sapiens
ggcctttcaggcaggggtggcaaccaattatatctgaggaccaggagccattttggggcaccagagctagtgagctctccatctccaccgcagactgggtccagagcgccacatctcagcactcacctcatcaggctgacatcataaagcaaacttgggaacctggaagcactctggagaacctttccctgagacatggatctttggaggccgaatgctgtggtgccctcctgtcgtggcccagcgatgaggaggggaaagtaccctggggcatgggccttcagcttcatggcaaacactaacctacctctggctggagttactctcagtgccactataactgcgtcagctcactggactggaggctctttgacgaacgaaggggtatccctgaggcccgggaatccagtgagtacatcggtggatcatgtccttggagccgaaagcatttcagagtcctgaggccggcacttagtgacccagtgccttgacctctcatgcaactacggtgtatccgaggagctgacgatagccggtcgatctgcatgcgtgatagccggtgtcagacacataccttggaaggagtggtgacttccatgggctcatcctaaggataggtgccccccatgtgtgtattaccgaggccagaagagtctaggaacttggttgacgtgggctgttgcaaagaattgtgggc

SEQ ID NO: 539239 - DNA, 697 bp, Homo sapiens
  misc_feature (70)..(70): n is a, c, g, or t
  misc_feature (204)..(204): n is a, c, g, or t
agacaaggttgtccaagcaagatgaaggccctaagcatcgactcgttgtactttcctcgtgcctcctcantcttgggagaacggcaaagcagtcctgtgatggggacataaaatagtgtggatcacaaaatggccggattacctaagttgatattttacccatagtttccacagctggaacaaaaggggcctagcactcattcntggacacaatataaggcaatgctaacaaaactgaagtcacaaaggcaagttattttctaattccaatacaccatgatcatcgttagagtgccaatagatctatagagccatgtccctgaatactagtacagcgattatgcatttgaactgccactagcaatatagaacgacaatatatactcaacaatcgtacgatcggtaggctggacacgtcaaacacaactgactccattacacctaaagacatgtaaggcaagttagacctatgtaataaatcgataaaggtcattgttcaacaggggttacggtatacgaccgataaatggaggcaatagtcttcgtcgatgggaagcgaacgagaagagtctcttgctcaaaggatcgaggggatgtagtcccattctggcatacatggcgacacttatgccagtccaaataggtcaacacacatgtaagaacacggctgaaggggttcaggggactaggtaaagac

SEQ ID NO: 539240 - DNA, 562 bp, Homo sapiens
tatcgcttttgccaaatcccgtagattttgtgtttggttttcatttttttcaagaaattaaaaaaaatttaattaagtttctttattgacctattcgttgttcaggagcatgttgtttaatttccatgtatttgtgtgttttcagaggtttcccttgctactgatttctaggtttattctgttgtggtcagaaaagacagtttgccgtatgattttcgcttttttgaatttgttgaggcttgtttcgtggcattgtattgtctgtgtatttgattttaccagtagcttttatatttttaaatattttcttttttgtacattatttgtttttctttctgattgaagaacttatatcttacattcctgtaagatgagtctggtggtgataaattctctcaggttttgtttcttaggaaaaaaaaattctctctccattttatttgaagtatagctttgctagagacagtattcttgcatgtcagtgtttttgttttgttttgttttttatttttattttcatcactttgaaaatgttgtcgccctcccttctgtcgtcttctcg

SEQ ID NO: 539241 - DNA, 133 bp, Homo sapiens
tgattctagaggatcccgacagcacagaggaggcacagaggaggaactggtttgtatgttttgcttacccgcagtgctggcatggtcacagctgtccaaccatgatccattcacatgctctggcccctgtgcc

SEQ ID NO: 539242 - DNA, 383 bp, Homo sapiens
actttctttatcatttttgaacacttgttaacagattcgcacatagagggagagaaaaaaaaatggagtaacagtcaaaataataataatcagtatccaggccaggcgtggtggttcacgcctgtaatcctagcactttgggaggccgaggcggatggagcacctgaggtcaggagtttgagaccagcctggccaacatggtgaagccctgtctctactaaaagtgcaaaaattggctgggcgtggtggtgcatgcctgtaatcccagctactccaggggctgacacaggacaatcgcttgaacccaggaggcagaggttgtagtgagccgagatggcaaccctgcactccaacctgggtgacaagagcgaaactccatctca

SEQ ID NO: 539243 - DNA, 246 bp, Homo sapiens
tgcatgaactcaatgtgattcccctgccgttggcctatcgaaagtgctgggataacgggtgcatgatgtacctcacctagcaccgcagctcttgtttacatccataatgagcttgtggatctttataatatatattcaggtgtgtgtgtgtgtgtatgtgtgtctctgtatccatgtggtacatgctgtctgtttaagaagcgggcactctggctcctcacagagcatgaaaccgccgtgttacga

SEQ ID NO: 539244 - DNA, 201 bp, Homo sapiens
tatctgactggctaaggacgatcagctgaatgtacatgggttttatgtgcttgtggctcactgaagcttacgtgaggattcccttgcaatgagtagaatttcccttctactcccttgtcacaggtttaaaaacctcacaagctagtatactgtacccatttgcggtccgcttttaacttgaactagtgtaactccttcatg

SEQ ID NO: 539245 - DNA, 116 bp, Homo sapiens
agagcagaggcccacgaggcggtccgctggcaggctggtcctggagagcattctgcggacccggtcacgggcttggtgaggcatgcgaacatgtgggccttggggtgctctgcact

SEQ ID NO: 539246 - DNA, 355 bp, Homo sapiens
ccacattcacagccttggcgcctatagagagagctgtgagcacatcagtacctgccgtaacaccctatccgagaaacactgccaccttccgttccgatagcgtcgacaatttctgacataacttcaatagtgactggcctccaataaagttgtcgagccccatgatgccactccaagaccccattcaagccatgtttaacagcctcggtggaatcttcacctctcaaaatgcccttcgcaacattcggcagattatgccggtcagtccagccatttgatccttgccattgataacctcaggagagattgatagagtgctggtgtctgtatggcacatcctgagatgtggcgacag

SEQ ID NO: 539247 - DNA, 425 bp, Homo sapiens
gacatctgttcctccgaaggcaagccttctatccagaatgtctaaactagctatttatcaagccattttcattagtacttgataacagccacgagtcccaaaacttttagcaaataaaataggacattggcttgattgaccagagggacttcttacacattgttctttcgtcagaagccttttggatgaattacaatagctctgatgaaaataccaccccagcgtcagtccaataggtcagtgagcttcaacaggcatccatccctcccatgaagggactctggtgatgggaagtttctgtaatgacaggaaagcattgaccctcattgattgtcaactttggtattagccatgaaagacaggatgctcattgggtgttctgtaacgtgaggaatgctgcctataccctcccagaacgtctgacc

SEQ ID NO: 539248 - DNA, 151 bp, Homo sapiens
gatgtgaccgcggtctacagtgctgtctgcgtgatttctgttgtccgcgagctttgctgctgtgaggagacccagccctaggccacatactcctcgcagtcctgcagccctctgtaaactccctccctgtgccctgcccccccttgtccag

SEQ ID NO: 539249 - DNA, 290 bp, Homo sapiens
ggggtgtctggcatgtttctcctcctagctctatctactgcgcacacagctgcctgcctcgccagatgcaggtgggcgggcagccctccctggctgccaggaggtctgcatgcccacagtcctgccctgcctctcccctcaacccggcagtgcctgtagcactgaggagcacagggggtgcatggggggcttggagcagggcggcagcccactagcctggcgatcccatgtttgcacatcttctgcactgtccccttgcttggttggcagcgtgcaccagggggcatcct

SEQ ID NO: 539250 - DNA, 356 bp, Homo sapiens
  misc_feature (52)..(52): n is a, c, g, or t
gtagattttcacaagctgtcctgttcctcaaatcgctagctcactgacgagnttgcaagggcttgattcgagcacttccgaaggcgactgtgagccagagcacgacaccacggtaaccttccatgacagttgacgttcatgccaatggaatacggcacgtacgggagaaatcccagacagtggccgagacgatgtctgcctctggccgtcttgactggtcatgagcatgtcgcggttggcgggtgcaaaaatcacctataacgacgacgccggggaaaccggcagggtgacgatcgtgcgggagatgtcggtattgggagctcgggtagacgtcagtatttaccgccgtacccggg

SEQ ID NO: 539251 - DNA, 186 bp, Homo sapiens
gcggccgactactactactactgctcgaattcaagcttctaacgatgtacggggacatggcccgccttgtggccacccctcaccctgacaccgacgtgttggccacccctcaccctgacaccgacgtgtcctgtacatagattaggttttatattcctaataaagtatagcgggagaggcaaaaaa

SEQ ID NO: 539252 - DNA, 684 bp, Homo sapiens
  misc_feature (645)..(645): n is a, c, g, or t
cttccgctgaggtgattgcaggcctgctgcagagcctgggtggtcagaggccggtgctagaggcagatggacgcaaggcgtttgctgacagatgacggggtacaccggactaacactgcaggcgcccatgactcctactgctcctatacctccagtcaggctgtacggaaggctagccttgtgactgagaggcatcagactagctggcacaggtgcatgctggacagcaggcttactgctgtacgatacctagttggagcaaatagagtgccagcggaacaaggtaccctagggatagcagagcagtactattctagagtccatatcaacaataggtgttacgacctcgatgttggatcaggacatcccgaacgggcagacgctattaaaggctcgcttgttcaacgattaaagtgctacgtgatctgagttcagaccgaagtaatccaggtcggatactatctacttcacatgcctccctgtacgacaggacaggagtaatactgcctacttcacacagcgccttcctcgtacatgatatcagctcaacttagtattatacccacactcatgcaggaacagggtttaagactaaggctaacaactcgaggggggaactgcccagtacggcctatagtgagccgnattacagttcactgtccgccggtttcacgttctgctgtg

SEQ ID NO: 539253 - DNA, 427 bp, Homo sapiens
aaagcctaaacaggaacaacttcatcccagtgttgatgttggacccatagatggtgatggccaaggtttaaaaccccttattttccaaaactaaatctaaaaccccaagtaaaccccaatgctcaaagttagcaaaatttggagccattccggaattgcaaaaaaatgccttttcaccaaaatcaaaatgttttttttgtaaactaaatcccctaaacaaccgtgtttcctttgccgtaaacagtttttaaaaatccaatggaaaaaaccactgaagtcccaaaaaaaaaaaaagtaatttttaactattcccataaaactggaggaagaaagggagttttactaaaattccttttgtttgtttccaaatttccctaatggatatagggccaaaacccccattaaaaaggggaatgtggagggccta

SEQ ID NO: 539254 - DNA, 432 bp, Homo sapiens
  misc_feature (100)..(100): n is a, c, g, or t
ggatcccccccgttacccccgttcctagcatttttcctagacccgtaagataagctagtcctattattattatctactagttcattgctacttcgtgtcnatgcaagtattatcacaattagtattataccttgctagccatcttagggattcatagtacagaattgctagagtacaaaaagtctatcgttttatttatttatttatttatttatttacggacggggtctcatctctagtcatacccaggctggagtaccgtattataatcattgctcataggtaaagtactaacacctgagctcaagcaatcctcatacttaagcctctcaagttgcttggattacaggaaactatcatcattattttttttcattttttgtaccgataaggcctctccgtgttgccccagccgatctttaacttctatgc

SEQ ID NO: 539255 - DNA, 1224 bp, Homo sapiens
tggtaccggctcggaagtttcgggatatcgtcgacggagctgtaacaacgggctgtggcgcaggcgtcggtacgctgtcttccagatacaccaggcgctaaggtcgttggtgcgccgaggaaaccgatactggtataccggcgcgccggtcaggatcttcgctatatatagacgtcgaattactgaccggaagaatgtcacccatgcgggccagacactgaacttagtatcccgcgccaccgcttaaatcgggaggtgcaggcagggcgtaagtctagtattgagcgactgtgcgtacaagccataccaggaccagaaagcgaaccatacctgggcaccacataatcggatcgatacgaactttggtgtagtaatgacgtgttaacgacggtcagctgccgcagcgagaaagtgaaataacgcggtcgttgccgtaagggccgcgatcattaatgcgcaccacgatcattcagccgttagccaggttaagtgattctggcgtaactggggatcagcgaagcgcttggctgggcttgccgtacagctgtgtcgggatcgaatgctatacgccagaggccgtccaggttactagccagggttcggccattcactaacattgacgcccatacccgcctgggtaactcggagagcgggcatccctggaacgaaattaacggcagccttaaaaccgctcagcagcagggttaatcactgcatatggcagacgcgctacaagtgggctcaacaacgcagggttcacgcaccgctaaaattacaacaaatagggcccgacccattaccagccaagactactatcaccacatacccgtctagtatcatgcaccactcaaccgctaccacccattccctaaccaacttcctcacaccaactccaaatccccaaaccattactaacattttagaacccatataccacacatacgccaacactatcctaaaccacacccaccacacacacaccacacaacccagctttcatataaatataatacaaaaccccacggtccatacacgtcccccttactctcccaaccacccacaacacacacgcccacaccatatccacccattcactaacaaaacaactcattattctatcatcccaacacatctgaacaaaaaatcaataacaaccgaatctagataccattactcgcttatacaataaatacaaaacacttcaacctagtacatatatccaca

SEQ ID NO: 539256 - DNA, 684 bp, Homo sapiens
ttggccctgtcggcacaaatgtttcaccagtcggcatatgtccaaagcagcagccccccccccattttggccagccttggtgccctcctggtcctggtaaggcccccagcaaaattcagggggtacctaaacggattttctgtcttttggtgcaattctgtatgggcatgaaatgcaacctgcagtctccctcccaagcaggattccattgatggcagccccaataggctttgtgcacttttcacgtttctcaactattctctgtgcttcttgtgacagctgtgtccttcatgaaaggtctgcaaagcggataacatgttgatatcagcacctgcaataaaacagcatggctttgatgagataaggacggcacttatgatttgatcactagcccagatgtcattcatagcttctgacaactctgaatgtagctctttactcagtgtatttacctttgaattgggagagttaattcgaacagctgccacatccccttagactccatagttaatatgggttgtggtcagcaaagcagaagaccatgtaaaattgcggcatatataacctcgggagcggaggatcctgaagtcagaaaagcggctgaggatgccaatcgccggccaggccaccatcttagcttgaaaaggccagcagtggagagggcctttaacgggtccgccggag

SEQ ID NO: 539257 - DNA, 104 bp, Homo sapiens
gagcgtacacgaaattgaggactctgtgctggccaaagacacctttaccactcctggaccaccctacgccctggcagtggttgatgtgacaaaacgacatgttg

SEQ ID NO: 539258 - DNA, 285 bp, Homo sapiens
acagcaagagttaggggccttagggcactgggctgtggttccattagaagccgacgtctggccctggcccgttacttgcttctctagcctctctagggcggctccagtttggcacctgtgcgcccacccttgccacatcatgcgtgtcactgctaggcaaacacttccactcgctccatccttcgcatgttgtcccccgactaactgcaagctactctccaaggtcctgttgcgtaataggagccatacgctagtagtgtccaataaacaacgagcatggaagca

SEQ ID NO: 539259 - DNA, 150 bp, Homo sapiens
acagaaacatcatccagttttatggagtaattctttaacctcccaactattgcattgtcacagaatattcttctcttggatcactctattattacattaacagtaacagaagttaggagatggatatttatcacattattaccctggccc

SEQ ID NO: 539260 - DNA, 222 bp, Homo sapiens
ctcgacgattcaatccttcttcaggaactggaccttttgagaataaggcaactttagagattgaccctcaggacagacagctctgttactcagagataccttgtatagctctctagaatatagaatatccatagtatagatattttggagctccccatgatcctatgtaggcataaggtgtaggtagcggatgcgaagccgtcgcaggttcaactgcaggct

SEQ ID NO: 539261 - DNA, 338 bp, Homo sapiens
  misc_feature (30)..(30): n is a, c, g, or t
  misc_feature (76)..(76): n is a, c, g, or t
  misc_feature (199)..(199): n is a, c, g, or t
  misc_feature (209)..(209): n is a, c, g, or t
gactaaactctcagagtagtactaaactcngaaaactaaaggaaagaaataataaagattacatttaagattaacngagaataggaaaacagaagaatgaatgacccccaagtgttggctcctgtggtaagctcaacaaaattgacaaatttttcgcgactggacaagaaaaagagagaagactcatcttcccaatttnagggagaaangtgatgacattactgttatcacagaattaagagggattatagacatatactatgaacaattttagtcacaacagattagataattgagatgaaatgtcaccagcccctagagtgattgtaatgaactgc

SEQ ID NO: 539262 - DNA, 457 bp, Homo sapiens
  misc_feature (2)..(2): n is a, c, g, or t
  misc_feature (7)..(7): n is a, c, g, or t
  misc_feature (30)..(30): n is a, c, g, or t
  misc_feature (85)..(85): n is a, c, g, or t
  misc_feature (139)..(139): n is a, c, g, or t
  misc_feature (148)..(148): n is a, c, g, or t
  misc_feature (153)..(153): n is a, c, g, or t
  misc_feature (157)..(157): n is a, c, g, or t
  misc_feature (442)..(442): n is a, c, g, or t
cntcgcnagggtcggggactgctggcggtngcaggccgggcgtgggcgagacacgaacgggctgcctgcgggtgagagcgtcgantgtcaccatgggtgatcacgcttggagcttcctaaaggacttcctggccggggngtcgcgctnccgtnttcnaagaccgcggtcacccccatcgagagggtcaaactgctgctgcaggtccagcatgccagcaaaacagatcagtgctgagaacagtacaaagggatcattgattgtgtggtgagaatccctaaggagcaagggcttcctctccttctggaggggtaacctggccaacgtgattccgttacttccccacccaaagctctcaacttcgccttcaaggacaagtacaagcagctcttcttagggggtgtggatcggcataagcagttctggcgctactttgctggtaanctggcgtccggtggg

SEQ ID NO: 539263 - DNA, 149 bp, Homo sapiens
tgaacgacgactccaggcggtgaggacaggcctgggtgggagaggggatattgaggggagctctctccccattcttctgcccctctccacctgtacccttatactgcgttgagaactagacgttccacacatggcactaaggtaactgc

SEQ ID NO: 539264 - DNA, 156 bp, Homo sapiens
gctcaaaggtagagggagtttattagttaaccaaatatcgttaagaggaatttactaatactgttaactaccaaagattatttatataaatataaggcttatattttaggtaacacttatctctaatatttttactacacagagaatatacactag

SEQ ID NO: 539265 - DNA, 525 bp, Homo sapiens
ggagagagagagaactagtctcgagttgttttcttttattcttttataaccctttccttataaccatgcctgtgtggggcttgacagtgagggtaataatgacttgtggctctgatcgctaaatatgggcctgttacattggtccattcacagtagtatttaatctgcacccaggcttatgcggccggacactgttatcacatgttacttatcctaaacataagtcctcctatcagggtgatagaatctggcccaatgggccgtgtcgccggagtacgcacgcaaaactagtcaggcgaaactattgtaacaaacgataggctgagggccagttaaagaatcactaagaacacccaccatgtaacgtatcccacagggagacggagcctagaactatataaaaggaccccatcctatactgcacgtgatacacacatttctaactacatcccctacatataccaagagctgccaagcccccataccgacacacccaaaaataggcagtgttcatccctattgcta

SEQ ID NO: 539266 - DNA, 403 bp, Homo sapiens
acacagcccctgaccctatgttggtgtaccccccaattggaccatccccaagggaattttgatttaagtccccagatatgagcaattgaattgtatcttcttgttaaaacactcagcataaaaggctgaaatgggcggatggtgggaaacttgctcagccacaaatgttacactgttcttagaaacccagggaaccggcccttctgaaacggagctctgcgttctcttcagtatcattcggcaacgtccagtgacactgaaagatctcacccaaaataggattgtacggctttttggccaccgatcctctccttcctgcatggaaggccgagaggtaccatttcacaacctgaaccattcgatccctgggatccttctgatcactaatgctcacgaacaggtc

SEQ ID NO: 539267 - DNA, 196 bp, Homo sapiens
gatccaatcacaacccttatcatgtgaaatctttagtgttgtgagcccttaaaagggacagaaattgtgcactcggggagatcggattttaaggcagtagcttgcgatgctcccaggtgaataagagcccttctacaactcggtgtctgagacggttagtctgtggcttgccttgctacaagctgagattgcatca

SEQ ID NO: 539268 - DNA, 287 bp, Homo sapiens
  misc_feature (16)..(16): n is a, c, g, or t
  misc_feature (113)..(113): n is a, c, g, or t
  misc_feature (115)..(115): n is a, c, g, or t
  misc_feature (123)..(123): n is a, c, g, or t
  misc_feature (129)..(129): n is a, c, g, or t
gccttgcatgcctcantcaagaaaacctatatttctctctcattggttgatcaaccaatatttggtattcttctatttgcggggcttttcctgctgatgccttgactgttttntntttttttnctgtcntggaggtgtttggatttccatgattttgttttctgttagaccactgcctgtgtctcgtcttgtttctctttttggaagcaagacccagataccaacacaacgatatggccggagaccatatggtgttggtctcctttttgctggttttgatgttatgg

SEQ ID NO: 539269 - DNA, 420 bp, Homo sapiens
  misc_feature (93)..(93): n is a, c, g, or t
  misc_feature (162)..(162): n is a, c, g, or t
  misc_feature (282)..(282): n is a, c, g, or t
  misc_feature (379)..(379): n is a, c, g, or t
  misc_feature (384)..(384): n is a, c, g, or t
  misc_feature (418)..(418): n is a, c, g, or t
cattgcccaagatttatttcctactttctttcccaacccaaagaatgtgaccgcccccacacatacacacccatggaatactatgcaggcatnaaaaaggatgagttcatgtcctttgtagggacatggatgaagctggaaaccatcattctcagcaaactntcgcaaggacaaaaaaccaaacgccgcgtgttctcactcataggtgggaattgaacaatgagaacacttggacacaggaaggggaacatcacacatagggcttgttgtggggtggggggnggggggagggatagcattaggagatatacctaatgtaaataatgagttaatgggtgcagcacaccaacatggcacatgtatacatatgttacaatanctctntgttgtgcacatgaccatagaacttaaagtatantt

SEQ ID NO: 539270 - DNA, 950 bp, Homo sapiens
gcgagtgctgtgtgtcgtcgccctgccgcgattaatctttggtccccagccggcttgttttgggcccgcttttttcacaactataggtccttgccgtccgaatatccgggtttccctcttcgccggggtgccaccgcccaaaagtgggtccaaagccgtctcctccctattagccgttcccctcttgtgttcgcgcttatacccattttcctattgcgtcctgtgcccggatgcgcgcttgctgagcaacggcgccccgcgacggtgcgttatgtctctcacccttctcccccctccggggaattttgagcgccttcttggatgatttcctgcgcgcgcactctatccttggctggtcttttgccgcgctcccatgccctagacgatcccttctcaataacccaggcgggggctccgattccgccccctcccgcggaaatcccatcggcgcccccccaatgggcctgggacccttccgggttctcccggctttgccgcggcgcctaattttctcacgtctcctacaaaacagttcgcccccccgtatggtcgtcgtacggaccccggcggacctgctgacctcccttgaccgtgtgcacccctctgggttgtacctccccgcgttgtgacgcgcccccccttctggatttattattaccatccccagactcgtctttgcacatcaagagacgtgtcccccacccatatggcgctttataaaccagatacccattctcccggacacttttaacacccaccacctttctacaccgctacaccgacccggtgtataataccgcgctcatgctctctgaaatctgtggacgcccaacccccacatgttcaacccccctggtccctagaatttattcccccttaaaatcctttgaaataagggcccccttttttccccttagcccccccctttcccccctttgaggttaaaaaaa

SEQ ID NO: 539271 - DNA, 133 bp, Homo sapiens
accaggtcactagattcacacgggctatgcttatggggccttttacgacgaccaaccgcgagcgcgggcaggtacacagattcacacgggctatgcttatccatgcttctacgacggtcaaccgtgagcacag

SEQ ID NO: 539272 - DNA, 406 bp, Homo sapiens
aacggggtctaggggtccctggctgggtggcagacccgaagccagcgctgggaagggctgtcggatgcccgggtcagaggaaggggcaggtccaaggacacgcgggtcgtggtccatgggcaatgaaccgctcgccctctccggtgcctgcttcagttcttccgtttgcagaacagacgggaccatggccccttcccgtctgtcaccccggggtgcttgaagtctagaccccatcactggtccaatgcgctcttgagtagcctccttatcccaggcatgcccgtcccgtcggccaatgccagacctatgacctgctcgcgctgacgacacttgctagactcgggcatggtgagctcgccagacaatatctcgcgtcaccatcccccggccttcctgcgtggagtcg

SEQ ID NO: 539273 - DNA, 752 bp, Homo sapiens
  misc_feature (551)..(551): n is a, c, g, or t
tcccgccccatgcgccgcgccgagagtgtctcgacgccccccaccgaggtagtccaaaagtctcgtataacacatgagagggtgcccaccccggaagagttgtaaatctcggtgcccccacaattcttgccccctggcccccccccaagattctggcccccccctggggtctctgttctcccccacaaaaaaagatttgtggtggaatgacacacttgccacaagagccacacccggggtgagactcgcgagaagggcccctctgagagcgagttatccccgtggagaagctcgaggcccccctttcacggactcacgagccacggccccacgcagttttgagagagtggtggccctctttctcgggcctctctcgcccctcgagttcactccctcaatggcccctctctcgcgggacctccccacgaggaccacggaatgagaacccacggaaaacccactttgaacacaccacgctgtggagaataatcacctctttgaatgagggattgtcaaccacttggctcgaccacagaatgcggccccgagtnccttatgcccgaggagaactctctggaacccttaaagagatcctggggactgccccgtcacatgggctgtaaatgttgatggcccccactcctcactgacatcactcgatgacatccaccacgtggtgctgtggaaatgcccacgccacgttaagccccaagggaaacatttccataaaggatcatttcaccactggtgga

SEQ ID NO: 539274 - DNA, 563 bp, Homo sapiens
cccggtagcgtattttaagagtaacagaaaatgtcttttttagagggggagggagccgctgggtaatctttgtgaacaaatcttctctctttggtgctgttcgccggctagagaaggaagtgggtgggatggagatggctcacgaagggatgatctggagtctggcttggcatcctcttgggcatattctctgctcaggctcaaatgaccatactagcaaattctggactcgaaaccgaccaggtgatcaaatgcgagatcgatataatctaaaccttttacctggaatgtctgaagatggagtagaatatgatgacctcgaacctaatagcctggcagtaattccaggaatgggaataccagaacaactaaaattagctatggaacaaggaaccgatggggaacgatgaatcaaatgaacttgaaatgacaattccaggtttagataggggaatggaggaagtgatgcaaaaggatcagaaaaaaagtactcagaagaaagtaccttatgcaaaacccattcctgctcagttccagcaggctaggctgcgaaacaaagttcc

SEQ ID NO: 539275 - DNA, 365 bp, Homo sapiens
  misc_feature (49)..(49): n is a, c, g, or t
  misc_feature (82)..(82): n is a, c, g, or t
  misc_feature (125)..(125): n is a, c, g, or t
  misc_feature (197)..(197): n is a, c, g, or t
  misc_feature (231)..(231): n is a, c, g, or t
  misc_feature (242)..(242): n is a, c, g, or t
tttgagttttatttatttaaatagtagttggatgcttggcacgttgttntgtaataggaaacctttgctttattagtttttntgatttataagtgtaatattttagttaatgctttgggagaagntgccatgtaaaggtggacaccattttccagctttaggggatatgtttgtcccgggcaccggtggaaggaagntggctttttggattaaggcagcttggggggacantgcagtttggntacacacagagatttggcaccccttgggtggagtgtcccttgggggttttgggaaagcatggcaccctcagaccacacagtagccaagttttggagcaaataaaaggcctgtgttatttttta

SEQ ID NO: 539276 - DNA, 875 bp, Homo sapiens
tggtggcggcacatcacggaacgggacgtacgaccgacgcgggatggctttaactcactggatacggcgaatatttacgtggatatcgataataacagggataagcgtttccaccgggatgcttgggtctataacggaggcgtacaacatcgggatgtaacaatcgcgcggtccccccgtcaccgcctttcttgtcgcaaaatatgaccaccaaatccgtatacatacgtgtgcgacatggaaccatagtccatagaatccccgctcattgtttaactcggtgaactttcgttctactccccgagagaacgtcaatggctcctcgtctcgcttgggacactgctctcagcacgacttcttcagtgtggtctttgacccccctcgtgcactctcgaggcgtcatttcaggtgggccaatgtgaaccactcgctagtaaatactcaagttgagagttgtcaatctgaagttgtaaatggtgaaagggtccttgtatcgcctcaactgccggacccccacaagaagccacgtcttcggatcgaatgctcttgcgttgcccgcttagttagtggctcagctagtggctgtcacgctggtcgtcgtaactcaaagtgcgtacagcaggacccagcatagctcgtgggagtaacatgaagacgggccagagaagaggaatgaagcatgcgagtggacatcctgctaaagaccagccttcaccccctagctccagcctcagtcggggccctagacgatgttttctcgttatacaagaaccaggtccgagtgtggcctcctcattccttccggaagccaaactgctccgttattttttagagctgctgattgattaatccggagggggggctacatgcaggaa

SEQ ID NO: 539277 - DNA, 329 bp, Homo sapiens
gtgccctaatccagtctgattagtgggcttgtaaaatgtgaaaatttaggcggtgcacggtggctcgcgcctgtggtcccggcactttgtgaggccaaggtgggcagatcacaaggtcgggagttcgagaccagcctggccagcgtggtggaaccccgtctctgctgaaaatgcaaaggttggccgggtgtggtggtgtgtgcctgtggtcccagctgctcgggaggttcaggcaggagaattgcttgcgcctggagggtgggggttgcagtgggctgacattatgccactgctctctagcctgggcaacaagagtgaaactccgtctc

SEQ ID NO: 539278 - DNA, 284 bp, Homo sapiens
acccgtggccagagcatagctggctcatgtcctgtaatccaatcactttggcgggtccaaggcatgagactcaattgcaacctgggacgtagaggttgcagtgagccaatgattgcgccattgcactccagcctgagcaataagaggaaaactctgtctcaaacaaaacaaaacaacaaaacctcctatggtggcaaaggaaacaagcagggccaatgcccagtggagctttagtgtcctaatgtaagagatagctacaccaacatttgtttttagcaactata

SEQ ID NO: 539279 - DNA, 514 bp, Homo sapiens
  misc_feature (125)..(125): n is a, c, g, or t
gccataatggacggggattctgggaatgaggagttttgacgggctctttaaggacccttgaactgcccgggggtgtcagggggaaggaaggagagaaattgcggacctgcccatggccactaatnaaaaccctattaacaggcggtggggaaaaaacacacaattcctgctgacttcccttatggatctcaggttggctccttttaatgaactttaatgggaaagagagtacccctccacagaaaggctggaattcttgaattctttacctttccataactatattgaattctttttttaaaaaaataaaaacccaaattccgcctcactttgtttctaaaaaatgttcacaacaaaaacacgtttgggctggttttaaattcttgaaaaattcaaaagcctttcaaaaagttaacggggctaaaagctgggaacccgttgggagtccacaagggctgcataaaccgggttgccaaagaaaattggaaaaaaacccccaaaacaactttttaaa

SEQ ID NO: 539280 - DNA, 1515 bp, Homo sapiens
tcgacccatgcgtcgcggagacattgggattctcgatgggggccaaggagcccccctggtttagcagtattttaatccactcatagtatgttggaacgagagaacaggagacaaagtatctcatgtccgataactagttattccgtcatccccatccgcttcatagctataccacgtgtgtcccagctgacatgctggcccagatcttcgcagtcatccgagtacacacgtcgagctgcctactgaccaaccgccaacaatcggtggcaggtggactgctccagactggatctggagcgttgagaccagggccccatagtgtgccacgcaccttggtgtgcccccattgcctcgtgccaccgtctgcctcgccttgagcctcatcgatgtgcacccaaagcggggccgttcaaggtagctggcttcgtggctgggcgatgggcgctggcacagggcacccgcaggggaaacgcatggcaatggctgcaacaacacagaccgagaaaaccaccaacgcccggagccccatgagcgaagcacaccaaaaccgggacccagcgcgcgagaggccaatccagcacagcccaagaggaaccacctgcaccgagcatcccaacacacagccaagcccaagtagataagcccaatacaacacaggggagcacaaaacatacaccccacaaaacagagaacgaaggacggagcatacagccatatggcagaccaacacaaatcgcccacaaaaggagcgccaaaacaacaacacgccgcagaacaacacaacagcacaatcacccacttgagcccaaataggagagcacaacccaaacaaagcaccaccacacagggaaacacgagacaagcaaccccaacgaaaaaacgccatgaactggacgaacgcattgcaacacaccaacggaggaagcgccgcgaacaaacagcataccgcaccgactgcgaacaagcaaccgcaaccgaaccagacaagagcccacctagctcaacaaaccccgtggaccgtgaggacacccacaccacgcacgtcgacaaccacgtagactctcacggaccaggcatcaaaaccacagagcgtagacccacgaaggcgaacagaggacagaaatggacaacacacgggaagagaacacaacaaatctaaccgaaagggaaaagaccagaaacgcaacctaaggctacgagaaacaacgacacagaaccagaaagcgacacacaccacacaaaccagcaacaacacgacaaacaacgacaccacgaatgacacatcacaataccgccaagaccagcccacacatgaggaacaaacagccaatcgaaccgcgacgcaaccgaacgccacaagcgcacacgcaaacacacagaacaaacgaaacaacaccaaggcatcgagaagcggacgaccgaccacccgcgacacatgacacatccacataagagagaccatagagcacagaccgccatcacgaaaaccccacccaagcaaacagctgaaccacc

SEQ ID NO: 539281 - DNA, 962 bp, Homo sapiens
  misc_feature (549)..(549): n is a, c, g, or t
gaatcacaaggtataatactatgtcacaaggacgtcagaatgagtttaaggagatgtctcagaatcaccagtcaaagcattgaggagattactaaagacgttcaacagcgagctcagaactcaagttaacgagaatcaggtatgtcccctaggtcgagcacaatcattgttcaccagaccgtcaggggaagctgattatctcttgaacatgtacagagtgaggctgaggaccacatcactttggccatctgaggagggccactggcacagagagatactcaacggacgttaaatgcaagatctcactgggtctccagttggcctctaagcaagcaatctaaatggaagttgcaatgccatctgctgggaaggtagaggaaaccctatggagcctcacggacactcctcattggggtatctcaaatgagttcttcaaaaaaacgctacttagatggtgaccatggctgatactacctatggtaaaacataagtcgcggtcctaccatacagtcacaggggatgcgccgatattagtctcgaaacgacagncaaatctattgggcactaattgtccctcttgaatgctcaggaacgttggaccacatccgcgcgtacatcgagagtgtcctaccttggtgcgagcacaaaaatcgcgtgtaaccaggaaccagtatgaggagaattccaggtcactccctccacaaggcatggaaatcgtcacacccgcgttcacactgaatgttatggtgtagaaacaatgtcgaaacaaggacatggggtccttgtcaattacgtacaagacgcgcgttggatacacacccatcagaagaacggagttccggcccggtgtatcccatggtcctatttattgtccgcaaattagtttaccacatgtaaccccagtaagttctggtaccaattacttgttggggaaactccttgcgatgaacggcacacaatgg

SEQ ID NO: 539282 - DNA, 153 bp, Homo sapiens
agatgtctgcctacgcaggcttgtcggacatacttctggtgggcactgtgcggaaacttgaggatgaaatcagtgagtctgcatgcatcttgaaacggcatggcctgtctcctcacttcagtgcaatgtccactcgaccaaagccctattctg

SEQ ID NO: 539283 - DNA, 192 bp, Homo sapiens
agtgtgaaaggaaggggatcaggaagtgatatgggaagggaaatatctgtgggagggctgcccctctctctcacaattatggcgtaaatgattaggagcttctgcagacacatgcatgcccctaatctctgcatccagggaagcagaaactggcttatattcttttccactcccatcttcttggggatcctc

SEQ ID NO: 539284 - DNA, 986 bp, Homo sapiens
gaaaacaccccgtgcattcgtctctatgctccccggcctgcagccttagctaggggcactcttggccttgtgcttgtagaacctatgaccttattgcattcactgtctctaagcctctgatatcattgaggttgcatgctcatgattgcacaggcccggtaggagaaccaccgcaagcagatggagcgttgctatgctagtgagacaacaatgatgaccgaaggaaagcgtgaacatgggcgagagaagagaagatagacaccattacttgaaccggtgtagaaggaggagtctggattggacgtatggtcgtgagagacacgatctacggaaacactgcgtatgaccagctcacgccggatccttggaggaatctcgtatgccgttagccgctctgtaagcgttggaggcgaaggcatgcggacctgcgttcccacgtcccatggttgatggagctgtcctcatcggaagtccggttctattgagagcttgaaagtaccgccacatggaaggtctttgcttgttagccctcgccagggcaacgtattacaacgacgtctaggtgaatcagatcggctttgagattaccttgtgccatcaagcctttgacccaagcatccgaaatcctccaagatttggatgatgggtcgccgaatcccgataggaaaggacgaagtggaggccttgtcgttaatgtggcctcctgtcagtggcacccaacttcggatcatccgaagcagctcgagactagactagtgcttgagctggacttattgagccgaattgttgttctcgtgcaactggtttcgctgagaattgggatggatccctgagttgtggaccgggccaaattcccaaagcaaacttgttgccctgactccgtgtccatttcctctggcaatatcgcctgttatgcggtgaaagcctttcttgaacgttttgtgcaaattaccagggggtttggccatccccattgggatttgctg

SEQ ID NO: 539285 - DNA, 127 bp, Homo sapiens
tagactctagagcacccctagcgtctctaatatataggtaaagctctaagactcctgagccaactttatatgtaactaggctatacctaggctggggcttgaactactgtacatgaagccaaggagt

SEQ ID NO: 539286 - DNA, 381 bp, Homo sapiens
ttcctcacacaccgcagcaaagagaagactgaaagacaaacctgggtgcagccagagaggtccagatagatgagcttgtggcatccattccccaagttcagcctaaggactccacataccccagctgggtctcattgttccaaaactgcattaattaagattacccagacttgaatttcaaaggaatactttcattgttccatctgtaacacaaagtaattagagccagctaaatgtcaagatacatataattaccattataatcttactctacttttacaaagcaactaacctacacaaagcaagcccaggcagtataagaagccgagtaaatcataaccaaacaagtagagacccagagaaactccaacccgatcaaac

SEQ ID NO: 539287 - DNA, 455 bp, Homo sapiens
agttgattaacatgcacaaaacatcatttaaaaatactaatttgggagtggtatcaagaatagacagaagtaggctaggtgaggtggctcacatctgtaatcccagcatttttagaaggccaaggcaggatcgcttgagactaggagttcaggaccagcttgggcaatatagagagaccgtgtctcttaaaaaaataaaaattaaaaaaaggccaggtgtggtggcacacacctgtagtcctggaactttgggagtctgaggcaggaggatcacttgagcccaggaattcaagaccagcttgggcaacacagggagaccccatctctacaaaaaataaaaaaattagcccaggcatgatggctcacacctgtaatcccagcactttggaatactgaggtgggtggatcacttgaagtcaggagtttgagactggcttggcccaaatggcaaaacc

SEQ ID NO: 539288 - DNA, 959 bp, Homo sapiens
  misc_feature (294)..(295): n is a, c, g, or t
  misc_feature (313)..(314): n is a, c, g, or t
gcttccttcgggactccggatcgactctggagctccgggaatttccctggtcccggccgctccgggctttccagtctcaaccatgcataaaagagggttcggcgatcgttggtggagccactactagcccgggtcgcgagggcacgcgtcccctgacaactctcccgcttctcgcacagcttcccgacgcgtcatgctgagccccagtggccctagcgccagcgctcgtctcggcgccccgcagcgagagtccccaggcgtccttgacggcgctgtgcgcgtgtgctggcgtgnncctggcgtccgtcggtgnngtgccggcggcagagcgcagggctgcaagcgacagcacaggaaggcagatccggataggatcagcgtgaaatctagcgctcgcgcagtagctttgaacgaacaccttgcgatgggcaatttgcactcgtcaagacatcgatccaaaggttgttgaaatcgtaacggtacccgcctggagccccattttgccgcccaatatcggaacgctcaatagtccacagctcaaggaatgggaagaaacgcttgtcgtcaatccccgcagtcccccagtggttcagaaatatctagtcgaaataggatactgaatcgaactgggatgcacacaagtgaacaggatgagaagtagagaacgctctatcagcgtactcacttgacagcttcctgcacgggtggtccctgaccttaccagagctgaacattgaaaaacgcagaacagcagcttctctagggagcagctgtgagaaggacttacatgtgtttggactatttcttaccgaggagttctactaatgtatgtactttagttacggaaacgcgttgtagtatttaactatcttgaacatgctgttatctcagattgtgaactgtccgtacctcgaaacgtggctcagaaccctgattgcattaacctcgtgagtatcctg

SEQ ID NO: 539289 - DNA, 204 bp, Homo sapiens
tttgcaggcaggacactgcacttggtgaggtggcgcgtgtccagtttctggaggctggacagtgcgaggcgggagacccctaggaagccatctttgctcttggtcatggtctccgggagcagaggctgaatcgggcttctattggtgagcgtctcctcgcttatggtcacggcggcaatctccttccttcctctgtagcttggc

SEQ ID NO: 539290 - DNA, 167 bp, Homo sapiens
taaacttttcccccaaattccagcaaaaggcccttatcccccctttttataaaaacatttgtttctttaaccccgcctagggtttttgtaggcccagctttttaaaaacccccggaaccctttttatggggcccccggaaaaatgttttttaatatgttatccggga

SEQ ID NO: 539291 - DNA, 236 bp, Homo sapiens
ctggagcttattcttaacataagggttttcattaaatgttgctgaccatagctaggatcagagcatttctggacagccattattctgatactaagaatctaccttcttcccacccctccccaccccaatggaatcatggtgctagctggcccaagccaggtatgttttaagaggccaagggggaagaactgcttgagcctgcaagttcaagaccagcctggacaacatagcaagac

SEQ ID NO: 539292 - DNA, 227 bp, Homo sapiens
atgggggctccagagccttagcatgagcctgctgaagcctggataggaagctagggattttctcttcaatacgcagtaagttatcttgcccctgtggttgccttatctgtagctatggggcaaagacaataatgagagctttctcgagcggaggttgcagtgacgctagagattgagccattggcactcctagctctgggcacacaatgaacaaagacaccggtctc

SEQ ID NO: 539293 - DNA, 856 bp, Homo sapiens
gaggaatcagagatcattgatttcttcctgtggtggcctctctcaaggatgaggttctgaagattatgccattgtgcagaagcatacccgtgccggctcagcgcaccaggttcaaggcgattttgttgctatcgcgggactacaatggccacgatcggtctggagtgttcaggtgctccaagggaggtggccactcgctggatcctgtggggccactcatgctggccttaagctctccgatcgtccccgtgctggcagagtgctactggcgtggaacaggatcggttaagctcccaacactgttccttggaaggtgacaggaacgctgcgggtctgtgctggtacgcgctcatccctgcgcccaggggctgctggcactcgtctccgtgcgctgtgcctgagcaagctgctcatgattggctggatatctgatgaggtgctacacctcagtgccgtgggctgtactggcacgcatgggcagattcgtcaaggccaaggctttgatgccctttcgtaagacctacagcttacctgtacccccgcagctctggaaggagactagtagttcacagagtttccctatcgatggagttcactgaccaccgtcgtcaagaccacacacatgagttctccgtgcagctggacgtcaggctccagctgtgggtacagacatagggtttttattccggaagaattcctgtggactaaggcgtgttaaggaaaaaaaagatacctttttcggggggaaactattatccgggggcggcgaaagagttctggaaggggcaggtctaggtgccggagccgccttgtgtgacagggaattcggcccctatgaggcatttataaaccgttc

SEQ ID NO: 539294 - DNA, 409 bp, Homo sapiens
atgcttgtggtcgtctctgacggtcccccgagaccccatacagagtatctgcattgccttttctttgctatcttgccagcatctgttactttttgactttctgtattatatccattctgactggtgtgagacctatcttttaaagtggtagggaatgttagtgggagaatgaccccgtagggtaagctcatgtgctcagattataatacctcacctgttcacatagaggtttaaagcaaggtctgccaaactatcaagggaggctttgagcagttgtgaagtttgtgtgactctgaggtgactagaactagtagaataaatataataaaaccctgaaccttcacacatatattgagtaatatctcaagtcattctatttatgtactctgtatgggggatctcggggtac

SEQ ID NO: 539295 - DNA, 137 bp, Homo sapiens
ctcaaggatccgtctacgagtctgaccagctcggtacgcttatgggacagccaccttggactgtacagccaggatgatgagcgacatcgagtgccacacactcgtcgatgtgactcttgtgagtgatagcctgtatc

SEQ ID NO: 539296 - DNA, 382 bp, Homo sapiens
ttacacatgcagcattttccttataaaaaaggcaaacaagagtgacaactcatgctccaaatattaaaaaatatatttaaacagtatgatcaagaagatttgggccgtgagtggtagctcacatctgtaaccccaggattttgggaggctgaggtgagtggatcacgaggtcaggagatcgagaccatcctggctaacatggtgaaaccccaactctactaaaaatacaaacattagccaggcgtggtggcaaacacttgtagtcccagctactcgggaggctgaggcaggagaatggtgtgaacctgggatggggagcttgtagtgagccgagatcgcgccactgcactccaacctgggtgacagagcgagactccatctc

SEQ ID NO: 539297 - DNA, 433 bp, Homo sapiens
acagcttgctgatgcctgtctcgaattccatagacaaatatatctgtcaccatcttcctgttccttcttgctcaaattcccaaacattgctaaaggcaagttctcttcgggctgcagttgggcaggagctgttagaagtacataagtccggcagcactcatggaatctcgcttctggtgctgtgcctcaggcccaagcagaaggttgaaatgagtggccaaaggtcttcgcaggaaagtcttattgggtgggatgttcaataactgagccattgtttctacgttaaaacgaggctctagaaccatgagcccaccatggacaccactgcctctgagattgggcgcatattctgccaagtccacggagcgcagccactccatcactcgatggttagtccacttctgaacttctgatgggacgatggtattctcat

SEQ ID NO: 539298 - DNA, 1029 bp, Homo sapiens
  misc_feature (597)..(597): n is a, c, g, or t
  misc_feature (723)..(724): n is a, c, g, or t
  misc_feature (753)..(753): n is a, c, g, or t
  misc_feature (783)..(783): n is a, c, g, or t
  misc_feature (827)..(827): n is a, c, g, or t
  misc_feature (1029)..(1029): n is a, c, g, or t
gcataggggtccatacggcgatcgtactcggattcccgatcgataacttacagcgggaaactttcacatatgtccggtagcccttgaatgtcctgcaaattgaagggtaggaggagtgtcgctgtaacgcttccattgacttgccgaggacagcccaccgttagggctggcacccaagtcttgaacttccacgtatggtaacgagtgaccattctatagaagaaggatagaagttgatggcgatctagtattcatacaactctctacaggaggaccgtgggacgaaggcttcatgctgagcagtcttctgtggcagattagttgcgcaccttggaaaagcaccgtgctgtgatgctcaggttgttgatattactctccaagagaatttactaggcgcagaaggagctagtgcctgaaggttttgcatgcttgccatctcggatgccacgtcccaattctgctgggccggcttacagctacctgagatacccttcagctaagcctagtataccatgcgcgcagtgccttcctgggagagccagcgtgcctttcttgctggctgtagcttgagcccgcaaggggcttgagccagccagncgctcgtcagcggcagagacgatcttatcgttgaaccttaccatagccagttgccgcgtgtggtatacacacgagttcatccgtcgtgtctgcctagttgttggagcagttagcgcagtccgcganntgcaactagacatagcggaagcgtcagcntcgcagtaggggctttcagatcgctaggtngcgactcgcatcgcgctccaggcggacagtatcgtggctgacantagcagattgtgcagcgcaagtttcacccgctgaagacatccacattgggcacgtgtcagtgcccctgagtctgatacgtgtcgtacgagaagaatcctggaacgagagttgacaaccctgaagaagcatggctggctgcttggagaagcgcaagtggaccaacggaggacatttcaggggtggaaatggacttggtcccgn

SEQ ID NO: 539299 - DNA, 85 bp, Homo sapiens
gtgggcggacgcgtgggctttcctcagacccctttttgccgtgcaaagggaattcttgacattaaataaaaggtatccagattgc

SEQ ID NO: 539300 - DNA, 212 bp, Homo sapiens
gaggatcccgcaccaggcgcacttctggaggagcgcataagatcacagtatcatggtcctgaagtgcaggacgtagcgagaggatctttaaagcgagaggagtttgtcaaatactgctgagaaccagaagcatgagtacggtgggaaactgcccactgaatgacagcagcagagcactcagcaggcaccttggcagaagtgcgcctggtgtg

SEQ ID NO: 539301 - DNA, 679 bp, Homo sapiens
  misc_feature (37)..(37): n is a, c, g, or t
  misc_feature (48)..(48): n is a, c, g, or t
  misc_feature (74)..(74): n is a, c, g, or t
  misc_feature (140)..(146): n is a, c, g, or t
  misc_feature (149)..(149): n is a, c, g, or t
  misc_feature (163)..(163): n is a, c, g, or t
  misc_feature (171)..(172): n is a, c, g, or t
  misc_feature (226)..(226): n is a, c, g, or t
  misc_feature (228)..(228): n is a, c, g, or t
  misc_feature (324)..(324): n is a, c, g, or t
  misc_feature (387)..(387): n is a, c, g, or t
  misc_feature (402)..(402): n is a, c, g, or t
  misc_feature (459)..(459): n is a, c, g, or t
  misc_feature (497)..(497): n is a, c, g, or t
  misc_feature (532)..(532): n is a, c, g, or t
  misc_feature (544)..(544): n is a, c, g, or t
  misc_feature (548)..(548): n is a, c, g, or t
  misc_feature (570)..(571): n is a, c, g, or t
  misc_feature (576)..(576): n is a, c, g, or t
  misc_feature (581)..(581): n is a, c, g, or t
  misc_feature (598)..(598): n is a, c, g, or t
  misc_feature (607)..(607): n is a, c, g, or t
gggagagagcatcttgggggcgcaattccaagagcancgagggcagangttagagatggctgagagcccctaanctgaggcggcaccacaataggcagcaacaactgtgtgaaagctggatgaactggtcagtagcggannnnnnntgntggcacaaggttgntctctttnngaggggtcaaaccttggcttggatgagctcatgagaatacccagtgttcccaantngaggggggcagagcccaaagcccctttctctgcaggcctccttaaggagaaaaaggcactcagagaaaaaggcattcagggaaccccctggaaagntgtgccagaattagtccttaaggcacagctgaggcggacaaggcaccaaggcacaactggtgntgggagggcaggggnagcctccaagccaagtgccagggtcacaagaggatgcaggaccgcccacgcttgatnggcgtggggttgagcacagcccggacagcctcggcgancacttccttgacaccatcctgttgcagggctgagnattcgaggtagngcanaggtggatctgcttggccagtnnctggncctgntgcggtgtgatgggcgnctggccctnctccttgaggccgccgtaggtgtcaggctgggctctcaggtccttcttggtgcccaccagcaggatgggcac

SEQ ID NO: 539302 - DNA, 300 bp, Homo sapiens
aaagataaagcacgtgagatacacgctatgagcggtatatgagcgaccgtccccctgttctgatcaccaacgttggtcactctcttagtttgctaactagactgatccctcgctctgtgtgcagtatttgtgtcctgtcttggtcattacttttttctgtgttaaaactccatcacacctcacggctaccaaggttctggcttaagggattagaaatttggggcactttcccaatactaaaggactctccaaaagtccccattttgatgcctgtgcctattccagctgcggcggattcgg

SEQ ID NO: 539303 - DNA, 338 bp, Homo sapiens
ccgctttgtagcccctcctcatgctcttggaggcatagtatagtaacgagatactatgctgtgtctgtgatagcataaagttcgtcagacctccatggtccctcgtgatcccaaacgagtcacttcttaaattcacactttggcacttaacttcagtgtggatgacagaacgagaccctggcttaaaaaaaaaaaaaaaaaaagaaagccacacttaatcttttcagaaacctggtatagcacaggctggactttagggacttaaaatatgcactataattttgcgggccttatcactggtatttttggagtgattcagtatagggtcgttttcattg

SEQ ID NO: 539304 - DNA, 333 bp, Homo sapiens
ctagtgttgccgttcatgattcaagtatatcacgactgatatgttctcttttcggattcatataccaaacgaaaaaactgaagttataagggaggcaactatgtgctcagacagtctgtcaatgagccatctttttttctctccgttttctttaatccttttacaagctgtattgattacaaagttgaaaaagaaaaggaaaaggtcaagttagtgcggctgctgtcccaaaaaaggtcacgaggtcagagttgccagttctaatttcagattgaatccgaacctcctcccagaagtgtcaccaggtcgtcccggcagagtgttgcccatcct

SEQ ID NO: 539305 - DNA, 947 bp, Homo sapiens
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttg

SEQ ID NO: 539306 - DNA, 826 bp, Homo sapiens
aactaggctaaggtacgaggccgcggtgaatcggccgaggagtggggtccctgtctccagctgctcctggggagtagaagcaataatgtatttctaatttgtgggtcccacttcggctatgcgggtttctagggggtgggggcttgggaccaaagccttgccccgcccctatgccccttgggggtttggctgtgtaagggggtgaaggactgcccctccctttcgagacccctccttcctggtttctgttcctttttcctggcagtgaattatgcaaagggggccggcaaaggaagggtaggtgggggaaagccaggtggaagcttgaaagactgggggactgggcctgtaaggaaggagccatcccagtccccctccgccctgctcccggcgctgagtcatggggtcgtggagaagggggcggggtggcctgattggctcgcctgcccctgggggcagtagagggggcagtagagggggcagtagaggggccccgcccagctaggggagccgctccgttccactcccctccctagccctccctccccacgggcctgggcagggaatgtcttgttcccgcgtccctccccggggcagagggcagggctgggccgggcggcgtcctaccctcttctcctcctccccatctcctccccgccaggtgcgagccggagccgcgccaccgtgcgcccctgactcacgccgcccgggctggcgcacgaagggtgtgggacagggtaaggggttggagagcttgttggaaacgggagcgggcctttggggctgttgagtgggacccccccggcaggaggggggttacctttac

SEQ ID NO: 539307 - DNA, 991 bp, Homo sapiens
  misc_feature (952)..(952): n is a, c, g, or t
  misc_feature (961)..(961): n is a, c, g, or t
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttgaaaanccaaacacnttcccacctcccattttaccccctttactt

SEQ ID NO: 539308 - DNA, 171 bp, Homo sapiens
gaggatcccttcgattggcgggcacttagaggtggggagcagagaattctcttatccacatcacatcttggtcagatttgaactcttctatctcttgcactcaagcttgttaagatagttaagcgtgcataagtgcccgcctatcgaagggatcctctagagcgccgcgca

SEQ ID NO: 539309 - DNA, 177 bp, Homo sapiens
cttcatttagtttctaacggcatgacttgcaatggtcaatcagttagtttgagtcaatttcagctctttgtgccgtcgtgactacccaatacaaccactctcaaagcaggcaaccatgcacatgttcccagagcaccctgcacacagtttgtaagagtcaaggttggctacacagaa

SEQ ID NO: 539310 - DNA, 634 bp, Homo sapiens
agtattaccattatttaggagatttcacaggcctggcctttgacggtccttgacctggaaaaccccttccgctagattgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttg

SEQ ID NO: 539311 - DNA, 1052 bp, Homo sapiens
gtagacgagtggggacatcctggcttcggagcgggagtgttcgttgatgccagcgagctaaaaagagaaattgaacagtagtgggtgatgttgagtaaaggcatagaagattttcattgatgtaacggttcgtctcccgagtgcctcaccgtatgtaatacatgggaggcatatgcactaagactgggcgatatttccatggtctctttgaggacggaagaaggggtcagcgcccctggcataactctttatcacagccgggcaactaaggaatcagaagtgccactgcatcctggtggcagaagcgtactagcacttgaatgagtacgttatttgtggagaaattacccaggaaagataataatttccgcggtgggaagcaacacacacgtgaattacttatgtccggggatttacgagtaacgtaaagggaatgcagaaagtggttcatgacgttatgaaggtacggcattaagttcttgcaggaataataagacgtaacatatatggaggatagaatacgtgttgggggcaacttgcacttgtagttatactgtagcagacaagaggagggataagatgatgctcattggacattggggaatgagtgggtggtagctcaaatcaccttataacaggtaagcaattcatctcaattacgaacaccagtggacaattttgcaaaattccgatggacagttgaatcttgaggcgagcaactaatttgcgacgggtagcggggccaagacacccctggaattattaagagaaagttaacaggaacgctgggagcctgatggttgggggttcacagcatatgaaaactacatatggctatccagagcattcatagtgtgcagaacttcttaggcgcttagttaaacttgctacgaatttcatcagagtcaagagattgggtgtcaatacagcacttgattagtcagaccccgccattgtgtaacagcggacctcctttcacagttgcacaggaaaccatttccggatgagtgtaacatgggtgaccaacctatacgagccgcacagagggactg

SEQ ID NO: 539312 - DNA, 1053 bp, Homo sapiens
  misc_feature (575)..(575): n is a, c, g, or t
  misc_feature (619)..(620): n is a, c, g, or t
  misc_feature (1014)..(1014): n is a, c, g, or t
  misc_feature (1023)..(1023): n is a, c, g, or t
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaattctgcttgcttgctttttaatattgatatgcttatacacttacactttatgcacaaaatgtagggttataataatgttaacatgacaggggaaatttttcccccttttttttcccccctttcttttntaaattaaaaaattttttcccctttcaaaccccccttttctttnntgaagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttgaaaanccaaacacnttcccacctcccattttaccccctttactt

SEQ ID NO: 539313 - DNA, 507 bp, Homo sapiens
  misc_feature (28)..(29): n is a, c, g, or t
  misc_feature (50)..(50): n is a, c, g, or t
agagagctagcaccagggagactattannatgactaagagtttggtttgnagtatgctccttacccaggatccacataaaccaaacctcctaaaatcaaatagatacaagaatgagctcgataagagtctattcccttaactaggcagtttcttcattaatcagctacacctgaatctctataatacccgatgtttcctccataggccataagtgccagcagctgcacagatacttctctattcagccaattctatcataactttcacaagagaatttaaagtcttttgtgtaactgtagcctttatggtggaatttgctatagaacctatcatgagggatacatttctccttttacattgcttcttttactccaaacaatgggaaaaaggacctaacaaatgatgcctttctagaagagtgaaggccttctgacaatggttctctttaacctggtgatgtgggtgaagaagagtgaaccaatggtctgtttccaactgattacgag

SEQ ID NO: 539314 - DNA, 402 bp, Homo sapiens
  misc_feature (15)..(15): n is a, c, g, or t
  misc_feature (79)..(80): n is a, c, g, or t
tcaacttcttcctgnccccattcccattctctctccacccggagtggagagagaaaggaaagaatctgagcaacacttnngagacagaattaacaggatagagtgactggctggatgtgatggtgacagagggttttctggtgtggaggattcgatgctaccactaattgaggcaggacctccagcagagggggtgcagggcggaggagctgcagggaggaggtaacgagccagggtttattctttcctatacgccatcaggcagggaggggaataagggactagctaaaactgtaactgggggcaaagaactacaaatattgttagagagatgaatacaaggaaaagcttccttccttccttccttccttccttccttccttccctccttctctctccact

SEQ ID NO: 539315 - DNA, 900 bp, Homo sapiens
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttatggtgtatgtaccattcagatgtagtagattcatatctacttgatattcattacatgtagtcaggtcacaagtcaggt

SEQ ID NO: 539316 - DNA, 352 bp, Homo sapiens
gctcgacacttcagaatacctaaaatctctctgaaacgaagacactctggccacttaaagtatctaatattgctcacgcctgtaatcccagcactttgggaggccaaggcggcagatcaccaggtcgagggactgagacaatcatggctaacacagtgaaaacccatctctcctaaaaatacaacaattagccaggcatggtggtgcacacctgtaatcccagctactcgggaggctgaggcaggagaatcacttgaacccgggagcggagattgcagtgagccgagatcgcaccactgcactccagcctggagacaaagcaagactttgtctcaaaaaaaaaaagtcgacg

SEQ ID NO: 539317 - DNA, 968 bp, Homo sapiens
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaattctgcttgcttgctttttaatattgatatgcttatacacttacactttatgcacaaaatgtagggttataataatgttaacatggacatgatcttctttataattctactttgagtgctgtctccatgtttgatgtatctgagcaggttgctccacaggtagctctaggagggctggcaacttagaggtggggagcagagaattctcttatccaacatcaacatcttggtcagatttgaactcttcaatctcttgcactcaaagcttgttaagatagttaagcgtgcataagttaacttccaatttacatactctgcttagaatttacatactctgcttacgaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttg

SEQ ID NO: 539318 - DNA, 909 bp, Homo sapiens
  misc_feature (330)..(330): n is a, c, g, or t
gacgaccagcaatgtactatgtgactatcattgatgccccatgacacaaagactttatcaaaaacatgattacaggaacatctcaggctgactgtgctgtcctgtattgttgctgcatggtgttggtgaatatgaagctggtatctcctagaatgggcagacctcgagtagcatgcccttctgcggcttacgacaacttgggctgtggaagctaacctaattgtcgtctgttgaactaaaaagtggattccgactgagccaactccttacagcccagaagagcattatgaggaagattgcttacgtgaagtctagctcacattacattcnagtaataattgtgcgtacaaccccgactacagatagcatggtgtgccaggttatcctcgagcttaagagaattgggtgacgacatcggactaggacgccaaggtgcctaacagtgtcattgagttcaagggactggaaaggtcatcgcccgataaggatcgtcaattgccagtgcgatatccaacgtcattgtttatgaagtctctggtacttgttaatcctaccatccaatgtcgtccgaaactgacaagtccgccttggcgtccttgtcgcgtcttccaaggtattgtactactaagaatctagggtcgcgtaactcgggttacttgttgtccttgttgtggccgagtgttgagacctgggtgtgtcttcgagaaaccccgggtatgggtggggtccacactttaggctctcaagtgctaaccgtgtaagcaacggaaagttaataatcctcgtccgacaatagcgttcgcatggaaatgcttctgaagtgaagtcgtcttgccctgcggaacgaatgttggcgcttacaatgtcaaccactgtgttcttgttcaaggatgtcccgttccgtggcaa

SEQ ID NO: 539319 - DNA, 971 bp, Homo sapiens
  misc_feature (449)..(449): n is a, c, g, or t
  misc_feature (463)..(464): n is a, c, g, or t
  misc_feature (468)..(468): n is a, c, g, or t
  misc_feature (484)..(484): n is a, c, g, or t
  misc_feature (504)..(505): n is a, c, g, or t
  misc_feature (511)..(511): n is a, c, g, or t
  misc_feature (514)..(514): n is a, c, g, or t
  misc_feature (522)..(522): n is a, c, g, or t
  misc_feature (568)..(568): n is a, c, g, or t
  misc_feature (570)..(570): n is a, c, g, or t
  misc_feature (585)..(585): n is a, c, g, or t
  misc_feature (594)..(594): n is a, c, g, or t
  misc_feature (596)..(596): n is a, c, g, or t
  misc_feature (610)..(610): n is a, c, g, or t
  misc_feature (614)..(614): n is a, c, g, or t
  misc_feature (620)..(620): n is a, c, g, or t
  misc_feature (624)..(624): n is a, c, g, or t
  misc_feature (627)..(627): n is a, c, g, or t
  misc_feature (629)..(629): n is a, c, g, or t
  misc_feature (638)..(638): n is a, c, g, or t
  misc_feature (643)..(644): n is a, c, g, or t
  misc_feature (646)..(646): n is a, c, g, or t
  misc_feature (648)..(648): n is a, c, g, or t
  misc_feature (650)..(650): n is a, c, g, or t
  misc_feature (654)..(654): n is a, c, g, or t
  misc_feature (656)..(656): n is a, c, g, or t
  misc_feature (662)..(662): n is a, c, g, or t
  misc_feature (664)..(664): n is a, c, g, or t
  misc_feature (666)..(666): n is a, c, g, or t
  misc_feature (677)..(677): n is a, c, g, or t
  misc_feature (682)..(683): n is a, c, g, or t
gaggcattcctgaacactgcacaggttcgggccgagatttctcgctccgtggccttagctgtgtcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagagaattgaaaaagtggagcattcagacttgtctttcagcaagcactggtctttctatctcttgtactacactgaattcacccccactgaaaaagatgagtatgcctgccgtgtgaaccatgtgactttgtcacagcccaagatagttaagtgggatcgaaacatgtaagcagcatcatggaggtttgaagatgccgcatttggattggatgaattccaaacnccgcccgcttgctnncccncatccctccgctcacnccccccccccccccgccccnncatgcnggncccccctnaccctcccccccgcccccccccccccttaccccccccccccccccncnccccccccccccccnccccccccncnccggttgccccccncggncgcccncgcngcncncgccacccncgagnngngncncccngnactccncncnccccccccccnccccnngccacatcaacatcttggtcagatttgaactcttcaatctcttgcactcaaagcttgttaagatagttaagcgtgcataagttaacttccaatttacatactctgcttagaatttgggggaaaatttagaaatataattgacaggattattggaaatttgttataatgaatgaaacattttgtcatataagattcatatttacttcttatacatttgataaagtaaggcatggttgtggttaatctggtttatttttgttccccaagttaaataaatcataaaacttg

SEQ ID NO: 539320 - DNA, 495 bp, Homo sapiens
  misc_feature (85)..(85): n is a, c, g, or t
actgatagcgagggataccagccagaagagggtctgaaagacaggcccatccccaggatgggaatgctgtgttcagacacacaanacaagagaaaccagactctggtcatggagcagtaccacggtgaaagacttttcccaccgacatggtcacatagccattctccttgaagtactgggggatggtggagaagtttccagcgtgcaccctccagtaggagttgaagtcgtacaggcgggtggtgtcaggtctcctgccagtgaggaaagaaacgcggctcggggcgcacactgctttgctgtttaggggagcagcaagccagaggtaatgcatcgcgcacagcaaaacatgtctgccatctcttaggtaaccaagcaaccgccctcccgaggctcctagcaaacagcttggtagctgagtcatgcagagctcaaaccagacactgggatttgggtgtcacctaggcaacagactggttccggtcgaacgggtac

SEQ ID NO: 539321 - DNA, 1043 bp, Homo sapiens
agaataacactaatggacatgtaaacacacatcgataaatacaatacaattagccctccaggaaactctgcaaggactctgcatttcatctggagaacaagtggactggaagagtacataatctatccccttcacatcaacacacaagcactgatatttctctgatatttgctgctacaacctccccagatgcagccacaacttactttgttgtttctttacactgaacacataccttagctgaccttgcttcctgaagtgcaaattgcacaaatgtaatctttgcaaaattcctcatattcctgaaacatttgctcaaacttcatcatttttgaagactctgatcaccctacaaatgctacagacatctaccaactcagcattctattcatttaattactccaatattgtcattgtttcaaatatccataaccttttaatgtattatataaattatttattattgtagaaaatgaaaattagctggacagcaaatatctacccagtcaaaaaagatttagataaattcagctggaaagttaacaggaaacacagttcttccaaggtttgtggccacttaaaagtggtaagataactgcttctttgattgactacctctttctttctttcctccttttttctttcctttcctttctcctttctatacattcatattctatctttcatatcctttctttcattacattcctatcctgtctatactataccgtcattacattatcattactcatacttctctatcatacatgtggcttttgaaattatgccgtagacaaaatacttcccttggctggataccggccttgaaaagaagaaaatttttaaacgtttaaatccaaatctcaaggggagatttaaaaaaaataaatcgtgtgtccaggaaaaaagacagacaggaagagatgaaacgactaaacagaagagagaacaagcaagaaatgagagaaggaaagaatataataaacacacaaagaatagccagtatcaataatttgatttttgtaatatatatagagacaaaa

SEQ ID NO: 539322 - DNA, 281 bp, Homo sapiens
caggggatggccactgtgaaggacgccttcccagcctgcccgttgccaatctgctgtgagagggggcctccctgccttgaggccttagccctggctctgcaattttcctccggggagaaaggacaatgcccctcccccgaactgggcccacaattcttcctttttccaagaacgaaggcttttggaccttcggaccccatcccactcacccaagtgtctttctgtgtctggggggaggagcggatgatatccgtgtggttccatctattattttcaagctc

SEQ ID NO: 539323 - DNA, 344 bp, Homo sapiens
caaggacttgctgtcgcccaggctggaatgtggtggcatggtcacagctcacgcatcctcgacctcctgggcccaagcgatcctcccatctcagcctccagaatagctgggacaacaggcaggcactaccacacccacctgattttattttaattttctgtagagacagggtgtcactatgttgcccagactagtctcaaactcctgggttcatgtgatcctccagcctcagcctcccaaagtgctgggattacaggcataagacaccatgcccatcccatgaattcttgtatatatgtaaaaacccttcaccactcaccttccttgacgtcgacgcggccgga

SEQ ID NO: 539324 - DNA, 602 bp, Homo sapiens
ggaccagacccgtgaagttcttctagctcctccaagtcccagttttatcccagtggaaccagctaaaagacaaggtcgtgcgtctgctccctgaagccctagtagtgctggagattggacaacgtcaaggtgaacaacatgttaaagggggaaaaggccgtcagggcctggaggtgtgctgtgcgccaacttcttgacagcaacgtctccaatctttgaagctcagcagcaccagtgcaatgaacgtggtcagcaacgctaagtgggctgggagcacacattggcaccggcaagtttccagcgacctcaatggggcagcaagccgtgtttgccgcgccacaggcagtgggttcgtaaatacagcgatcaggacacttccttcccagtttcgaactggcacttccaacgcggccctccttctgaacgcgcgcgccgtgtgtgcaaaacattttgtgggtccccactttggtgcttctaaagtgggcgccatttggacaccgttcacatgattatcacggccgcttttgtgggcaacgggggcacctgtgagctggcccgtgggctgcaaaatcgtcaagggtaacttctagttcaaggccaca

SEQ ID NO: 539325 - DNA, 760 bp, Homo sapiens
gacttgggcccccttgtgggccccctctcgctcctccctttaggcacctccctggggcccgcccagggtctccccccagttgtggactgcgtcataagtatcccagacctcggcttgcaggtatgtgttagactgaagataaagtaagtgctgtatgggctaacaggatctcctctgtgcagttctgccagcccaggacgcttgattccagcaggcggcctttacccgggcaggcccgaaagaattccactaatggtgcacaaactccgggcttcaattaaaccccataacggtccggttggacaaaagggcaggatggcgcgggcaaacgcacctgttggtgaacgggcccctccttggaagccggcacgggggccagagaaactctcaagaataacttggaccggtgcaaagaagcaccccaattttacccggtggcaacagcaagattgttgcctttctcatcgggaatccctagggagagacttcccctgggcaaaaaatttcccccctttcacggtggggcacatggaaaacaaggccccttaaagcgattttcccctgtgggcccatgggtaggaactcctggaaacggaaaggggcttggcagcaaatttcccggggtggacgcggaatttgcgaccacaccattttcggccacattcccatcgtggatgtgtcgcccttggttcaccaccaaagatatacctccgtggaatacaggtgggaccccctaggacagggcacaaacttaaattca

SEQ ID NO: 539326 - DNA, 1380 bp, Homo sapiens
tgggtaaagatgggggtctcactgtgttgcccaggctggtctcaaactccgtggccacaaggtgattcattccgtgaccttcagccttcccaaaagtgctgagattacaggcaatgtgagccacgtgtacccagccgtttcctatattaaaattcaaagagaaaatttctacacctttattccctcaaattaaacacatgttgcttacagttctatacgggtgcccttgtacaagaggtcataatagtgttaaaaagagatttcgtgaaatttatacgcgtgtagacatataaagatcgtgtgattacaatgtaaaaaagaggaactgaagagattagcaatttttctccgagttgggatatgggcgtcgtatgagactgtgttgagaaggttaaatacaaccgcgcttttaaagaggaaggcaaagcattcactgggcgtgtttaaaagcccaacagagtgttggccgtttaccaaagccgctcttttggggcgacagggaagtaatcatgtgatttactagagcgaagagtgttcccgaagacgagagggcaagaaacacattttgtgagagggtgtgccttcaatgttgaacagagtatacacgaggggacagatgggtgtgggtaataattattaccaatagacatttatggggggggacctagaaaaatgtgttgataaacaagagtgtgtgtttttatcaaacatgagggaaaggacaacgatgtacaggtgtttaactccacaagacgttgttggagagggatctactgttggggggatttgaaagattgtcgtttattagaccgcggaagaaggacaacatctttgtattgagacgaagaaacacatggaggttgcaaaaacttatgaaagactatcaagggggcagtagtaaatttgtgtgtagaagcaccacgaatcataacacagtattatttgtggtatagatcagctaagttgggtgtttataagaggtgtttgtcggagagaaaatattttacagaagatatgctagtagatattgataagtctgatgtgtgtgaattgtgtggggtcacttaaacacgacgattaagtaaccccagaaaagagccctccgagactagaatgatcagtgggtaggagcagcagacgccactcacagaaggcaggtacgtcatctgaagcggcagcagaggtaacaacaacgaccgattgtggcaccgaacgaccaagcgaaacgtaaaaagaggggggggggaggacacacaacacccccccagcaacatgacaattaggtagagacaaaacccgtgagtcacccaatatccgcgaacgaacaacagttgcaacatgaggcgacacagccagcaaagcagtcaccaccacgaaact

SEQ ID NO: 539327 - DNA, 719 bp, Homo sapiens
gtgcaatcgacaatgtgctaacctgcttttctctttttgtcaacgtttttgcattacaggctgcattcttgcccttactgctatagaaacaagaacaaaaggctgggcttcactacttgcacactttctaagcttttatacctcttactctctcttggcaatggctcagattctgcaactggacagctcacgaaccacaggctctgctgcttaagcggcttttaaacttgctgcactttcttaacccctacagctgacaatacacttacagatatcccctgtgttcacagctgtgacggggcctgttttactgtcactgttggcactaaattgtcccgtaaaagggaaagcgtttctaaaggtgtttcagcgcttgtgctgatacaaagtaagttattactttgcaccaggctggttctggccacctgaatttaatactgctatagccaagagaaaccaactcttattctttttggacaacactgttccacttacagttccttcattctctgttgacttcttttctattgcactttactgattccagtgcgctgggaacttgagacatttacttctgaaatagaataggtaacacctcagcgtactatagcaaaatcgcactcagcctcaaactgctggtgttttaaaaataacacatttttaaattcccctcttttaccagaacaactcaaccatcaccaccgctacattctttctgg

SEQ ID NO: 539328 - DNA, 120 bp, Homo sapiens
ttcgacggaagcagagaatgggcctcagaagcaatgtcccaaacttgtggttgggtcatcgtggaaaagaaacctcatataagaaaagatacttacatactggagagatggacttgatta

SEQ ID NO: 539329 - DNA, 888 bp, Homo sapiens
cgggggttgtggcccccgccccctccctatatgcaccctggaaccagcaagtcccagacaaggagacggaggaggaagtcatgggtacgcagcctccagttgtagcaggtttcactattcctatgctggggtacacagtgagagtactcactgtttcacttgtcttgctcttagattgggccatggctttcatcctgtgtcccctgacctgtccaggtgagtgtgagggcagcactgggaagctggagtgctgcttgtgcctcccttcccagtgggctgtgttgactgctgctccccacccctaccgatggtcccaggaagcagggagagttggggaaggcaagattggaaagacaggaagaccaaggcctcggcagaactctctgtcttctctccacttctggtcccctgtggtgatgtgcctgtaatcttgttctccacccaaaccccttcccacgacaaaaacaagactgcctccctctcttccgggagctggtgacagccttgggcctttcagtcccaaagcggccgatgggagtctccctccgactccagatatgaacagggcccaggcctggcgcgagtacggggccacgaggcgagcagatactctgaggcaagtgactagacaccacgccttccgtcagatattactgaacttgatattactctctatccatgcgcagatgataaaagcgaagtctggcattctacagcctcggacacattatgaatcggtctaaaggtgggacgttggcgtaatatcaccgaagcctggatgaaggtatagtatggacgcgtaaatactctatgatacatgaagtgccgtgtgtgtaccataaagtcgtatgaccttaatctactgacgtgtgcggataccagtggttt

SEQ ID NO: 539330 - DNA, 671 bp, Homo sapiens
  misc_feature (37)..(37): n is a, c, g, or t
  misc_feature (62)..(62): n is a, c, g, or t
  misc_feature (69)..(69): n is a, c, g, or t
  misc_feature (81)..(81): n is a, c, g, or t
  misc_feature (91)..(91): n is a, c, g, or t
  misc_feature (140)..(140): n is a, c, g, or t
  misc_feature (203)..(203): n is a, c, g, or t
  misc_feature (213)..(213): n is a, c, g, or t
  misc_feature (216)..(216): n is a, c, g, or t
  misc_feature (254)..(254): n is a, c, g, or t
  misc_feature (283)..(283): n is a, c, g, or t
  misc_feature (289)..(290): n is a, c, g, or t
  misc_feature (298)..(298): n is a, c, g, or t
  misc_feature (414)..(414): n is a, c, g, or t
  misc_feature (428)..(428): n is a, c, g, or t
  misc_feature (433)..(436): n is a, c, g, or t
  misc_feature (448)..(448): n is a, c, g, or t
  misc_feature (484)..(484): n is a, c, g, or t
  misc_feature (632)..(632): n is a, c, g, or t
gggggggggggggggttcaaggggcttttatgaaganctgccctctagtttctcatggcagnatttggnggttctgatcanagggttgggnatcttgatcaagagttcctccttgggtttgaagtcacagtgggcaaggntgacagcagcaaccctttcacatgatttaagcgttagaattatataattctgtacattggggnaatctcaaangtngtaaaattttttttgtcttttggcttaaccctagaganacagtagaccagtttcagcttacatttangatggnngggggggngaacaaaaaatttgacaggaattaaagtgctaagaacatcaccttagaatcaattccaaggacttacatgaagagaaaaccatcctcccatatgaaaatatttgcagtaggagaanacagtgcaataggntccannnnttgcttttaagncctttggtggggcagttactactgctttaaaagccnggttaaagtatactctaagcaaagatgaccgtagagcagctagcttccttttttataatcacagggaaagctctctccattgtccatcaaatcagctctagaaggtttttcttttttttctcaagtgccaaaggggaacactgatttnaagaacctccttttcccaagttttggcccaatttccttt

SEQ ID NO: 539331 - DNA, 362 bp, Homo sapiens
  misc_feature (75)..(75): n is a, c, g, or t
  misc_feature (94)..(94): n is a, c, g, or t
cgtgagccatctcccttattcactgccccctcatccttgtgccacttcccctttctaactagaaaaagtacaatncctagctgggcacagcggnctcatgcctgtaatcccagcactttgggaggctgaggtgggcggatcacctgagggtcgggagttgagaccagcctgaccaacgtggagaaaccctgtctctactaaaaaatacaaaaattagctgggcgtggtggcgcatgtttgtaatccagctaatccggaggctgaggtaggaggatctcttgaacctgggaggcggatattgtggtgagctgagattgcgccattgcactccagcctgggcaacaagagcgaaaccccacctc

SEQ ID NO: 539332 - DNA, 589 bp, Homo sapiens
tgagcgggggagtagcctggaaactctgaaagactgaccgactgactctgacgaggatccgggggctgagggcaagtgaggcggacggacatggagttggtgctgagctgctctacaacaagtctgagtacctcgagacggttgcgcgggtccgaggatatggtatcctcctctttccaagcctgcgctgccgtttgaggcctggtcggcgttcccaacctgggcccatagcccgacacaaccggatgatacctgtagggcattagatcgccggcattatctacgcgatgcccaccgatggtaacagactggctaccgctgtattactccgcgctatggacagatatgaggaccttttgtactttattcctgattttcatcatagtggcgtaaagtgccttcgcgaggataggacaagtcccatccgtgtaacatacgaaatacagacatcggaccttcgggtcccttttcaccactgcccatttggtactctgttaaccttgacgctaaaacaccgcaaacgggttcttttaacatctgacgaaggggagagggggagcggcacactctgacagccaaacactgaagg

SEQ ID NO: 539333 - DNA, 158 bp, Homo sapiens
gcaattttgcacaagagaaaaataaaaagatacaatgaatgtcatcattttatcattttattttcagttggcatgatgttggaatttttgttcattgtcatgaacattgtaacacaatcattgcacaagatacaagttgttttggtttttcacatcaa

SEQ ID NO: 539334 - DNA, 292 bp, Homo sapiens
  misc_feature (4)..(4): n is a, c, g, or t
cccngggcccccccccttttttttttttccccccccggggggggggccggtgtgggggggagaaaaaatttccccggggtttgttaaaaaccccccccccttttggccctttggtttttttttttggggaaaaccccacaccttttttcccccttgggggttttttcccccccccccccccgggggtttttttttttcccggggggcccggggggggggccccccccccccccccccccgggggttgaaaggggtttttttttttttttgggggaaaccccccccgggggga

SEQ ID NO: 539335 - DNA, 909 bp, Homo sapiens
gaggcgggagcccgcgtgccgaagccgggacccctcggtccgttcccccaggcccggcacggggtcggcgcccccccaggtagcctccagtccgaggggtgggtcccggaataccccccgaagctgccgcggcgcgggcatctctggcgcggggacgaaggaggtccagtgcacgggagaaggggcaagccggagcaggggcagggaacgagggttgggaaggccggaaggaaggggagagggaccaaggcgggggctaccagggacgaatggacaaaagggctttgagaggggaggacccaaaaagtccttataaaaagccaaagtctctaagctaggtggtgggtaattcgaaattaagattgggattgtgggtccaaagagaaagtggtacttgcccaaggtggtgtaggaatagttccaaagggtgtcgtaaagttttagcgggagaacttgggaggttcctatcccaattcaaagtcaatattgttcacaagaagtgtggagattaattccattacaagggacgacataggtggccaccgaatagaaggaagaatggctattgtgcgaacagacaacattaaatgaagtacattccaagtgcaatttccaacaaaattatgttggcaccctggcggaattatttgggaggcgcccctgacagggaataatccgggaaagccctaatcggcttgacacagcgtccgtggtgattggtggggccagtgggtgtcaccgccttggaaatataccggctggtcagagcctggcacccctggcgcaggaaacaatatacttcttaatacagagaacgggcaagtccttccctggtatcggccgggacacccggcgacgattctcctaataaactggaacgggtaaccccaaaggccaatgcctttccgc

SEQ ID NO: 539336 - DNA, 452 bp, Homo sapiens
aatggtgtagtctgctgtcgcctgacacacattttccttctggcatgatagtttgtttcgagatgataacactattggcagtgtgaaccttctggactactatgtatccattgaactctcaggagatatgtcccaagatgggaagctttacgcaagcgcttttccgatccatacagtcaccgaccgatgcacctgcgccacatacaatcctatgcggttttctactgtcatgtgcttcaggggtggatgtgcaagggagatatttcctgccctcttgccccaaatatttatctcgtgaagattctcaaggttcacgaaagtgcttcgagggaccgctccccataaggctgtgcgagtggtatgaccggaggggtatttcacacgtggcataggggggtgggggagtttggcgctgtgttcttccatgatgcctcctactgagtaccgtgcgt

SEQ ID NO: 539337 - DNA, 159 bp, Homo sapiens
  misc_feature (35)..(35): n is a, c, g, or t
  misc_feature (39)..(40): n is a, c, g, or t
  misc_feature (143)..(143): n is a, c, g, or t
cagaatcgtgtgagggtgggaatagtgttaatgtnattnnaagagaatgaagagaagtaagccgagggcgtgttgattgtgtagtaagggtgaggtgattttatcggaatgggaggtgattcctatccttcgacgccgatctnctctatccttcgcacg

SEQ ID NO: 539338 - DNA, 517 bp, Homo sapiens
  misc_feature (34)..(34): n is a, c, g, or t
  misc_feature (72)..(72): n is a, c, g, or t
  misc_feature (147)..(147): n is a, c, g, or t
  misc_feature (194)..(194): n is a, c, g, or t
  misc_feature (303)..(303): n is a, c, g, or t
  misc_feature (361)..(361): n is a, c, g, or t
  misc_feature (415)..(415): n is a, c, g, or t
  misc_feature (497)..(497): n is a, c, g, or t
gggcgggccttgctaatttgggcgtatttggggngtgtggcttctcctgtgatagcggcgtaaaggtcggtnaacggtttgcccttcgcctggcgctcttaagccactcctcccgtggtccgtgttggccttgggtccgcggccgcngggcccggggggccccacgggtgtgtgggttcggcgcctggggggcncccctaccctctgtgctgtgtgttcccatgactccagaaataattaatcgcaacttgcattattaagtccacaggcaagtttgaaatctaactagaaaaagtagcagcnaaggcaaaatacgcgggaatttgttagaaaagccacaagatttcttaaaatgcttccngttcaagtcagaattaaggtgacattaggtcccccagctttacagagttgtggntgttttgctgttgttctttcaaaaaagaagaatctgcaataaacatgttcatttgagaaaaatactgtgtttactttttgtngccctccccagttactttaa

SEQ ID NO: 539339 - DNA, 237 bp, Homo sapiens
ggtcccatgggtgcctgtggcgactggacgttcccccaagccacaggggtaaaaagattcatcccttgagaaactagcttgcgatcactggcaggacagggggtcattttgaagtcttaacagttgggcttgggaaatacaggggcttgacccccgggcttgtaaggttggctgttcccagatgcttggtattgaacgcagactccgtttccgcagacttgtaccgggcctcattta

SEQ ID NO: 539340 - DNA, 217 bp, Homo sapiens
  misc_feature (151)..(151): n is a, c, g, or t
tctagagatcccgtcgacggtaccaacacgatttgaatcatctattaactttttagataaccatttgactggttcgaaccagaagactggcttgggttacaataagacgattctgggaccaagtaggttgtaaaggccaaggtatgtttgnggctctctctctctctttctcttttttttttttgggagacagagttcggtctctcacccagggtgg

SEQ ID NO: 539341 - DNA, 163 bp, Homo sapiens
ccactgtacttgggagtgtccacctttacaatacacaagtacagtaacggtaactcgcactaagacaaagcatacttctgatagccattatatttctctaatgggacaaatttatagtttgcctttctgtcacacaaaacagcgaatgtacattatacaatag

SEQ ID NO: 539342 - DNA, 374 bp, Homo sapiens
  misc_feature (24)..(24): n is a, c, g, or t
  misc_feature (111)..(111): n is a, c, g, or t
  misc_feature (177)..(177): n is a, c, g, or t
aagatgccgatacttgatgacagnggcgttccgcatccggtgttggggattcagagtcaggcagactttcagaaagcggtattggaacccttgtatcaggcaatgggcatnaccagcgcagcgagcctcgacactcgcataacagaagtggaacgacgcttgcggagcatgacggtnaaggacaacctcgagatgcgcggctaccgtttcatcgagacggttcagtcgcacgcgccgctgcgcgacatgctggcgatggcaaacagcgggcctgacagcaatggctcacagttattcatcacgctggcagataccgaatggttgaccggccgacacagcgtgtaccggcacaagtgcgtgccggcatggaagtc

SEQ ID NO: 539343 - DNA, 459 bp, Homo sapiens
ttttattaagagttgactgatttgttacatttggtggtggagaatgtaaacattaggtggttggaaacacgggaaaagggggccgcttttttcaaggagaggcccttgaaacagctaccatcggggatactttatttaaaaccaaaggtgtgtggttttaaaaactaccggctttaaaatggcatatttttttaagactggggatcacaattacccacactgtggggcagtgaaacaaatccacctttttttgacagccggtttctgggggcaagaggttgtaaagacataaactggggtttccttacaatgcgggccggggctaaaaaagagggtgggggcgccctgggaaacatatttggggcgcaaaacacaaaccccccgcagaggttgaactaatgatcttcatttatgcccacgaatgagagtccctctcttctaaaaggacaagcttcatcc

SEQ ID NO: 539344 - DNA, 257 bp, Homo sapiens
gattatggtgactaggagatacaagcatgagactcagaagaattactagtttttcataaaatgattcattgggatatcattctaaagcagtgtattctataatttcagtaaatcataatttctcactaaaattgatatttttatagtaaaatccatctactcaaaacttaacactgaggtgaaacttaaactaacatgcctgtaaaggctcccttattatatagctaggtgtttaatttaccaggggtggatccatt

SEQ ID NO: 539345 - DNA, 153 bp, Homo sapiens
ctgaggtattcgatttgctggctcagaaaacttatcagcatttaactgttgtgcatcaatttgccaaagattttatgacttattctgtctgcacctaatgcttctgttacaggtcctcattaacctaggaaacttgtcgtgagcgtggtgctg

SEQ ID NO: 539346 - DNA, 143 bp, Homo sapiens
agatggacaactccgaggaacgcacccatccacccacaaccccagagcctcagagacctgccatgaacacatgaccacgcaccatccaggtaaagtgcttagaagagcgacagagaaacggtgcaaagatgagtgaacaagta

SEQ ID NO: 539347 - DNA, 298 bp, Homo sapiens
gacggggcgctatactgtggcctacacgcatatgccggccatcaccggggagcaattcagaagaacagccagtgtggcccagtagaactgaacgggtgggaccgtcaactccttcaccgaaacgaagcggacgcttcgggccaagcagggtggtaccgcgagccttaaaggcgcgtccctgcaccgtgttaagagtgaaggataattatggcgaagaagatttaccccaaggtcgacatgaccggcggctccacgctcccagatatggaagaggaagtccagaagtactgggtcgacg

SEQ ID NO: 539348 - DNA, 595 bp, Homo sapiens
gactatctcttttgcctaataaatacagagggctgtgtaaagctcagggcccttgttcactagagacaaggtgtcccctgacccttcttccaaacatattcttttgtctcttgtctttattcctgcattcatccccctttgttcagtccaccagggatcctggcaggctgcaagtggtgcctcgaacagcaacagaatctggtgctttacaagtggcgtccaaacacaggggcttcgaggatgtgaatgaagaatgtctgctagagcagaggaactgaaattgacaaggcgaatggggaccccgggatgagtctgctggcagcggatataaggtcagtgccctaaaaaggtactaggagcagtgctttaaagaagtactgggaatgggaagttttctgaatcagggtaacatggagcagaattgtctattgaaggaacaacattatgtgcagttgcttaaagtttcgcttgaaaccaaactggtgctcgggttctcagacattcattaagatgctacaggaggttattacgcataacccatggtttccacggcttatcaaaactcttgatgtggacgatgcgacagaccaggaga

SEQ ID NO: 539349 - DNA, 232 bp, Homo sapiens
tggtcagcgctggcccgaatttgcctcatctactttactccaaatacatgttagccaggtgaggtggatgcatgcctgtaatcccagctactcgggaggctgaggcaggagaattgtttgcactcgggaggcggaggtagcattgagccagattgtgccattgcactccaacctgagcgacaagagcgaaactccatctcctaaaaaacaaacaaccacacacaacaaaatt

SEQ ID NO: 539350 - DNA, 223 bp, Homo sapiens
ttcagctagctggatcactgcttggaagtgagcattattattgaataatgctatatatatgaaaaagaagctctataatgtgaaaagaagagagactcctccaaatgttacaatagggctatgacaactcaccgtgtgagcagagaccaaacttggttttctgaaatgacttaaaattgagtagttcccaccattaatttccattctacacaccacgtagcaa

SEQ ID NO: 539351 - DNA, 978 bp, Homo sapiens
  misc_feature (978)..(978): n is a, c, g, or t
aaaatcactgttaatagaacagacaacctgcagaataggagaatatatttgcaaactatgtatctgacaaattctcctatccagaatctataaggaattcaatcaaacaaatcaacaagcaaaaaacaaacaatcccattaaaaaatgagcaaacaacatgaacagacccttctcaaaggaagacttacatgtgaccaacaaacatgtaaaaccgtgctcaatatcactaatcattagggaatgcaaatcaaaaccacaatgagatatcatctctcatcagtcagaatggctattattacaaactcaaaagctaacagatgctggcgaggttgcagagaaaaaggaatgtctatacactgctgatggaaatacacattagttcagccatagtgaagagcagtctggaggtttctcaaagaacttaaaacagaactaccagtcaacccatcaataccatccttgggcatacccaaaagaataaaaaccattctaccacaaagacacatgcatgcatatgtaactctcagcactatacacaataacaaagacatggaactaaactagatgcccatcaatgctggattggataaagaaaatgtggtaccatacaccgtatggaacactacacaatatacaaaatgagataatggcttgcagcaacacaaatagagctggaggcattttcctaagcgaattaatgcagaaacagaaaacccagtacacatgttctcctgtagtaggagctaacatagtacccaggccaagaaagacatgatagggctattgaggtgcaatggcggaggggggtggaaatccctggtcatgtctaccggggcaaaacttatataaccggatgtttacatgttaggcttttccccaaaaagggaaaatttccaaaggtgtgagtaacacccgtaggtattcgggggggataaatctttaccacagaaaacgatgtggtcaacaccgaaggtccn

SEQ ID NO: 539352 - DNA, 898 bp, Homo sapiens
  misc_feature (371)..(371): n is a, c, g, or t
agcgggtggggcgccgggatcacgctggggaggcagaacgccaagtggggaacgcgtttcgctgtatcgtcttctgcagcgtggatggacgtccagacggctacctcctgcctgctgtaggagctggctgagcaggcggacctgggcgccggcggcggcaaggagcgcagcgctaggatcggctgtacgaccgtatcattagggtgcgtgcacagctccgggagtgccgcggtgagtgggcacggagcccaagctgccgacccgagccgactcgatcagggctcagccatgcgcccctccaagtctctgtgcgagtgacgcatggcaggtcagctccgtgagggtgttgcacggcatacttcctagatagngcgactaactcccgtccagatacacacttttccacttcttctgccgaattccctgcactttttgaagtgactccatcaggcacacttaacttcctgggacccttccattagagacgcctacctaatgaataatcctctagggatgcttgcccaagacaactccgcgcaatttctatcacgccgccccagaaactccagaacggcaatggtcgccggtctccacaaagtttagggcgcactcgataacgtatcacaatccccctggaccacagaactgctactacgaggcccctagcatttgcatgcacacgccgacccacactttccagcaagctagaattgtgccgctacacgcccgtatttggaccatatcacccttcttcacgcaattgcctaatttatgacgcgacagacagcacgctagctgatttaccagccttgggaatcaccccggctcccctttttacctaagctgagcttagatacgcggaccccatccgcaggggcagctcgcgcaagagtctcct

SEQ ID NO: 539353 - DNA, 156 bp, Homo sapiens
cagtttcagccctccattcgcatccagttcaaccctccaatcacatccagttcaacccaccagtcccgtccagttcagccctccaatcccgtccagttcaactctccactcccgtccagttcaagcctccactcccgtccagttcctggcctccca

SEQ ID NO: 539354 - DNA, 332 bp, Homo sapiens
ggggggagtttttttttttgggccccgggggttcttttttttcccgggggggggggggttttttggggcccccggttttctccccccccctcgtctttgggcgggcccccccgcttttttttcccccccccccccccccccccctggtttttcccccccctttttccccccccttttttttttgcttttttttgggggggccttttttttttggtgtgttggggggtccccctttttttttttttttttcgttccccccccggctttgttttttccggggggggcctttgggggtcccttcttgagagggtggggctggggcaaatttttta

SEQ ID NO: 539355 - DNA, 433 bp, Homo sapiens
tacttccacagggagtttattccaaaaataatcggggatgtgaaagaagatttagatgcccagaaatttcagctatctaaaattcatcatttacgttcatgcgaaaaataagctgcggtttcagaccatgaattttatatcattataactaggctcaaacacatctttattaatcaaaatagaaaccattacaatcaacacatttttaagttgtttatccctgtagtgtagaaatccatgctttaggattcgacgaactcttggaaagcattttctgcatcctgctagttgtggaagtgttttccctgcaaaaaggtgtcgcaatgcttgaagaagtcgtagtcaatggagagaggtcaagtgaatatggcggatgaggcaaaatgtcacagcccaatttgttcaacttttgaagcattggttgtgcaacatg

SEQ ID NO: 539356 - DNA, 439 bp, Homo sapiens
  misc_feature (12)..(12): n is a, c, g, or t
  misc_feature (35)..(35): n is a, c, g, or t
  misc_feature (104)..(104): n is a, c, g, or t
  misc_feature (129)..(129): n is a, c, g, or t
  misc_feature (180)..(180): n is a, c, g, or t
  misc_feature (183)..(183): n is a, c, g, or t
cagagggcaggnccttcgctcaaagacaaattggnaagaaactcactgggtcttgtcaaacatgtcactagagaaactggtaatcatgtggcaccccggcagcngtgccttaccgtgaaaaggtgcccngaggtaacatctaaaacgagatgtggttcttatgtttaacgaacgttctanccngccacgtgttatcattatagaatagttgccctttctaactactagcacagtttgagaatacgttaattgctatttactatttaaaaagttttactgaatcagtccataacattaagatgagccctaatatgtaagattttcctctggaatggatgtgagaaatgtaaattttataacagcagtatttatcctggtttaattctaatacgatgtcatgttaatttcatgttgtgattaataaaagcattttttctgc

SEQ ID NO: 539357 - DNA, 808 bp, Homo sapiens
  misc_feature (1)..(1): n is a, c, g, or t
  misc_feature (94)..(94): n is a, c, g, or t
  misc_feature (119)..(119): n is a, c, g, or t
  misc_feature (130)..(130): n is a, c, g, or t
  misc_feature (263)..(263): n is a, c, g, or t
  misc_feature (342)..(342): n is a, c, g, or t
  misc_feature (389)..(389): n is a, c, g, or t
  misc_feature (391)..(391): n is a, c, g, or t
  misc_feature (583)..(583): n is a, c, g, or t
  misc_feature (619)..(619): n is a, c, g, or t
  misc_feature (624)..(624): n is a, c, g, or t
  misc_feature (627)..(627): n is a, c, g, or t
  misc_feature (689)..(689): n is a, c, g, or t
  misc_feature (706)..(706): n is a, c, g, or t
  misc_feature (710)..(710): n is a, c, g, or t
  misc_feature (722)..(722): n is a, c, g, or t
  misc_feature (798)..(798): n is a, c, g, or t
nagaaaggaaaagaaagaaaagaaaagaaaagaaataataaataaaaaagaaagggaagaagaagttgataagagagaagggggaggaagaaanaaagaaaatagaaagagagaaaaanaatggaaaatnatgattataagaaaaaaaaagattaaatgaagaaagaagaggaatgggaaagggaaatgataatggaaaaggaatgggagaagaagaagagaaagaaattaaaggaatggtgtaaataaaaaataaggaaggnggggaaaaagatagagaaaatagaagaggaattaagggatggaatgaagataatgatgatgatggaggtaatataaggngaaagattggaaaagaaagagagaggaaagaagagagtgaaaaagananaaaaagtaaaaaaggaaatggatttaatagaaagaaaaggagtaaaaatggtgtaaataggagaagaagaaatagtggatgggaatgtgaagatgaaaatgggaatgatatggaaaataataatgagatttgaaataaaggaaatataagtggaagagaattaagaaaaggaagggatgataatgtggtgtnagagaaagaaagaaaattaaaaaaatgttaaaatanagaanttnaaaataagatggaaggatggaataggattatgtgatttgataaaaagaaaaaggaaagagangattgaataagggaagntgtngaaggatgatanaataaaaaatatgaataaggattttgaagtggaagagaagtaaatggaaataaaaaagatgatggatgaagaaganatagttggaa

SEQ ID NO: 539358 - DNA, 983 bp, Homo sapiens
  misc_feature (391)..(391): n is a, c, g, or t
actgcactccagtctggggtgatacagcaacactctgtgattgttccactgcactccagtctggggtgatacagcaacactctgtctctaaaaaaaaaaaaaaattaggctgaatgcagaggctcccacctgtgatcccagcatttggggaggccaaggggggaggatcacttgaagtcaggggttcaaccccaacctcggcaacagagcaagacccaggctctacaaaaatgaaaataaaagccagatgtggtgggcatgtgcctgtagtctcagctatttgaagctgaggcaggaggatggcttgagccaaggagtttggaggcctcagttaactaggatcatgccactgaactctatgcctgggcagacatgaagaccaatggttctntttagggccaaaccaaagagaacaaaatacgaagagagagacagagacgacgcctacacaagagaaagagatccacacaaccgaggggggggcgcgcaaagaggaccacgcgcccgtattacgagaacaaccccctgtgcgtcgccgtcgtgtcgccccacaacatgtggggggggggcggcgcggcgaccccccagatgtgtgggggcaggctgagagtaacactgtaagacaaccgcacccggaagggcgtcgcgagatgccgcatcttttaaaatacgcgcacgcgccagatagggggagaactcgtcccgtgtgggtccttccttgtgaggcgacccctccctattgtggtgacccccgtcgctttctcgaagcaccttctctgcatgctcgccttgtggtggccaccaaatatattgtttcatgtggtacgtcttcccaccctgggaggcctcactttggagaggcggccgctgctaatctactgtggtgtcagtctccgccgcccaccggagtttttccacgggggtggtgtctccgtggggtgtgggcccccctcttgggtttttgctcgagatgagtgtgaccc

SEQ ID NO: 539359 - DNA, 442 bp, Homo sapiens
gtgttctacagatttaagattgaacattcatcacaaaagaagacatagtactggtctgtaagcacaagacaatgtttcgagacatcatcagttaccaggaaagataacatttaagccacagagagagttaaggctctgctaccacggaggccaggccgaaaggccaagtggcgttttggcaggcgggcagcagggtggcactgctggcgagagtgcacatggtccagccactccagaaagcaggctggcagtttttatgaaattaaaaatttgctgccccatgccccagcaacctccctcctcagtgttcacccaggaaaaaggaaaacactcatgcttccacgcaaaccgacacagggactctcaccgctacagctgtgatctccacagactgggagcttccacgcagaccagcagcaggactctcaccgcttcagctgtg

SEQ ID NO: 539360 - DNA, 204 bp, Homo sapiens
gattggttccattacacatattaagtgattatttcagctaattaacatattaatcccctcaaatacataccacttctttgtggagagaatatttaaaatcctttttttttttttggcaatgaattctggcggtttggcccaggcggaagtgcagggttgtgatcaaggtccagggaaccctcgtgcctctccggggttcaagca

SEQ ID NO: 539361 - DNA, 224 bp, Homo sapiens
ccctttttcctgtaaaaattttttttattccccagttggctggggccccccccctttccatttcccttggggaccccgtgggtgggttcccctttttgtttcaccttttccccggggctttggggttttgtccccaagttttttttcccattttttggccttcccccccccccaaggtttttttttcccccaaccccaaataaattcccttgggttttggggga

SEQ ID NO: 539362 - DNA, 460 bp, Homo sapiens
tagggcaaaaccctgcagtattaaacactgaaataaatgtgagctatatgtacacttaagaaagattaataaaaataagtaagacaattaattacccaaatattctaattcagggtcactggtggccagtgtatcccagcagctcaggggcaagacagggacccagtcctggacaggatgccattccattgtggggtgcaatcacatacaccccaacactcacccggactgagaccatttagacacaccaattcacctaatgtgtacagttttgggatatgggaagaaactgtagtacctagagaaaacccacatagacatggggagaccatgcaaactccacacagacagtggcccctgctgggaatctatttttttttttggccatcaacattatagttaaacaatgtccttaaagatctgctgtacatttatttgggcccttatgaggggtacccga

SEQ ID NO: 539363 - DNA, 395 bp, Homo sapiens
atatctaattttattggtggttatagaaacaaatgctaagaggagaaacaaaacttccccatccacatacaacaatttaatagataaaagaacagttaaaataaatgaaaaacaaaacgtcgaaattctaaactttgtcatagcttcaaaacattaacctctgatacaatgagaaatcacattcagatctcaaactcttaaaaaaaagtatggctccttattaaaaaaatactgtatcccacttgaaatgaaaacacaggttgcctgctgatgacatggctggggctgtccctgcctcaggtgttaagcgtgccccctcccggggctggggagcagacataccctgccggcgagagcccacctacactcctccagggtgagacacgcgaggggac

SEQ ID NO: 539364 - DNA, 995 bp, Homo sapiens
ctactatattgcgtcggcgctgcgatatatccgcggttgctctctccccgcggggtttattatctttcgcgcggggacgcgtttttgtgccggcgctaagcaggggcttattctagcagctctggggcgacccccctcttttctgcacagcattcggggggctattttcttgtgtaccggcgcgctacccccttcccctccggggatttcttgctctgcgctggaccaaaagagggtaatttgctgacggcgttggttgcgtcgcaacagaccggcgccttggttagccggcgccgggtcaagtctggctgtaagtcgtgaccggccaagggaggagctccgcggtctgttgggacgtgctcattcagggttagcccccctcgttagcggagggagggtcttctatagcggccccaaccagatttgggggcgctcttaggctcctcgcccccccctctagttgttatgatgggtgttgtgcattttgctcccacgcctcctccgctcctgtgtgtagcctctcccaccgcatgcatcattattgtgtgggtcgcctctcgcccacccagcggggccgccatgtgtgttgtctccccctctcctctttagaggcgtcatcattctgttgggtggtaaagtcacatacagtcgtcgcaaacatattcttctctccccgcgaaatgtaccctgcgccagctctcatatgtttaaacaacgcgcggattctaagcaactgctataccgccccgcccatattttcttcacacgcctccgcacccacaccatttcttgttatttcgccccaccccttgctaatacacccacccactccggctacgtctcttattaacaggcgtagcgctataaaatacattacaacacgtattctccgcctcacatatatcctccccccctcttttaccctcacttaaaaacctctcggctcgtccccccccggtgtaaagtccccaaataaaaaaaaaaatcggaaagca

SEQ ID NO: 539365 - DNA, 687 bp, Homo sapiens
  misc_feature (5)..(5): n is a, c, g, or t
  misc_feature (88)..(89): n is a, c, g, or t
  misc_feature (204)..(204): n is a, c, g, or t
  misc_feature (241)..(241): n is a, c, g, or t
  misc_feature (276)..(276): n is a, c, g, or t
  misc_feature (280)..(280): n is a, c, g, or t
  misc_feature (289)..(289): n is a, c, g, or t
  misc_feature (320)..(320): n is a, c, g, or t
  misc_feature (322)..(322): n is a, c, g, or t
  misc_feature (324)..(326): n is a, c, g, or t
  misc_feature (329)..(329): n is a, c, g, or t
  misc_feature (335)..(336): n is a, c, g, or t
  misc_feature (339)..(339): n is a, c, g, or t
  misc_feature (342)..(343): n is a, c, g, or t
  misc_feature (361)..(361): n is a, c, g, or t
  misc_feature (369)..(370): n is a, c, g, or t
  misc_feature (376)..(376): n is a, c, g, or t
  misc_feature (390)..(390): n is a, c, g, or t
  misc_feature (399)..(400): n is a, c, g, or t
  misc_feature (415)..(415): n is a, c, g, or t
  misc_feature (420)..(421): n is a, c, g, or t
  misc_feature (423)..(424): n is a, c, g, or t
  misc_feature (427)..(427): n is a, c, g, or t
  misc_feature (429)..(429): n is a, c, g, or t
  misc_feature (434)..(434): n is a, c, g, or t
  misc_feature (438)..(440): n is a, c, g, or t
  misc_feature (442)..(443): n is a, c, g, or t
  misc_feature (449)..(449): n is a, c, g, or t
  misc_feature (476)..(476): n is a, c, g, or t
  misc_feature (490)..(490): n is a, c, g, or t
  misc_feature (515)..(515): n is a, c, g, or t
  misc_feature (524)..(524): n is a, c, g, or t
  misc_feature (598)..(598): n is a, c, g, or t
  misc_feature (610)..(610): n is a, c, g, or t
  misc_feature (623)..(623): n is a, c, g, or t
  misc_feature (682)..(682): n is a, c, g, or t
catcnataaattgtttttgaaagtcattaaaattatttaaataaactgtgatttggttatcagtggggtgctaagcagacattaaaannacaatatatgcgtatttatatatagttaaatataacagtgtaaataaatccacaatatattgttgactggaaagaaagtttaagtaatgtgtacaaaagaaaccacatttttggntcaaaataaaaagaaacaactgatgtacatacataancatgcccagtaaaatatttagaaggatatatagcnagtntctccaagncactatctctggctagtagaattcctaaacncntnnnggnatttgnntgnggnnaggggcatgcctgacttnggcactgnngggganagtaaagcgatctntggggaagnnactttgtgagagaangagannanntcncngaggnaggnnntnnaatggntccgatacctttcaatcagaaatttanttcaattatgggcnattgcccattggtgagaaagggganttaaaaaanaactcattggcttttatttttcttctaacgtgttccagaacacattcatgcttaaatttttatatttccctaantattaggtattntgaatttgtaatnttgttatcaggctcaattttcaagctgggtcttattaatttttagtatatgtgctgccnaggtg

SEQ ID NO: 539366 - DNA, 322 bp, Homo sapiens
cactgaatgaccgaggcgcctgtatcgcaggcaagccagctcccacatggaccgcgtccaggcaaagggcgctgtatttcatacgggacaaacaacaagggggcgaatcttcatccgccccctgtgtgtccgcttactcctgcggttcttcttcgtctgcggcagcgtcgagggttggctcgtcaacgttgtcatcgccagctgcgatcacctcgccttcaaattcctcaccttcgagctcttcaccttcgacttccgaaggctcctgcacacgctccaggccgaccagcttttcgtccttggccagcttgatcagggtcac

SEQ ID NO: 539367 - DNA, 1091 bp, Homo sapiens
gcaagttctcaccaggagtatgagtccatcgaggcctgggcagcagtgcacgtgggagaattgaaacctggaggtgaacaagcacacgaaccggtatgcgaatgtcatcggctacgaccactctcgagtcattgccttacgctctatcgatggcgtccccggcggagtgactacgatccaactgccaagctagcatcagatggctaccgaaagcagaatgcgctacatcgagcatggcaggtccccctgccccgaagaccatgggatgatgttctgggaggatggtgtgggaacagctgcaactgggctactgtgtgtcatgatgacacgagctggaggagaagtccctgggtacccaatgtgattcagtcactggccaggccgtgggtacctgaagacctgtggacttatgcagggtgacacctgtgggacaggggtggaactggcagatacacgtaggatcgcaagcttcctgcaccttccgacaacgaagttggctcccaagtgagaagaccgcgagctgcgtgtacgttcaccaggtcattgggctggccaagaaccatgggagtttccgtgaaagtaggctatggcccatacctggcctgtcctaacgacagggtcaaaggcttggaaccccctaagaagcatgggcccttgggtgggtcaccttgcaaccgcggggcgcaggggctgcccccggcttggttctccggggcttgatggccatgtcgtagcggacaacacacactaagaaagaggggaattgttgcgtcacgggacgtgcaatgcagcccacgaggacctcgtgggtggaaccgcgggaccaggcggcgacccacagaaagcgctagcggaggtgacacgccagggcgacacaggtaccgccgcgaggagggcaaacccgaaggggccaggccacacgggagaagtagcgccagccgaaacagcgggcaaccaacgccaggtcgggaaagcaccgccgacgagacaccgcggactcgccacaagcaggggtgccccagggagggcacaaacggaggaagcaggcaacacggagacgggcggagcacacacgcggacacaggcacaac

SEQ ID NO: 539368 - DNA, 445 bp, Homo sapiens
gcacgcgagcacggtgggagatgcctgagattgtaggctctcagcacatatttgttgctttttcctcccccctccccataccctccagtttgttgaaagtgatgcacatgaagagctcttgtttaatattccgcaaggatctccttgtggcctacactcaagctaaataggctgtacccaggtgcctcagaaggattcattcactggtgtcaagagcacacatttgcttctagaaatgggataaattactttggtgggtttgaggaggaaagcatcatatctttcttggtgccgactggaaacagatgtatttgtagaacaataactcggaaattgaggtagatttcttataattgtataatgctctaggtagacaggatcttagttatctagtacacggtgaccgatgagttaactggagcccatacacgggagggtcttgccc

SEQ ID NO: 539369 - DNA, 1097 bp, Homo sapiens
tggtgccgtttaccacctgggcttttaaccaattgcccgcattgcactagcccattgagaagccaccatgaaccaggttcccaacatgggtggaatgtagccttggtaccgccacaaggacgttggtttacgccttgtcgtgacgtctttgccaagattgcaaccaagttccaactccgacgaacttacccgtaaggttaccttggggttgtaaactcccaagggcgttttccccatccaccctgtccaagtgactcttatggggctccaaatggaacctacaatgggggctccctcctcccctagtgtaattgttcgcccttcccgctacttagaatagaaaccgtatcgagagcccttggtgcaatggtaattgccccttcggaatagagcgggcaacagccgttcaaaggacgtactgtcccagacgagcttcctacaagagctaagttccctggccagagcgctctatgcgtttgcctgcaactcgaaccccttactattgggggacggccaggcccctgtacgtgctatctgtaaatacgggcgtatgtaacattgcacgaaatacatgacgcgaggtctctagactcgggttcgcgcagacacatttcatttcgctccttaagccatttgctgggtttgcctctgcactggtccacacagctaccatgcgtagagactcgtccaattggtttacacctgaggccccgtgagcatcggagacacagtgagaagaggtgcaagacctgccctaaggtcgaagtgagagctattacgtggtcatgcgctgtctaggacctagcatgttcctcttcagcagcgtagacacccaacgtacctctgggctcatgacctccggtttgcacttcgtccctcccatgggacgaatgatgcctgaagggaacgggagtgaatatggtgtgcaagacaggaactcagggcctgattcaaccttcccttctccaggtggcctaaacaggagatagatagatagaagaagacaggctcgggctaagcggtaggatgcagtacaaccggcgctttagtcaaacagttgtgcccacctttggcaagatacggcccaggtgccaact

SEQ ID NO: 539370 - DNA, 225 bp, Homo sapiens
tgcctgccttcctcctccctcccgggtgggctgcccccttgcctgcctgcatgcagggttccagcaaagccagctttttcaaagccaggtggatcctgtttcggtcctgcctaggtgtgtgaccctgggggaatttacctttttcagcttttgcttccccctttattaaaatggggctgatgtcccagggttgtttttagatttaaaaatattaaaaaccgggga

SEQ ID NO: 539371 - DNA, 514 bp, Homo sapiens
ccccccggttttaatgggattccttttttgtttggagggaaaaggagggagggggggtttattatctttaatgcctttaaaaagggcccccttttgaagccttgggccctttcttttttctagggcggacccctcgaggctttttccttaaagggttggggggggaaaaaaaaaaattttaaggttgggcaggaggagttttttaaagaacccctggcccacaccctttctttttaaggaaagaacctttcgaggggttagggggggggtgttcccaaaaagtccctttttttttttaacccccccttttaaagggggggttttccggggtcccccccccctttcaggccctcccccctccccttttttaaaagggggccccccccttgggggttcagggtgggttgcccgggtttttttttcccttttgccaggggggtggggtttttttttttaatgttaattccttcccccttttcggccccctcccaaataaacactttttttaggggga

SEQ ID NO: 539372 - DNA, 368 bp, Homo sapiens
tatggaatagggaggcctgaagagaaaaagaggtggagaatagctggcctgtggagcagtcataacacatacagcatttgttgattaagttcaaggtcctatatgggtgtggtttgtctcacccaaaaacaattagaacagtaacaccaaagatcacagatcacagatcaccataacaaatataatgaaaataacacaactagacatgctttgagaattaccaaaatgtgattcagagacaaagtaagcatttgctactggaaaaatggtgctaacagacttgctttatgtaatgttgccaaaatgcttcaatttgtaaaaaacacaacatctgtggaatgcaataaagcaaaaaatactaaaacaaa

SEQ ID NO: 539373 - DNA, 668 bp, Homo sapiens
gggtatgttgaagataactaaggatttttctctttgggaggcatcaaaaggatggcagttggctttaatctttttatgttcattttctttaagtaggtgacctttctgcattaagaactgttttaatctttaactaccttttcttttctcctttggggagacagcatgacatgtcctgaaggtcaccttggcctttgaaaaaggtttgatgaaggaattcacaggtgactgccaggcctttgaaaagaatgggatctgttcacttctggcctttttggccgggacctcctgattggggttaagggggcaatttcccccatatcggatttagaatcactgagtttgcgctagatgaaattttgaaaattcctgcttgcttcattagactgatgaggtgcgttttcttcttcatatgaacagttagttaatatcagcaccgttttaactcagtgctcactacttaatttcccactgcaccacaagtgccttacctaaatgacctgaattttcctctcaaggttaagagtcctatctgccgtttccacggattttcctggacatgccatgttccggtcaataccctccagcgttgggaaatggccgtcactacgcgcaatcccaacttggggcaccgccttcattcacccccctttctttccttcggtcct

SEQ ID NO: 539374 - DNA, 293 bp, Homo sapiens
gtgtactgagatgaatcaggagtgcccataaattgatggcatagaaatacccaaacagttctgcgggtacaagtaagctggtcttcgccagaccttgctgatgtgcagagcttgcgagtaaagcattggttggtcccggaatcatcaagacagcaatcattgccaatacaaacagccaactctcaatcattgacatccaacaacagcattaaagatgcgcaatttagccgaaaaagagtggcttcctcaagtcaaagcggaaaaaaacacagaacccatgaggtagaaaagcg

SEQ ID NO: 539375 - DNA, 201 bp, Homo sapiens
ttttctctgatcgctcaaggcaggagttggagatcagcctggcatcatagtgagctcctggagaccctatctctacaaaaaaaaaaaaaaaaaatttagccagccaggggggaaagcccttgtagtcccaattaaccaattactcaggaggctgagggaggaggatcatggagcccaggagtttggaggcttgcagggagt

SEQ ID NO: 539376 - DNA, 140 bp, Homo sapiens
cacaggtgttatgatgctatatgaaacaagctcagtcaaagaactcaggaacacttaaaagttaagtcctttaagtcagattcagaaacaatctggcatacgaatcactctgaagtttctaactggtcatcctctgtata

SEQ ID NO: 539377 - DNA, 110 bp, Homo sapiens
ataggcctccgggttccttatttccggattttcccttggcgccggtgtgacggctcaggtgtatgccctcatcgagtaccttacccgtggtacctccgctgagtctcata

SEQ ID NO: 539378 - DNA, 95 bp, Homo sapiens
  misc_feature (34)..(34): n is a, c, g, or t
  misc_feature (89)..(89): n is a, c, g, or t
taaccaacccaaggagggtaagtgcacccagcanccacccagccatgtgatgggtggggtgcctctcattgggggcggccactaccacngccccg

SEQ ID NO: 539379 - DNA, 107 bp, Homo sapiens
taaaaagaaatagggcctttaatggaagagtttccccttgggtatataagtgagcaccgggggaaccttccaacacgagcaaaggggggccaggtatgaacacaggg

SEQ ID NO: 539380 - DNA, 159 bp, Homo sapiens
ttcccttacaaggagaccagtgtactattgaaccaacaggatatctatttttattatttagcatgagttaatcctacaaacacaaattaaatacctcttttataaaacatctttatccagtgttctcaattgcatggcagcatgcggatccactccatc

SEQ ID NO: 539381 - DNA, 134 bp, Homo sapiens
  misc_feature (47)..(48): n is a, c, g, or t
  misc_feature (80)..(81): n is a, c, g, or t
  misc_feature (91)..(91): n is a, c, g, or t
  misc_feature (97)..(97): n is a, c, g, or t
  misc_feature (110)..(112): n is a, c, g, or t
  misc_feature (114)..(116): n is a, c, g, or t
  misc_feature (119)..(119): n is a, c, g, or t
  misc_feature (123)..(124): n is a, c, g, or t
  misc_feature (130)..(130): n is a, c, g, or t
ggcccctttttccccggggggcccccccctttggggggcccccgggnnttttttccccccccccccccccccccccgggnnttttttttgntttggnggggggggggggnnntnnnaangggnntttttnccca

SEQ ID NO: 539382 - DNA, 1037 bp, Homo sapiens
agcggcctttccttaccttcaggtcaggagccggatccgcgtgtgtgtgtgtccgctcgccctctgctccgtaccggcggttgcccactgccctcctacggtgccaccatgggcctgactggacaactctggagcgacgttccgtcccaacgtgagatctgcaccaggcgccgttcctaccctgtggcgcgctcaggccacaggcggacgggacttactgccggagaagccaccatgcttcgcgtggttgggaacccgagtgatggagaatggggaactgctccgatgatcgcgcaagtgtctaggtgaaggtcgagcatgaatacgcctttagagagagagacaatgcaatagtcacttaatgaagtatggagatctggcgaatgcttggatgcacatgaccgcggcatgcatgaatggaaacaagccttcacgatgactgtgcctacgcgcgtacgcgacaagggctagcacaggcccgagaatttgcgcgcctggagaaaatgttcgggacaatggtaactaagcgtgacgcgatatggtgggactgcgggtgagacttgttgggcaacggtatagtcgtgccagtaacctacgaacctgcgtgtgatgatatcagggtaaggtcctctgtacatgatgagggatcggggttgtgtgcatcatgattgcatgaactaaacttctacgtggggaaagcttgggaaggacactataaaaggattgctgggaagcaccaaggttggttcctggacatagatgacatttagtaaaaatgttttgaaagtccgtaaggagtgatctgtacatcttggacgcgaaaaatatgcaataaacaatgaggtagtaaaaaggcgagtgcaacgaacatgcgacatcgttttcgagagtgaaattgacgatgggactgttgtctgtcgattaacatggagggtagatttcgggtatattttaagttgaacaccccaaaggaaaatttgacgtgggtttgtatgaaccttctacagaagaggcgtcgttgattggaacgggtgaat

SEQ ID NO: 539383 - DNA, 168 bp, Homo sapiens
tcacactggttgttgatataatccccttccaaagcgtgagccatcatatctggcctgtatattgaattttaaaaactcaacagaagtaggatgattaagagtagggcttccagtgaaagggattatatcaacaaccagtatgagggattatatcaacaaccagtgtga

SEQ ID NO: 539384 - DNA, 144 bp, Homo sapiens
tggacttcccgggggaagtgccctggagtaagctgccattcttctgtatcaatgttatcagttatgctttatactccagtcacctggttttgcatttgattcctagtctgtatcttgttttgtattttctccccggaagttcca

SEQ ID NO: 539385 - DNA, 875 bp, Homo sapiens
  misc_feature (133)..(133): n is a, c, g, or t
caacagagagatgtggaaagagctaaagaaaccaccctttgttcccaactccactttacccatacttttactgcaaccacaaacactgtcccttccggcgctccctcttcttacagcatggcacctctctganaaccaattatcgatattccacgctttttcagccctcagcgttaccaagcataaactactactgtatatactaacccttctattactctgctactactctttgtgcgcactaactaccattcagcgctgcgctgctgggctgactccactctataactctcgaaccctaggctatcatccctctcgcgtcttcccacagctcatgcttgagcgtgggcctccctggctatggtcacaacagccagcgctactaactgtaaccttcagccccagccctttgtacctaacgctcttgatagctggatatactctttctaagctctagccccaatactagggtaactggaacatttccctgccctctgggttcccccactcttctactcatccacgacagaccagctgcatacatccacctcaatgccaccaacctcctgcgccttcagctcaacgctgagcagctgtgcaacctgtgctgcgcccagacgagccctccacacccctcccctagggtgccagaggacgcccagggccctttactgtctaagcaattcattgcaccttgaacaaggcaaaccccttaatcctcgccaaagcgacgagtcaagcccagtcgattcatacccgggtcactccttggaatgggaatccccctttgacaaacttccacctccaagggcaagacccgctataaaactccaagcctcgcacgcctgcctgaaacagcaacctaacacccccat

SEQ ID NO: 539386 - DNA, 971 bp, Homo sapiens
ctttgacgaggatggagatggcacttatcaccaccaaggtagttgtggtgactagtgatgatgatccctgggtacagaatccccactgaagcagagctgcgtggatatgatcaatgaggtggatgcacgatgggaacgggaccattatgacttctcacggcagtttcctgtaccatgatggaccagaacacatgaaggactacagacagtgaggaggagatccgagtaggcgttccgtgtctttgacaaggatgggaatggctacatctagtgccgcagagtctgcgtcacgtaatgacgaacctgggggagaagctgaccgatgaggaggtggatgccgatgatcagggaggctgagatcgatggagatggccaggtcaattatggaagagttagtacagatgatagactgcaaagatgacatggccccctcggagcagattggtcgatgaccacgttcctacattgatctcgtactcattctcagcagacgcgcacgtctctcttcaacgatcccctggtgtaccccaggttactagtcaaaccaccaattgatagactgaggacatctgcataaaagcaacaaaagattagtaccacaagactggcttgatagcatctatatctccattcttcaccatgaagtctctctaccatgcacacatcatactacttccattatagcacctcgaccatctatacagtaccacgtcgtatccataggccttgactgacatacataacgttgaacgacacagttccccacaagcagtcgcacaatagggaaggaaagacttaatgacccgcttacgtccaagaaccaggaataggatacatccatttcaaatataggagtaggatatacctacaaggtattggtcactctcatataatgagatacgccgaaagtaggctagcaaagcagatacccgggggaccaagaatgaaaagggacaaaaaggtcctttaac

SEQ ID NO: 539387 - DNA, 135 bp, Homo sapiens
tggtgggtcgttctgtgggcgaaaaagcatcgctcactaccacaagctgggcatcgaaccgatgagcaagaccctggtgtctccgacagtctgacattgcccaaagccttggaaatattccgggcgttgcgcggt

SEQ ID NO: 539388 - DNA, 106 bp, Homo sapiens
  misc_feature (63)..(63): n is a, c, g, or t
  misc_feature (70)..(70): n is a, c, g, or t
ctagaggatccttttgggtgctttcatcataggctggagctgaggaggaaaaatgattcatgncctgganccatggaccccttgctgtttgcagccagtgacttgg

SEQ ID NO: 539389 - DNA, 168 bp, Homo sapiens
gcggccgactactactactactgctcgaattcaagcttctaacgatgtacggggacatgggggtggctggacaggcttgttggagtcgtataatgcaatgaataaaaacttacggctgccttaaatgcaaatgtcaagcccttaaataaaatttaacaaagtcaaaaa

SEQ ID NO: 539390 - DNA, 1003 bp, Homo sapiens
gtttgagatgtgcgtgctaccggcttaggagtgcataactgtcgttggtgtggatgtactgtcgtgagtttaaaggggatagactttgctgtagagtaccgggaccccttgatgtcctgactgatgatgtgcggaggagtgtcctcgatgttccttggcgaggcgggacaccacgtttatggtgcgaaaacctcatctccttgatttctatgtatgcaggcagaacacggtttatgccccgtgagactagttgcttgagcattcgattgtcaatataatactcaaaagaggatcctgctgggagagcatgcgattgctgcgcgagtgcaggtgctttggtgagctactctagagaaaggtactgtctcgatggtcacgtgttatgaatccttccggtggagtttctggcacaaggaagggctgtgcgtggcacgacttgcttgatgtctatttgcgaagccaatctacatatgtgaggtcagtatattagtccatgtgactttattatataaacccagatcacgaggctagtccttactcgggtagccaatggttgtcatccgtgcgttaatgagcactctggttatgaccaacttcctctcatggatgacttgtctatgttaatctgtctgagcaagttgctgctgttgttaaccactaaggatttgtctcgtgggcttattgtgagactaatgggccagtcccatgcatctatacataggtagctcactcaccggggtttgtgttcggtggtatgctgcttcggagaagctctgctccgtgctgtggcaacgcattgtcgtgttctcccatgggatggtgatgtgcgatctggacctttccggaggatcggtctccactttccactcactctccgtggtgttgttggcatctggcgcgccgggggactgtccgggggctggaggcccgcttactgttgtgttctctgtgttgccctgcgggggggtggggcctcgggcatgcatcttggaggggcccttcg

SEQ ID NO: 539391 - DNA, 245 bp, Homo sapiens
aggccgaggcgggtgcatcctttgagcccaggagtttgagaccagtctgagcaacatagcaagacctggtctgtacaaaaaattagccaggtatggtggcatgtgcctgtggtcacagctactctgggcactgagggggcaggatcacttgagcccaggcttgagcccagtgagctatgatggcaccactgactgcaccccagcctgggtgacagaatgagaccctgtcggtctcacgaattccg

SEQ ID NO: 539392 - DNA, 248 bp, Homo sapiens
agtatgggccagaaattatatctccctttggcgtggtggggtgagatgtacagctattattgagatatcattcctgtaccatacaattcacttaaagtgtacgagtcagcggttcttacgttctattcacaacaattgtgcaactatcacctgataaattttagaacttactctattccttcaaaaactcttatcttcacaaacaaccattagctgtcataccctgaaaatatctgtgcccattacaa

SEQ ID NO: 539393 - DNA, 936 bp, Homo sapiens
tcattttgtagtcggtggttttacatgtatttggtatttcatactatcagtttttaaattcttggcctttgatgttgatgaaatttcgggagtcataatgctttgccccctattgtctgtttgtagtcaattctcttgcaatatgctctgtaatccaaggtggggttacttggtcgtgtttccagcattcatcagtagcttatggtcagtgggcagtagtatttttaaattaggataactaagccttatgcatgtagaggcagatgctcagagaagttatcagggtagtctatcatgttttacaacagatttgtggaactcttctcatagcacattgtgttggtcagggcctagtctgctacaaagtgtgaatatgttttagtacttatactcatgtgtatgggcttatatactctcgagttggactgtatattgtgatctatattgtattcacaggttattttagtttctgttctgtggtaagtttaagcattccacaaagggtttttttgtagttttttttttcgcaccccatgctgcttgatttgctaaattcggtcacagtctgatacgatgacgctgttatatgtatgtcttttttttaatgtgctgtgtcaagattagtctactcataagccatcttggtaaatttccccaacagtgtgaagatagaattccttcagggtgatgccaggttctatttgggatttatatacaacctgcctttgggtggagaagccattgtcttcggaaaccttggctgtagatctgaagcgtgtatagtctactgttgtgactctgaagttcacctagttaaaagggacttacccatagccaaatcatggatatggttataaaagtgattgttggcacatcctatgcaatatatctagatagtgtatcatggtaccagataataacatagaggggatgaag

SEQ ID NO: 539394 - DNA, 438 bp, Homo sapiens
atcgcccaccactcaggcctggactaccagtcatagcctaagataagccattagcttaacaacaagctgatcaggacataggctgatctcttagcgatgaatctatcccccgtagggagtatcttggtattaatcatctgtctccacatggctatccctacactaatgaggcacactgacctatgcggtgactcacccggtacgccgactaactccagacattcgtagcaagcctagacagcttcatcgatacgacgtctgcatgctacttaggcacgccgccccgcgtttcacatctcagccagtgatcaaacctctccactaacaaggagacctccacgactccgggggaatccctctctagaagctcgaaccgtgcatgcgcagtgcaagcgtctggcacctggccgatcgcttcttacaaacgctctgctgacc

SEQ ID NO: 539395 - DNA, 127 bp, Homo sapiens
gaccagcaacaggctggggctaggcagctgacaggaccagagtcagggcaagggccagagcagtgcaaggccaggtagggcaggcatttcaggatcagggccagtggagaaccagggcaagttctca

SEQ ID NO: 539396 - DNA, 1324 bp, Homo sapiens
  misc_feature (885)..(885): n is a, c, g, or t
tcacggtttcagtttgccctgtgtgctgtatctctttaggtcggtgtgtgtggtctctttgtaattcgctattgtgtcatctcgttaaaggtcttcggctactggccattgtctttgtcagacgtaatgttgtcgcctttaatgtatctctgtcatgttttctaggcttcatagtgccgattcaacgcgactggctctgtctcatgccctaggaccgcttgcgggggtcggtgtatcaatagtggtccatgcatcctggataccggttcagtggtctattcttggggcagtgccgcaggtcatgaagaagtgtctggtcaggagtaccctagctgtgagtcgcattcttgtctgatgacgtcaacgtcctgtcgatggaactctgccgttccacgttttgcatcatgatcgctgacctgtgcactgctgcgtcgtctgctgcgggtacgtctgcgataatattgctgctctgattagtgtgagagtacgtggccatggatgtagggaaccgcctgtcagcagtcacttggtttatcatgatctcgacgtcaggttacttgtcatcttatgtctagacaactatgaacacgggactatcgggcatggtgccatgccgaggaactctgcattgctgtcgctcgtctgtctctcatatgacgatgtgctgtcactgggtctattgccaagtatatgtatgcataggtcctgagtctatggcatatgacatgtgtataactgagattccaggacggatctcgagaatgcgcgagtcttagtggagtcagactctctcaagaaggctacaggatatataagtagtagatacgataggatgatatgatgcaatagattgcatgaatgtaatatagctgcagtatcgcgtgnattgtcgagccccgatgcttattagttaaatatagtagacgtgtaccgagatcgaagctattctgtggtgagcacaaacgtctgccgcatggggacttgcactaccaatgtgttactctgtatcctcagatgcctctcgcgagacttgcgtatgtgttactgaagctctatgacgataagcatgaaatctccttatcttattgtgcacgatgcgtcggttgacactgaaagcgttatctctctctgtccatgtgtattattagaaatacgtaacgttctaaagagtctggcacaaagtggtgagtaaaattcctatatggtttgggagcaatactttctgcatagtggcctggtccaatggcctgtgtgttacaatgaaatgatcagctctcaagaatgagtcccttgtataacctccttttatacttctagactaacc

SEQ ID NO: 539397 - DNA, 464 bp, Homo sapiens
  misc_feature (114)..(114): n is a, c, g, or t
ttggaaatcctactgatttgaggaatcacttgtttagtaaagagagaaccggggtagtgagggtcaagacaaataaggtctgtccccatgctaaaatgctagtaatcacttctngatcctctgggcctagcacattaccaagcacatagtaagggctgagtaaatatttgtgaaatatataaatgaatagattttctgcccagcctcaagacctgctggaatacaacttgtatgcctaactccctttttttcccacccttcaagctaaacatttctgtgaccataaatgtgacttcagcattccttactgctgaatagatgagaaacatgtaccactgcagatgaatgaacacatggtctatccccacctgttctagttcatctctttaaatgctttccttactgttgaagggactgctatggtctgttaaaaaataataataataataaaataaaaaatttta

SEQ ID NO: 539398 - DNA, 124 bp, Homo sapiens
gctgcaccgttgttttgagctcggactgtcgagaagacgaggttcaggtaagcagctgttaaagcccagacacttgaggttcaaagccctttagtactttttaatgatcgttgactaaattcct

SEQ ID NO: 539399 - DNA, 401 bp, Homo sapiens
gaaattcatttccagatcctcaacttccagatgtactccacctgagaaagttcctggggttgaggctccaagccgactttttcttcataattgtagttctgctagtcttcataagaaaggccgggctgtggtcgtcgcgcctgtgatcccagcgctttggggggcggaggtgagtggatcacctgaggtcgggacttcaatgccagcctggccaacatggtgaagccctgtctctactaaaaatgcagaaattggtcgggcacagtgcacgtgccagtggtcgcagctgctggggaggctgaggcgggaggatcgcttgggccctggaggtggaggttgcggtgggccgagatcgcgccattgctctctagcctgggcaggagtgagatccgtctcagaga

SEQ ID NO: 539400 - DNA, 259 bp, Homo sapiens
agctagtatcggtcagagccagcaagagggtctggccagggcgaaggaatgacagtatgaccatagttttcaggatacagtgtcagaaggccagagcacacagacaaatttacgttgaccttccctgtctatgattggccaaccacccgcttaaggtcgcgtacgtacatggtgtggtgcaggtaaaccatttggagcatttcagcgagcgaagtaacgcccagagccggatgacggccgcgtttatgcagtacagccg

SEQ ID NO: 539401 - DNA, 471 bp, Homo sapiens
atagcctacaactgagctcaccacaggccctccccagctcaacccattaaagacccaggccctgtcaaaaaaaaaaaaaaaaaaaaaaaaaaaggaaaaaaaaaaaaaaaaaaaaaaaaaaaaaaaaggggggggcccccggggcccccgaaaaaaatcccaaaaaaacccgcgcgggggggcgcgcggggcccccaagagagagaagagggagaaagaggggccaaaagggggaccccaagggagaaacaccgcggggcgaacaacacacgggcggggggaacccacacacacacacaaaaacaacaccccgcgggggcaaacacgggcagggtttggcgaaaaagaccccagaagggggagtctggaggagggttattgtggggggactactttctaaaccgggcgccctcccacaacggaacggccggaatattaaacattattcgcccccccgccgcggggggttaa

SEQ ID NO: 539402 - DNA, 1067 bp, Homo sapiens
gggcgaaaaatgtcttaagcagtggggaacctgccatcctacccttgacccctcagcctgccacaggccccgtacacacacagcacacatcacatcgacagcacacactagcacacacagggatagtgcacacgcagagacatgaggaggagcaatagcatagtgcgtgcgccgtcagaggactacgtagattctttccacacgataatcggtacgagtgatgtatcacaaaggggaggatgattggcaccgaggccgatgagaaggaagcacgcggcattgatgcaagtagtagtggatgatagctgctgttcgacgagatggatccccaacgatgaagcgcagacgaagaaacaaaaaggacagcgcgtgaaggaatgcccacgcacgatcgatatacatacaaccaaacgagaagacagagggacgtccgacacaatagacacacaagggggagcgtgcatacaccaggttgagcaaaggtgaacgaaaagaatacaaccactacaaaagcaaaacagtaagcaggaacaaagaaaacgatccatagaaagcaacaacagagagagccacacgaccaaaaacaacgaacgaagtgagaaggacaccaaagcaatacgaagagcagaagaccgacgaactatccaaacatagacaagagcactagaaccacgcaccacggacacaataccatagaaagacgggcactaaggcaagatatgagcacgatagaacatccggagcacagactcacatagaccacagcgaagtgagaaggcaagcaacgaactcaacacacagagacaaaaccgcccaccatgctcaatccggagcaaccaatgcatcatgcgaaacaatgccataccaaccacacgccagcaccaaagcaagggggcgcaggagagggccccaggcggacagcaaccagaacatgcgacccgtgaccaccccacagacactagaacagactaggcaaacacccccagatgacaacacactccaacaagatgcgaacgactggggacacaagagcatagaagcgtgaggacaatgacaacacacaacac

SEQ ID NO: 539403 - DNA, 206 bp, Homo sapiens
gtgcatgccattacggggtcccagaccccggcagcgggtaccctgattgaccatgcatgggccggggcgcagagtgccatggggcgggcctctcttatacacagcagattcctccttatggacaacaaggcccccgggggtatggtcaacagggccagattccatattacaaccagcaaagtcttcaccctcagcagcagcagcca

SEQ ID NO: 539404 - DNA, 209 bp, Homo sapiens
ctcgtgggttcttcctcaggtaggcagctcctccttcaggccttcgatctggcatctccaggtcagtccgggccagggtcgagtcatccaacacccgggcgcaggccatggacggtcggcctccgcagtctggccgcggggccagttcggtgctcatacgttggtcctggaagtcatcgggctggccagcctgggctatggtcaatctg

SEQ ID NO: 539405 - DNA, 303 bp, Homo sapiens
gggtttcaaggggcttttcattgggtttttcagggaaattccccgaaatagaaaaaataaattgtccctttttttaatccccccctggggaagggaaactgtttaaagccagcaaaggggaaacattgtcccccccaagggaaaacccttttcccgaaactgttgtttaaaaaacagggggttccccctttttagaaaaatattttgttttttttattttttggggaaacaacgggttgtttttatatatgggggccttgtgaaattttttaatcaagtaaataaacatgtttgtccccccca

SEQ ID NO: 539406 - DNA, 610 bp, Homo sapiens
  misc_feature (39)..(39): n is a, c, g, or t
  misc_feature (43)..(44): n is a, c, g, or t
  misc_feature (81)..(81): n is a, c, g, or t
  misc_feature (96)..(96): n is a, c, g, or t
  misc_feature (102)..(102): n is a, c, g, or t
  misc_feature (182)..(182): n is a, c, g, or t
  misc_feature (184)..(184): n is a, c, g, or t
  misc_feature (196)..(196): n is a, c, g, or t
  misc_feature (203)..(203): n is a, c, g, or t
  misc_feature (222)..(222): n is a, c, g, or t
  misc_feature (609)..(609): n is a, c, g, or t
gcgcaaaatggcggcggcgatgaccttctgccggctgcntgannaccggtgtggcgaggcgtgcgctggatgcctgccccntggtgctgcccattngtgttntacggggtttgctgggtcatcagaccgaccacgggggacacgaaagggtccaactgccaaacccaccttgggcccccagngntttttaaatggncatttgnattacaaaacaagggaccnttaaacccaaggggggcacgggcacaacttttcccgcgggggcttttctgggcttaaaagggggaattcctgggccttcctaaggccaacaacaccggcaccggggggttgtgcaaaacccttgtgcacaaaccagaagccgcgttttttttgtgggccccccaaaatttttctgtggcaacacgttctttgtgtgcgaaatcttttaaacggggccccaaaccggacaaagggccccctaaagggggccccccccccctgtggggtgtttgggcagaaaaggggcccccggggacacacacggcggagggtctgtggggcgggcggccacacacgggccacaaacccattttttccccccagggggcagcggacggggattttcgng

SEQ ID NO: 539407 - DNA, 776 bp, Homo sapiens
tgcacacatcagaaagccaaagcgatcggtgctcccagatcccgcagcctctgtgtagtagagggggacggcatgatgaaagtcacctaggccggggcacccgcgagaaccctctgtgaccttccgtcggccctctctgctacacatcctcaagtgaccccgcacggcgagacgcgggtggcggcagggtcgtcccagcgggtgcggcaccgcggctccatgtccttggaaataacttaggcaaagttctaaaggtctcaaaaggagcaaagttaacaccgtggtaggacatacgtaacaagggttgttattcttgtctttccagccagtcctgctggtctcccatagagagaggtccttttcagttgagactctgcttaagagaagatccaaagttaaagctctggtggtcacgcgggaggggccgggcggcagagaaactacctctggacttaacttcttttaaggccacggtaggcaactttcttgagggatacggtggtaccctgacatccctgtggccttgcccgatgggctctgctggtcttctctgagtcacagctgcgcacgtgatgggggctggggccccaggcgtctagctctcccatgagggacagctgagcccccttgccttggctccaggttggtagaagcagccgaagggctcctgcaccgtggccaggcaccccctgggtcccccaggcctgcacgatgtttctatgaggggcagagctcctggtacatccatgtgtggctctgtccacccctgtgcagcc

SEQ ID NO: 539408 - DNA, 165 bp, Homo sapiens
aacaacttcgtccaccctgagctcgtccacccggacttgaataagtgtatggtccctcggcgtgtgcatgcacacgccgagggcccaaactacatcatgtggaggtctgtgtggacgaagttgttgcaggtcactatggagtctggatcttcggcgtgtgcagga

SEQ ID NO: 539409 - DNA, 270 bp, Homo sapiens
taaatggctccctttgtagaacttgaacccagtcggaaataggggtttttggtagaaaatatagttccttggttttatataatgataataaaatgtgtttgattagaatgaaatctccgagattttttttttttgttttgtctattccatttttttagaataggccctggcccatagaaaatactcaaatttttaaaaaataactaactaatagggcaagcatagtattttcccctaacaaaatgaataaatccaactgttttgatccca

SEQ ID NO: 539410 - DNA, 576 bp, Homo sapiens
  misc_feature (30)..(30): n is a, c, g, or t
  misc_feature (34)..(34): n is a, c, g, or t
  misc_feature (44)..(44): n is a, c, g, or t
  misc_feature (64)..(64): n is a, c, g, or t
  misc_feature (75)..(76): n is a, c, g, or t
attcggctcacggcgcgctgcgggcccgcnctgnaggactgtgnctgcgcgcaggacgagaacngcaagtccacnnagcgcgccattgagccgtgcctgccccggacgagcggcggcggcgcgggcggccccggcgcgggcggggtcatgggctgcaccgaggcccggcggcgctgcgaccgcgacagccgctgcaacctggcgctgagccgctacctgacctactgcggcaaagtcttcaacgggctgcgctgcacggacgaatgccgcaccgtcattgaggacatgctggctatgcccaaggcggcgctgctcaacgactgcgtgtgcgacggcctcgagcggcccatctgcgagtcggtcaaggagaacatggcccgcctgtgcttcggcgccgagctgggcaacggccccggcagcagcggctcggacgggggcctggacgactactacgatgaggactacgatgacgagcagcgcaccgggggcgcgggtggtgagcagccgctggacgacgacgacggcgtcccgcacccaccgcgcccgggcagcggcgctgctgcatcgggcggccgc

SEQ ID NO: 539411 - DNA, 125 bp, Homo sapiens
cggggggtttggctgatgacacttgtggcgccaacgcaagcagtcccgggactcgtgtcggatgccttcgagagtggtggctgacgccttctttagtgatgctctctgggaagctctcaatcccc

SEQ ID NO: 539412 - DNA, 333 bp, Homo sapiens
gctcgacaaatcaaaaggagtctgtgtgtggtggcgcgtgcctgtgatcccagcactttggaaggccaaggtggaaggactgtttgaagccaggtgtttgagaccagcctgggcaacacagtgagaccctatctcttcaaagaaaaaaaaaaaattagccgggcgtggtggcgggtgcctgtggcccttgctactgacagggctgaggcgggaggatgtcttgagcccaggagttgggctgcagtgagctgtgattgtaccactgcactccagcccaggcgacagagggtgaccctgtgtacaaacaaacaaaagaatagtattttgtgaccc

SEQ ID NO: 539413 - DNA, 149 bp, Homo sapiens
atattcactgcactttgattagtgattaacacgacgagaaaccattgttcctcctgagagaatactctggtcctcttggtgtctcctttccaagatcaccttcgtttcttcctgtcttaccgacttctcagcttgagtaaattaagccc

SEQ ID NO: 539414 - DNA, 127 bp, Homo sapiens
caacttaacactgtatatatggacaagtatcatatatctcattgaaaagtatagtagggctggaataccgtatacaatgcagatagagctagaaatgagaactctctaaatagtgaaggcctactta

SEQ ID NO: 539415 - DNA, 293 bp, Homo sapiens
cagaatagacccttgtggcaataacaaattattcgtaagatctaaggtcatgccagcgcaagtgttatgtcatgcactcctacacttaaagaataaactatgttctaactgccacaagattttctatttatttatttatttattttttagacagagtcttgctctgtctcccaggctggagtgcagtggcatgatcttggctcagctcactgcaacctccaactccctggttcaagggattctcctgcctcagcctgtctagtagctggaattacaggcatgcgctgccatgc

SEQ ID NO: 539416 - DNA, 850 bp, Homo sapiens
ggcggtgatgaattgggacgcaggcgcgagccaaggaccattccccctggaagacatgagaccataggggacctgttgggtgcctcaggataggcgctcccaaggtgtgattgaggcaggatgacctggacgtgtttgtacaccttgctcagtggcgtgaaccgggcatccatacgtgccatggccgagttatggctctcggcaatcttcatcttccagacatcatggtgctggtggtggctgcagagagtgtgtggggtgatgaagacaatcttccccttcattctgcaacacactccagccggttgcaaccagggttgtgcttatgaccaatttctttcccacatctccatgtgcggttgtggtccctgcagctcatcctagtttccaccccagctctctttggtggccaatgcacgttgctcaccagcacacatagagacggaaaatgctacggttgagggcatggggaccccttacactgtgggacggtgacgaggcccaggtcacttcggggacctgtggtggccctagttccatcaggggtgggtgtccggctgtggttgcggccgctacctgtttgtcttatctgctcaacactggctatgcagtggtgcggtggacaaaggcgcgttacccttgcccaaaaaggggaatggttggtccgccaacagaaaacggttcacgcttatagaacagccttggattggacaacccaagtgcggaggtggcacaaccgggcggccgagaccaggcgcaaacactccgaagaggtcgaccggtcatataaagaagaaacctggggaggctaaaatgcgccggggaacgcggaaacaccaagctcggttgg

SEQ ID NO: 539417 - DNA, 547 bp, Homo sapiens
tttactggtacgggagtggtgcgcctgtattaccatctacttgggaggccgaggcatgagaatggcttgaacctgggaggcggaggttgcagtgagccaagatcacaccactgcactccagcctgggtgacagagcaagactaaaacttaaaaaaaaaaaaatcccaaaataaaaaagtttttttaaaaaaagtgtgcgtatagtgctgtgcgcaagtggctcacgccttataatcccagcacttggggaggctgaggcaggaggatcacaaggtcaggagttcaataccagcctggccaacatggtgaaactacgtctgaaaaaaataaaaaaagttggaatttggatgggaaaaagtaacacttcataagggaacgttttagttggtatggatttcaatttggccaactttctagcatgtccaggattctcccagtagcttctcagacagcatatcagcttcggtaagctactattcagacaatggcttttcataatcagcaatcaaaatggtacttttctgtaaaagctgttacaatattcttg

SEQ ID NO: 539418 - DNA, 927 bp, Homo sapiens
gatcctgcgtgagttcaaggtcacggcatgcccgggatgggcagtcaaggacaatccgtgcagttccatgttcacatgactgtggccagatgcagggcagtgcccaagacaggcgacgggattcattgacttcatcgggcaggtgcataagaccaaggagcagtttggacaggatgcggcctatcacggctgctactgcagtgctggcgtggcgccgcaccggggtgtacatcacgtctgagcatcgtcctggagcgcatgcgctatgagggcgtggtcagacatgtcccagaccgtgaagaccctgcgtacacagcgtcctgccatggtgcagacaagagtgaccagtatcagctgtagctacctgtgcggacctaggtagtacctctggcacgcttttgaccactatgcaacgtatctaaccgtcccctctcctccgcacagacccacagccgtggggctccggaggggacccagctcctctgagccatagcggaccatcggtacagtcctcctacgcagatgctgtacactggcagaagccatcgtgcccacggggatcacagcgtctcaaggaacgtcgccataccaatcagagagccttagaacatcccttggagcaagctgggatggccccagccaggcatggcacctgatggcccttctgtccaccagagccacctgggagcccgcttcaagctctctgttgcgctccggattctcatgcttcttctcatgggctgggagataggcggcaaaagcttccgttctcacttccttaacctgggcttacacctgagggcattgtaggccacttccctctgattgtgccatcccgggaacgcgcatcttcagcaaggggcactcgaagggttggcgactctataccgtttgattcctagatcttgaaatttcactggtgaacca

SEQ ID NO: 539419 - DNA, 796 bp, Homo sapiens
gaccggggaagaatatacaatataccttatctctcttaccccattttactcaagtccatgccctatgggaaatatcctgctgcgtttatgtacttctcagtaaaacatgagtaagtgtcctattataagtgataggaaaggaaaagacttacatattgcagttttacaataagagaatgtgatactgcaacagccactgggcctaaagtaatcacattgatgaacatagcagataacactgaagacaaacaaaagcttaatattaacatcccaataatcatctgctttccagagaactaaaaactgacaagcacttgcagtgagttgaagataacttacaaacctgatgcagcatgagcacacttgtgtcatccaatttcagctggggccacacaacttcagtataagaggggataattaacaaaacaaaaaaggtatttctgttaaaggcagttagaagacatgaaaaacaagataataggccacagccatctttctttaacccatttcattaaaaaaactatgattggtatgtcttcttttgagaaacaactattccaggtcttttgcccatttttaatagagtcatacgtttcctggtggcttgggtgttatatatttgaatcttatccccttgtacaagtatggtttacaatatgtgtccaaccggggggtggcgtttggccaggtactattctttggtgggatagcttgtaataagcagcggctgggaatcgggatggcgtggggggaaacaccaaactggcagacacgttcgggtctcaatgtcgcgttt

SEQ ID NO: 539420 - DNA, 169 bp, Homo sapiens
cagctgaacagcaacatttggtggacgtaaactgggtcggtccatagttgtcatcatttgtttccttttctcttttttcctgatccccagctgcctgcaggctgggaaatacttgctgaaactgactattcactatggattccatctaccttgcccacacttgcttgtt

SEQ ID NO: 539421 - DNA, 383 bp, Homo sapiens
  misc_feature (178)..(178): n is a, c, g, or t
  misc_feature (233)..(233): n is a, c, g, or t
  misc_feature (290)..(290): n is a, c, g, or t
  misc_feature (354)..(354): n is a, c, g, or t
attcaacctagctcagacaaaaaggggattcttgaaaactatacagggatcctgacaggaaatgaaggacagttgggtcaccaggaaaggtagctggaagatccaatgtcagagctcctccctgtgccctactagggtgagaggaaggtgagggaggaaaggctggttgtccatctgnccctcccagcaccccagcttttcctgcataactcatgacctctcttccccacttngcttacacaagacagtggatttccatagtgcccacttggattcccatcccatgaggncctgcagctcagctcctctcaactggctcatgtctgtgtctcttggtcaaacaaatgggacagnctgagctctagcttggttccaccaggtct

SEQ ID NO: 539422 - DNA, 398 bp, Homo sapiens
tcacaatgctgttatcttttgtaaagtggacataagagtagttatattttttgaattagcgcaagtggtcaaacggtgtcaaaattgtcctcattcctcgattgtctcttttttaccatgtctcttgcccttcaaacagaggatacctggcgtccatatcagcccatgtgatgttgccattggctaggtcttggactatgctgggcagctcagagatctctgctcttatctgccgcattgagtcccggtccctcagatttgccgtgtggggggtcttgttcactgtgtcacagtccttgttgacacctgaagccacgccaatctcatcagtcctggcatagcgccttccgattgacccagaggaatcgtctactttgtgagatactccatgcttagtc

SEQ ID NO: 539423 - DNA, 817 bp, Homo sapiens
  misc_feature (646)..(646): n is a, c, g, or t
  misc_feature (722)..(722): n is a, c, g, or t
actgaagtgagcccagaaatgtatagtatgctatttagtgtaaaactcaccaataccagtgcctctgcttccaaggagatagacttattttagttaagggactactcattatctttctgatctttcccaggaaccaagagctggaaacgcttaagccacgtggcttggtgcttcaatgctgtggggcaaaagaacagatcttctgggactagaaaaaggaacagtgtgtcaggctggtgcggtggctcatgcctgtaatcccggcactttgggcgaggcgggtggatcacgagctcaggagatcgagaccatcctgctaacacggtgaaagcccatctctactaaaaatacaaaaaattagctgggcgtggtggcgggcgctgtagtcccagctactcgggaggctgagccaggagaatgggtgaacccgggaggcggagtttgcagtgagggagatggtgcatgaatcagctgagcaacagagtgagactgtcggaaaaaaaaaaaaaaaaaaaaaaaaaaaaatttgggggggcggagaaaaattttaaacccttttggtgggggccgggaccagatatggtaatgaaatggggcaaaactggcgccaaagaaccggccggcacgggtggttccactaaaaagngcggggcgcgggttcgcacaaccaaggttcgcgtcaggtccaaccggggcccggtgctacccccctccgcgggggnaaaagacagagaaaagcaaaggagaccaaagacacgacgacaaagaaccaacggagcagagcgaacgaaaaagagcacagaagagagcgcgacgc

SEQ ID NO: 539424 - DNA, 285 bp, Homo sapiens
cattgatacagagtacatgaagggaacacatggcagaagtgggggtgggagcaacccgtagctgggaagagctgagtctcagcaagtcacatcctttcagtggtcatgacatcactggctgctcccagggacacagtggccttacctgtctcacactgtggccagagccagacttggaggcaagctgtagaagtctctcagccatcagctgcccccatgctcccctgctgacatgcttcatcagcctgaggggttgctttcctgtggcctctgggtcaacattgt

SEQ ID NO: 539425 - DNA, 420 bp, Homo sapiens
attcgcgggcgcgtcgacagattgttgattcgacactgaacagtgggggccttgcgacaaccgccagaatgaaaaatgggcacccgatccgatcggcgtgcattttttctacagccctcccgttgctccgggagtggtacctgacgcttacgggttgacgctatctttgagcgacttgcccggtttgaatgcgacggtattgctggccttgatcttcaccggctcgcggtgttgcgggttcttgccggtacggcaccgcgatggcgctgcagaaaggtgccgaaacctaccagggtgacgctgtctttgcggtgagccgccggtgatttcttcgaggacggcgttgagcacgcggctggcctgttctttcgtgaggtccgctttttcagcaattgcagcggcgagttctggtttacgcat

SEQ ID NO: 539426 - DNA, 268 bp, Homo sapiens
tgctggggttgctgacatgagccaccgcacctggcctgacacaccattcagttttaatgaacttccaggtgctgtggtcacgcccctcttgtgtggcatgcaggttgggagagatgggttggaagatgactggatgggggcatggagctaggtgggaagaggaaaagtgtcttgaaggaagtaagtcccttcagataggggagggagaagctcgatcaatatgcagactttcacagtccttcagtcctggggataacacgttcgcgag

SEQ ID NO: 539427 - DNA, 342 bp, Homo sapiens
  misc_feature (267)..(267): n is a, c, g, or t
  misc_feature (290)..(290): n is a, c, g, or t
  misc_feature (297)..(297): n is a, c, g, or t
  misc_feature (331)..(331): n is a, c, g, or t
agagtttaaaaaaaaaaaaaaaaaagagtcagagtcagctggacgtggtagatcatgcctgtaatcccagcaagttaggaggctgaggcaggaggatcacttgagcccagaagttcgagaccagcctgggacaatgtggtgaggccccatctcttaaaaaaaaaaaccaaaaatttcttaattagccagatgtggtggcgtatgctgatggtcccagctcctaaggaggctgaggtgggaggatcgctttgagcccagggaggtttnaggctacagtgagtccatggttntgccatngcatttccagcctggggtggccagagcaagaccntgttttcccaa

SEQ ID NO: 539428 - DNA, 535 bp, Homo sapiens
caagcagttaatacagactcaaaaaagaaaaaaaaaaagaaaatcctacagtatgggacaatttagatgacccttgaggacattatgttaaggtgaaatacatcggtcacagaaggacaaatactgcttaatcctacttatatcaggtactaaagtagtcaaactcatagaatcagaaagcagaattgttgccaggagctaggtggaggggaaaattgaggaactgctaatcggtgagcatggttccaattatgcaagtataacactagttctagaagatctggtaaaactattgccccgtgtagttaacaattacgtgtcttggtgccctttaaaaattctgttaaggaggtagagctcagtgtaagtgtcttgcccacacacacacacagacacacacacacgatctttaaaaagtgtatgctctttaagaagaaaagtaaaatatctcaaaggacggtttcaccaccgtcctttatggaatcaatttttctacatttcagagcaagtgtagatactgagggacccctatttg

SEQ ID NO: 539429 - DNA, 535 bp, Homo sapiens
tagagatcatgtgactacactcagcaataatcactctcaagacagacttcaaaccccactgccatttctccattaagccagatgatcctgaggaccgaccactgcagaaagtcggctacaccttatttcagttgcaatgttggccacattaccatggcaacctggtcgaagcacccaccctccttttagttccagcatgtgctcctcagctggggacctgcatctctagtgagcagagagtatcacggtggttgctgttgcttgttccaaaagaagagctcggaaccctacagcagactgctgggtttccagcaggggagcaggaatgaacctatcttatactccatctggtttccatggtgacatcacagctgtgcccattgggacaaggtcctgtcacctgtcagcagaggcaggcacagtatttggttaagcctgagttttgggtaccttttgttactgttttcaaaaccctgacttgctcttatcttgatgtacaagtttcaataaagctttgtaaaaattaaataaaaaa

SEQ ID NO: 539430 - DNA, 150 bp, Homo sapiens
gccccaaatttttttttcccccccctcttgaaaaaaaatttttttgggttccccatccccccccccccaggtttttttccccggcccttaaaaagggggccccctttttttttaatttttttttttccccaaaaaaagttggggggccca

SEQ ID NO: 539431 - DNA, 529 bp, Homo sapiens
  misc_feature (12)..(12): n is a, c, g, or t
  misc_feature (24)..(24): n is a, c, g, or t
  misc_feature (90)..(90): n is a, c, g, or t
tataatatgttnattttagataangtgtttaaaagttgggaaagtatatatttttaattttttttaggtaggttggtttttatattattntagttaattgtggtttttaatttattgtataatgatatttatatttttttagttgtagtgaattgtgagtaaaagattttgaaagtaaaaagtattaattagtttaaaatgttatttttttggtttttattatataaaaattatgaagtattttttttatttgttaaattagattgtttttttttagtgatttatgtttatgaagagagttgagtttaataattttagtttttaaaagaaattatttaatgtaaaatattttatatgttatttagatattatgtatattttttagtttttattttgtatttttaatgtatatatttttgttttgtgtgatttgtatattttattggtttaaaaaataaatattgaaaggtttatgttaaatggaagatagaatataaaataaaatgttatttgtatattggtaaaaaaa

SEQ ID NO: 539432 - DNA, 105 bp, Homo sapiens
ccatcagccaacatattactcacaagaaatgcatgccaggaacttcaacctcacattccattttaatatgtgaagcaatcaggaatcatgacatgttaggttaag

SEQ ID NO: 539433 - DNA, 216 bp, Homo sapiens
cctctactgactttggttctgttcttaaagcagtctctccacatctctctgatgcactggtaactgccaaatctagatggatactcagttgtcctttgttctgaatgttttacatgatattatctcattgtggccgggcgcggtggtctcaggccttgtaatctcaagaactctggtgaggccgatggtgggcggatcgcctgacggtcaggatgt

SEQ ID NO: 539434 - DNA, 923 bp, Homo sapiens
  misc_feature (2)..(2): n is a, c, g, or t
  misc_feature (52)..(52): n is a, c, g, or t
  misc_feature (79)..(79): n is a, c, g, or t
  misc_feature (96)..(96): n is a, c, g, or t
  misc_feature (103)..(103): n is a, c, g, or t
  misc_feature (142)..(142): n is a, c, g, or t
  misc_feature (155)..(155): n is a, c, g, or t
  misc_feature (199)..(199): n is a, c, g, or t
  misc_feature (203)..(203): n is a, c, g, or t
  misc_feature (212)..(212): n is a, c, g, or t
  misc_feature (231)..(231): n is a, c, g, or t
  misc_feature (238)..(238): n is a, c, g, or t
  misc_feature (248)..(248): n is a, c, g, or t
  misc_feature (258)..(258): n is a, c, g, or t
  misc_feature (263)..(263): n is a, c, g, or t
  misc_feature (267)..(267): n is a, c, g, or t
  misc_feature (273)..(273): n is a, c, g, or t
  misc_feature (282)..(283): n is a, c, g, or t
  misc_feature (287)..(287): n is a, c, g, or t
  misc_feature (296)..(296): n is a, c, g, or t
  misc_feature (309)..(310): n is a, c, g, or t
  misc_feature (322)..(322): n is a, c, g, or t
  misc_feature (325)..(325): n is a, c, g, or t
  misc_feature (329)..(329): n is a, c, g, or t
  misc_feature (334)..(334): n is a, c, g, or t
  misc_feature (339)..(339): n is a, c, g, or t
  misc_feature (343)..(343): n is a, c, g, or t
  misc_feature (351)..(351): n is a, c, g, or t
  misc_feature (355)..(355): n is a, c, g, or t
  misc_feature (382)..(382): n is a, c, g, or t
  misc_feature (386)..(386): n is a, c, g, or t
  misc_feature (406)..(406): n is a, c, g, or t
  misc_feature (414)..(414): n is a, c, g, or t
  misc_feature (418)..(418): n is a, c, g, or t
  misc_feature (420)..(420): n is a, c, g, or t
  misc_feature (423)..(423): n is a, c, g, or t
  misc_feature (427)..(427): n is a, c, g, or t
  misc_feature (435)..(435): n is a, c, g, or t
  misc_feature (440)..(440): n is a, c, g, or t
  misc_feature (444)..(445): n is a, c, g, or t
  misc_feature (447)..(447): n is a, c, g, or t
  misc_feature (450)..(450): n is a, c, g, or t
  misc_feature (456)..(458): n is a, c, g, or t
  misc_feature (461)..(461): n is a, c, g, or t
  misc_feature (470)..(470): n is a, c, g, or t
  misc_feature (480)..(481): n is a, c, g, or t
  misc_feature (487)..(487): n is a, c, g, or t
  misc_feature (492)..(492): n is a, c, g, or t
  misc_feature (495)..(495): n is a, c, g, or t
  misc_feature (509)..(510): n is a, c, g, or t
  misc_feature (525)..(525): n is a, c, g, or t
  misc_feature (528)..(528): n is a, c, g, or t
  misc_feature (533)..(533): n is a, c, g, or t
  misc_feature (544)..(544): n is a, c, g, or t
  misc_feature (551)..(552): n is a, c, g, or t
  misc_feature (562)..(562): n is a, c, g, or t
  misc_feature (589)..(589): n is a, c, g, or t
  misc_feature (612)..(612): n is a, c, g, or t
  misc_feature (615)..(615): n is a, c, g, or t
  misc_feature (622)..(622): n is a, c, g, or t
  misc_feature (658)..(658): n is a, c, g, or t
  misc_feature (661)..(661): n is a, c, g, or t
  misc_feature (666)..(668): n is a, c, g, or t
  misc_feature (672)..(672): n is a, c, g, or t
  misc_feature (675)..(675): n is a, c, g, or t
  misc_feature (677)..(677): n is a, c, g, or t
  misc_feature (680)..(680): n is a, c, g, or t
  misc_feature (682)..(684): n is a, c, g, or t
  misc_feature (686)..(687): n is a, c, g, or t
  misc_feature (690)..(692): n is a, c, g, or t
  misc_feature (706)..(706): n is a, c, g, or t
  misc_feature (714)..(714): n is a, c, g, or t
  misc_feature (753)..(753): n is a, c, g, or t
  misc_feature (756)..(757): n is a, c, g, or t
  misc_feature (760)..(760): n is a, c, g, or t
  misc_feature (762)..(762): n is a, c, g, or t
  misc_feature (769)..(770): n is a, c, g, or t
  misc_feature (772)..(772): n is a, c, g, or t
  misc_feature (774)..(776): n is a, c, g, or t
  misc_feature (778)..(778): n is a, c, g, or t
  misc_feature (781)..(781): n is a, c, g, or t
  misc_feature (783)..(783): n is a, c, g, or t
  misc_feature (785)..(785): n is a, c, g, or t
  misc_feature (795)..(795): n is a, c, g, or t
  misc_feature (797)..(797): n is a, c, g, or t
  misc_feature (804)..(804): n is a, c, g, or t
  misc_feature (806)..(806): n is a, c, g, or t
  misc_feature (816)..(816): n is a, c, g, or t
  misc_feature (818)..(818): n is a, c, g, or t
  misc_feature (821)..(821): n is a, c, g, or t
  misc_feature (824)..(824): n is a, c, g, or t
  misc_feature (834)..(834): n is a, c, g, or t
  misc_feature (844)..(844): n is a, c, g, or t
  misc_feature (849)..(849): n is a, c, g, or t
  misc_feature (897)..(897): n is a, c, g, or t
antatgaacaaaacagaccccagatcagaggaagagatggctttcttgttanttctggagcagattcaagcagcaaatntttactgaacacttgcnatgtgcnggaaattgttctaggaactggagttacagcagttaaaanaataacatttgtnttttcataaatttatattctagagggagaagaagataataaganaatnagttatacngtgtcctaactattaaggngaaaatntagcagagtnagggggtggngagtnatgngggtgncattttagnnaggnggtcagggnagcctctcagggnnggtgacacctgngcngggncttgnataangtgngtcggggnaccngacatatacttgggagagagtgttctnggcngagggaacagcacatgcganggccctgnggcngngtntgtngctggggnggggngggnngngcngtagannntcngagaggtcnactctgtggnntccccngcccnggnatttggggctttgnngctctcttatgttcnganaggcnaatcatctccnggtccanngttgattaanattctttatttcacagtatttttgatnagaagtcttagaaatcatgattnatntggttanaaatcccatgagtttctctttgaatgaacctcttgnttncagtnnnatanaangnatntnnnannagnnncagtgggttgtaantgtgattnaacactgagtgctcgcttggaaaggaggtggagctcaanttnnaantnagagggnntntnnnantgntntnagggaaatgncnatgattnanttatgctgtntnaanaanaagtgcagcngggcgctgcnttccnagctggccaagcgctcctagggggatctccaccctcagaggcttaggnaaggggagtgtgacgagtcagggccc

SEQ ID NO: 539435 - DNA, 321 bp, Homo sapiens
aacttaaatgatttttggaaaaattaggatgtaaggataattcaaaggtgtccaaatgtaagccctttagaaggaatttttattatttaaattggtaaaacttaatccctggaaattccttttccctacccgatgttttctttcaactgagaagcctaaaacaaacaaaaaccttgtgtgttatcctgaaaaagttgactaaaaggatttgtttttatatggatagtaaaatgaatgtgacatgcccccattgtcctattataattttcaaataaggggaactaagcccctgtgtaataaaaattagtccttttttttcca

SEQ ID NO: 539436 - DNA, 80 bp, Homo sapiens
cccaggagttctaggccatagtgtgcaatgaagatgcctgtgtgaataacctctgtactctaccctgggcaacacagcaa

SEQ ID NO: 539437 - DNA, 586 bp, Homo sapiens
  misc_feature (8)..(8): n is a, c, g, or t
  misc_feature (437)..(437): n is a, c, g, or t
  misc_feature (462)..(462): n is a, c, g, or t
  misc_feature (490)..(490): n is a, c, g, or t
  misc_feature (503)..(503): n is a, c, g, or t
  misc_feature (512)..(512): n is a, c, g, or t
  misc_feature (515)..(515): n is a, c, g, or t
  misc_feature (518)..(518): n is a, c, g, or t
  misc_feature (532)..(532): n is a, c, g, or t
  misc_feature (567)..(567): n is a, c, g, or t
gaattcgncacgaggtcatgggcttttttcaaaactccagtagaaggtgcccagacttccatttatttggcctcttcacctgaggtagaaggagtgtcaggaagatactttggggattgtaaagaggaagaactgttgcccaaagctatggatgaatctgttgcaagaaaactctgggatatcagtgaagtgatggttggcctgctaaaataggaacaaggagtaaaagagctgtttataaaactgcatatcagttatatctgtgatcaggaatggtgtggattgagaacttgttacttgaagaaaaagaattttgatattggaatagcctgctaaggaggtacatgtgggtattttggagttacctggaaaaattattttttgggataagagaatttccagcaaaagatgttttaaaatatatattaggtaaagtntaaattgaataataagtccaattgncaaaataccaatttataattgtaaaaantataaccttgggncaaagcatnggntgnccatatttaaatantttggcaaggaattaaaggtgcctcaaaggtcctncccggaggagggttttccc

SEQ ID NO: 539438 - DNA, 384 bp, Homo sapiens
gtatccacgccccgcggactgctcttagcgttataagtcggttgctgcgcgcgtcacaccttgtaatccccgcactttggaaggccctggcgggctgatcactttaggttaggagttcacgaccagcctggcctacatggtcaatccccgtctctactaaatatacgtgacgttagccggcgctatggatggctgcatgcctcgtgactctccgccttcttggccaggccaaagcacgagaatcgctttaaccacgagatggacgcttcagtgaatgacgatcgtgccattctattccagccctcggctcagacagcacgactgtcattttctttggagactcctagattgactgtggttttcaactgaatatggcggatattt

SEQ ID NO: 539439 - DNA, 530 bp, Homo sapiens
ctcccgctgctgctgccgttgccgcctgagtcattgcctgcgcagctccggccgcctggctccccatactagtcgccgatatttggagttcgttacaacatggcaccgacgattgacaacctgcctagcggtagttcaacagacgagtgcaatgcgtctcagagaaaccgtgcaaggttaagagtgtgcaccagagtagaagccaaattctatgagcgcacagttcatgatcttgcaacaggacagtatgcgtgttctctatcagcctctatttgataagcggatttgaaattattaatgcaatttatgaaccgtacgggacagaagaatgtgaatggaaaccaagatgaatgaagatgaggcatttcggaggaattgaacagaaaaggccaatgattgcaagatgagaaaaaggatgaagaaaaagaagacccaaaggaattcctgaattctggttaactgtttcaagaatgttgactagctcagtgatatggttcaggaacacgatgaacctattctgaagcacttga

SEQ ID NO: 539440 - DNA, 430 bp, Homo sapiens
tgtagctttataatttagtttagtattctcactaggccagttttttaaagagacggagtctcactctgtcactcaggctagagtacagtggcgtgatcttggctcactggagcctctgacccctgggttcaagtgattctcctgcctcaacctccctagtagctgggattacaggtgcatgccaccactcccagctaattttttttgtattttttttgggtggagtttgagaccagcctggccaacatggtgaaaccctgtctctactaataatacaaaaattagttgagtgtggtggcacatacttgtaatcctagctactggggaggctgagtcacaagaatcgcttgaacctgggaggtggaggttgcaggcgagatcatgccactgcactccagcctgggcgacagagtgaaactgtgtctccaaa

SEQ ID NO: 539441 - DNA, 566 bp, Homo sapiens
  misc_feature (22)..(22): n is a, c, g, or t
  misc_feature (66)..(66): n is a, c, g, or t
  misc_feature (152)..(152): n is a, c, g, or t
  misc_feature (284)..(285): n is a, c, g, or t
  misc_feature (361)..(361): n is a, c, g, or t
  misc_feature (390)..(390): n is a, c, g, or t
  misc_feature (402)..(402): n is a, c, g, or t
  misc_feature (411)..(411): n is a, c, g, or t
  misc_feature (413)..(413): n is a, c, g, or t
  misc_feature (424)..(424): n is a, c, g, or t
  misc_feature (427)..(427): n is a, c, g, or t
  misc_feature (477)..(477): n is a, c, g, or t
  misc_feature (555)..(555): n is a, c, g, or t
ggggctgctttcttctttctgntttctttttggtgctgggtcctctctggctggtccttcctctgntgggggggggggggcctgggggggggccttgggtggggcggtgggcccggccctcggcgcggtccgccctttcttctttttcttgnggttgtttttggtgttttggtgctctttccctcccttttctgttgcgttcggggcgtttggggctcccgcctttggttttttgcctctgctttttgccgcgggctgcctttccccttttctctgcttctccnntttcttcctttttcctctgctcctccgcccccccttcccccctttcgtccctcgcccccccctcctcctcctcttncgctcccttttgctttttccatcgagcgnggttgggcatcngccccagcncnttctccccgcnttnttcgggggggggggtgggggggctatttttgggtctagtaccctatgtcnattttctctattccaggctagttttgccagcttgttcttcttgtttttgctgtttgcttgccttttttgagctaatgntgctgcgattg

SEQ ID NO: 539442 - DNA, 312 bp, Homo sapiens
gcacaacctagggtcagttttgcaggtggtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 539443 - DNA, 128 bp, Homo sapiens
cggtgggctcattaatggaaacaaatgccccataatgaggcaagatgttaatgatgggggaccttgtgaaagatgggaggggaaagggttatatgagaattctctatacttttggcccccctttctgt

SEQ ID NO: 539444 - DNA, 107 bp, Homo sapiens
ctatagtactcgatcgtaactagaaacagcaacgctgagatagggctagctcaaactagtaccgaagtaaaaagtaaagtatctaggcatctattgctcccagaagc

SEQ ID NO: 539445 - DNA, 343 bp, Homo sapiens
  misc_feature (26)..(26): n is a, c, g, or t
  misc_feature (36)..(36): n is a, c, g, or t
  misc_feature (119)..(119): n is a, c, g, or t
  misc_feature (177)..(177): n is a, c, g, or t
  misc_feature (213)..(213): n is a, c, g, or t
gggacaatttgatattaatatttaanacctctgcancttttccttaaaaaagaatatgggccagatacagtggctcacatttgtaatcccagcactttggggagccaagttagcagaancccttgagcacaggaatctgaaaccagcttgggcaacatagtgagatcccatctctanaaaaaacttaaaaattagccaggcatgatggcacantcctgtagtcctagctactcaggaggctaaggtaggaggattgcctgagcccaggagttcaaggctgcagtgagctaagaacgtgccagtacactccagcctgagccacaaagtgagaccctgtctcgca

SEQ ID NO: 539446 - DNA, 177 bp, Homo sapiens
acttcaccacgttgaaacgcactgtctgctctagtagtgctcgcactctcccactgtgacgatatcatcgatcttggacgatctcttaaccagggggacaggtgtacagacttgttcttatggcgcctctcaaatcggctgtacttgcggatgtagtgcacatagtacagcgtctga

SEQ ID NO: 539447 - DNA, 1382 bp, Homo sapiens
tggcatttacctgagagggccggcgtcttgaggtggtcagctgttcgtggtgggtcgcggactgcggatgcgccgccatgcgctgcccttgtgtgttccgctatctgggctgctcttggttctgcgtgcctctgacgggatggcttcagctgtggtacgcggcaccgagtgtctcctgaccgtgcacgagcgctgttcaagcaatgttggcttacgtcgagctccacaagatggtggaaagatttcttggactcagctctctgaatttgtcatcatacaatcagatcagtcttgtgctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaaga

SEQ ID NO: 539448 - DNA, 1051 bp, Homo sapiens
gcaggaagactggggtgatcggacgaggcgatgggcataggtcagactctgatgattaaccagctcatagagcaagggtgggagcattctgcttccacttttcagaaaagtaagtggctttctcccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaaga

SEQ ID NO: 539449 - DNA, 897 bp, Homo sapiens
aataatagttgagaggaagaagtgagaggtcatgagagatggagatatcagataaatgtcagtctcaaatagtaattcgcattcttgttgtgaaatgatgtctctaagatattctgtgtgtgagggtcatagtagtaaaatgagttccctaagggctcgttcagggaagtatgctaagtcaatgcccaagtcacctgttgtttataacttcaccaataggaggatctcagtgcagagggtcgtgagcatatagaagatgcaccagtgagtttgggtcccaaagaagctgggatcttaaagacattgttggccaaggagatctgtggtgacaccattagcagtaagtggtgtatcatggattccatgggaccacctggataaggcaaagcgtaaaattccagagcgattgaataatctatggaaaaatcgaagaatctgcaggtaactggattggccgcgtaagatttacgccagacaccctgtgtttattgtcatcataatgaatccgtcgcgatgtggacattattggctgagagtcaatgtttaatctatttccagtatcgatgtttaggttgatctctcatggtactagtgtctacgattccagagattgggggaattgcttatcgctcttgaaaccacagttttagcccctgagatgttgaagggcttgcgggaatcatcaatccacgaatttttgaacggtccgaggttgttaaaattttgcgcacgaactttggtgcttgcccaataaatttttgtggcacaaggagcccagacaaggttggggctctcggaaatcaaaacttggggggggaaagaatagcgggcaaccgggaccgaggtgccaaaggggggaacgtgggttggcgcacacaccccgtcgacacaaaaggc

SEQ ID NO: 539450 - DNA, 1324 bp, Homo sapiens
  misc_feature (478)..(478): n is a, c, g, or t
atcaggcgaagactgtggccacttgagcctcttcacctttttgtgttctctgcaatcaggggctggtgacgctcaccacaaatcatgtcttctataaaaacagtcattgccagctgtggagtagctgttccactgcctttcctctcctgaaagatggcacaaggagtgttagaaagccactggcaggttggagcccccacagttgaagagccgttttgaaaaagggaaagggtgggaacggaatggctgggattgaagaagaaggttgacgagcaagaagctcttgccatagaagtcacattgaacatcccgaatgataccctttcatctctttgtgccatggagctgtgccatttgaacactcactccccttttttttcctttggagcagagaaccttctgcattcaagtctctcagttctttattatgatcagttacccatcaagagctgcttagatgtattaagccaaaaaaganaaaaaaaatcctccgggtggaaattaattttcttggatgattctgtggagttggaaacatttatctgaagctgaattttctctccccagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaaga

SEQ ID NO: 539451 - DNA, 1596 bp, Homo sapiens
  misc_feature (1396)..(1396): n is a, c, g, or t
  misc_feature (1455)..(1455): n is a, c, g, or t
tggcatttacctgagagggccggcgtcttgaggtggtcagctgttcgtggtgggtcgcggactgcggatgcgccgccatgcgctgcccttgtgtgttccgctatctgggctgctcttggttctgcgtgcctctgacgggatggcttcagctgtggtacgcggcaccgagtgtctcctgaccgtgcacgagcgctgttcaagcaatgttggcttacgtcgagctccacaagatggtggaaagatttcttggactcagctctctgaatttgtcatcatacaatcagatcagtcttgtgctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccaaaaagcaagagcttgtttatggctgaggaatcggcggattgtctgaatgacacatatacagagcccccacggatttctgcacactctgggtctgtgctggtggaacattgccaatcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaagaaaaaaaaaaaaaanaaataactatccatttttcaagataatataactatttctccatctccctttccattatnttagttttgtttataaaactgtttggcccctttgccccaattttttttaatttggacaactttttcttggcgcgccaatattgggcttccttggcaattcccccctttggggacgggttaaaaaaacacgggccgggtttt

SEQ ID NO: 539452 - DNA, 191 bp, Homo sapiens
  misc_feature (126)..(127): n is a, c, g, or t
ggctcagtgaagttagtggcctttgaagcaggtttgcggacaaatatggtacctggtattgcgcgtgcgactgtcgtcacagcacaagctgaagctatggttgccgctttccaagactttttggcnntaacccacaaatttctggtagtgctgaatctgatggtgatgacattaagtttgtcgtgaatggt

SEQ ID NO: 539453 - DNA, 1148 bp, Homo sapiens
tggcatttacctgagagggccggcgtcttgaggtggtcagctgttcgtggtgggtcgcggactgcggatgcgccgccatgcgctgcccttgtgtgttccgctatctgggctgctcttggttctgcgtgcctctgacgggatggcttcagctgtggtacgcggcaccgagtgtctcctgaccgtgcacgagcgctgttcaagcaatgttggcttacgtcgagctccacaagatggtggaaagatttcttggactcagctctctgaatttgtcatcatacaatcagatcagtcttgtgctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatatagaattaaccttgcctcagttctacagcttcctgcacgagatggagcgagtcagaaccagcatggagtgtttctgctgatttctgtccctgcatctcccctggccccgttccctgccctcctcccttccctgggtgactgctctgagaggcacttcactcacaggcctgtgggatgctccatggggccctgctggctccatggggcccaggtgcaaagggtttctgaaaaacagcaggattaagtactgaaagagcccaacacaattaccctgtaaactctctgttagggcaaccaccaccacctgtcttccaggacacatttttagatactctgacaggccactgcatctcagattcaggggagaaaataagttgtcacctccccttcaaagttccagagtaaacaaatggtgccatcattcaagataacatgctgatcaccctcctcccgggatacagacccgggctggagtgcagcagcatgatctcagctcactgaaacctctgctcccaggcttaagcaa

SEQ ID NO: 539454 - DNA, 816 bp, Homo sapiens
tggcatttacctgagagggccggcgtcttgaggtggtcagctgttcgtggtgggtcgcggactgcggatgcgccgccatgcgctgcccttgtgtgttccgctatctgggctgctcttggttctgcgtgcctctgacgggatggcttcagctgtggtacgcggcaccgagtgtctcctgaccgtgcacgagcgctgttcaagcaatgttggcttacgtcgagctccacaagatggtggaaagatttcttggactcagctctctgaatttgtcatcatacaatcagatcagtcttgtgctccctcagaagcatcgtgaaaagcctccttctggttccaaatggtgctttgaagaagagtctcacagccaagcaggtccaggcggatttcataactctgggtcttagtgaggagaaagccacttacttttctgaaaagtggaagcagaatgctcccacccttgctcgatgggccataggtcagactctgatgattaaccagctcatagatatggagtggaaatttggagtgacatctgggagcagcgaattggagaaagtgggaagtatatttttacaactaaagttggtggttaagaaaggaaatcaaaccgaaaatgtgtatattcagttcttaatgaggcacctgtgtgtaaatacatgcttggtcttctctgcagagaactgaggctaaactctgtccctacttctggttttgccctgtcatgtcgtaacgaggtgggccttttgaggccattttagtttgagttcgagccaaccacctctgttggttagatgatgaataaaaaggttctgaaga

SEQ ID NO: 539455 - DNA, 196 bp, Homo sapiens
gaattgagctcgtaccggctgagggcgcgcggtgcagctgcgcgactgaccctgcgacgttctgcgtcggcaccgagaccgaccacgtggcgccatggcgttcggtctacaagctgcacgacctgtcgcccgcgccgctgaccttcgtgctgaccagcggcggccacaacgccggcatcgtcagtgaacccggcca

SEQ ID NO: 539456 - DNA, 1874 bp, Homo sapiens
  misc_feature (370)..(370): n is a, c, g, or t
  misc_feature (1408)..(1408): n is a, c, g, or t
  misc_feature (1640)..(1640): n is a, c, g, or t
tgggggtcccaaatttctttatttggaaggaatgggtccaaatcaaaaaatcttaaggggattgtttgggtcacaactttatagaaaagaggtaagaggaacaccccaaacagtgctgtgccacgtgccttgggtgtgcaccagggaaagttccacccccagcggcatagtgggagaaatatacgccccaagagctatagctttctcatttactcacgtggctctccacagggggtgtgtgtgcttgtgttacaaaagagagatatatatctccgcgcacaagcgcacaagatatctcgagagcgcgcgctctcacacatctctgtgtgacgcgacaaatgtgtgtgtgctcaccggtgtgtgctcaccncacaaatatctcttgtgagagagtggctgttcacaccctgtgtctctcactatctcagagagtgatagagtgtgtgtgtctctcacagagtgagaagacgtctcacacacacacaacagtagtggcgggcgcctccacaatatatgtgtgtcgtcaagagagtgccgccccgcagtgtgatgtgtgtgtcacagtgtctccgcagagatgagtgtgacactgtgatgtttctccacaaattttatattatttcttcccacaaagtatttatttatagtggcgcaccacaactctcccaaagttgttgagcctaatcatcagaaggaccccgcacgacgtacttctcctctcaccagaaggactcaactactctcaaccagaggagttcctgtgggggagtatcctccgtagtggagaaataatattcccctgttgaagaaggaagaggagacgaggaataattatcggggcgccacacaacacctcttcgtgtgtggggagagagtactctctaggcgagacggcctatactcccaacttcaaaagaagtagtctcctcttcccaaagaccagtagttgtggtcctccccccctcttcttcctcatctcctcatgtagtggagagcactatttgggtgtgcgacaacacgacacaggaggtttatttgttgggcgcacaaaagaggggtttctcttctcaaaaagaaggcccacaaaaaattataaatccgggcggggggcaccaccacaagctggtacagatgaataagaagcaccattttgtggtcccagccggagtggttcaacaccacgtgtaatagcagcagcgcgggcggttaaaaagaaggcctcccccaagggggttagtagcacatctcggggagcgaagtgtctaacgaacttggagcgagggaccccgctcatagaaagcacccccagggagaggggagggcaaatgtctcctttgggggcagcgcccaccccctttggcgtgaaatgtggttgggtgacaccgccaggggaaccaggcacataatntgggcggggggcaaaccacaatacaggaagagaagcaacgaggcaggaagaagaagaagcagcaaagagaacataggtcgaatgaattagtctacaaccgaggatcagcatagataaaaaacgaaagagggaagaagagggagcgcccgcttagtaggggtgacacagacacccgcgagagggtatcgcggcgagaacaaaacaagcggctagcacaccaggaaggaggggngccggagcacacaaatgtgagcagcgcgccacagaccccggaacgtcaggtggtggcaaacacatagcaacgccgaggagaactcaccgcaacaacagcacaacgtggttgaataacagtggagaaaccccccaggaaagacgaagctctaagcgaccaaggagccagacaaactatcgggccacagaagagtacatggaggtgagatacaagacagaacgggatgctgaagaa

SEQ ID NO: 539457 - DNA, 692 bp, Homo sapiens
  misc_feature (39)..(39): n is a, c, g, or t
  misc_feature (83)..(83): n is a, c, g, or t
  misc_feature (120)..(120): n is a, c, g, or t
  misc_feature (137)..(137): n is a, c, g, or t
  misc_feature (145)..(145): n is a, c, g, or t
  misc_feature (153)..(153): n is a, c, g, or t
  misc_feature (224)..(224): n is a, c, g, or t
  misc_feature (291)..(291): n is a, c, g, or t
  misc_feature (309)..(309): n is a, c, g, or t
  misc_feature (318)..(318): n is a, c, g, or t
  misc_feature (320)..(320): n is a, c, g, or t
  misc_feature (327)..(327): n is a, c, g, or t
  misc_feature (331)..(331): n is a, c, g, or t
  misc_feature (333)..(333): n is a, c, g, or t
  misc_feature (340)..(340): n is a, c, g, or t
  misc_feature (361)..(361): n is a, c, g, or t
  misc_feature (363)..(363): n is a, c, g, or t
  misc_feature (368)..(368): n is a, c, g, or t
  misc_feature (371)..(371): n is a, c, g, or t
  misc_feature (376)..(376): n is a, c, g, or t
  misc_feature (385)..(385): n is a, c, g, or t
  misc_feature (397)..(397): n is a, c, g, or t
  misc_feature (404)..(404): n is a, c, g, or t
  misc_feature (456)..(456): n is a, c, g, or t
  misc_feature (486)..(486): n is a, c, g, or t
  misc_feature (523)..(523): n is a, c, g, or t
  misc_feature (567)..(567): n is a, c, g, or t
  misc_feature (629)..(629): n is a, c, g, or t
gggagggatatttacagtgcatggtggtacggggacaancactttcctcgagagctctgagaactttgtgctttttttcttanttggtgccgagctacctggaaaggattttgtgtttancttctttagggaaaaangtattaancaaaacanaatccagcccaaattctcggctgaggatttcacgatatcaatccaaacatcacactatttaattccccaanaaaacattggaaaaaggactatcagtgctaacacatttacatataaaatttccacctaataggtaanagacgcctatgtaccaanttctaaaananttaaaanatananacacaanattggggtaaaataacaaaananaaaantanaaaanaataaaggnaaacctcctggnccacggncccttgttgccgcttacttgaagttggcataatctgagaatgcatcaaatanactcctgcaccaccttgtagcagaactcanacatgttccagtgtctggaccaagtgtggcctctgtngccgcagcctttgacagtctggaagacatccaaaatcccctctnctttcacacgctccaggacggtgctcagggcacagaaggtccccgtccttcctgccccggcnctgcagtgcacggtgatggggtggttccctgactgctgctgctgcttctgcacggcggcgatg

SEQ ID NO: 539458 - DNA, 2519 bp, Homo sapiens
aattggtaccaggagagcccagaagccacacagcatctctgcctctttgctctggctctcccaccctcttcccgtctttctctgcttccttgtcactgttactccaggagacgttcacttttcaccaacctttctccaagcatctccaagccactgactatatatattttgctacaagagacctagaagaggaaaaaaggcacgagacttttcaacacatcgtttaaaaaaatcatcaacgaatttcttgcaatgtttgagaacaattaaaaggaaaaagcgttttttaaaaaatctatcaactaagtgaacaatcattcatatcgtctacatcctgagatattattctactctatatctcctccgtccctcgctgcggacaccagcgagatgacagctgctttttcatttttgaatgtaataaatatttgctgcttttaatattttccggaatctcccctcgctattccttggaattttaactctaaagattggagaacagattatcaaaaagggcttttgcaagcctccaaaatgatgctgagtccggaccaagcagcagattcggaccatcccagctcggcgcactcggatccggagtccctgggcggcacggacaccaaggtgctcggcagcgtgtcggacctggagccggtggaggaggccgagggcgacggcaagggcggcagccgagccgcgctctacccgcacccgcagcagctgagccgcgaggagaagcgccgccgccggcgcgccacggccaagtaccgctcggcccacgccacccgcgagcgcatccgcgtggaagccttcaacttggccttcgccgagctccgcaaattgctgcccacgctgcccccggacaagaagctctccaagatcgagatcctgcgcctggccatctgctacatctcctatctcaaccacgtcctggacgtgtagggcggggtgcgccgcggggggccgcctgtcccgcgtccgcgaaacgctacggatccggacgggccgcgtcgctcgggtggcggaggctgcggtggcccagcgagacggccgcctcgagagacggccggggaagaagctcgctacctgttctctctggtcagcagggcgacgagggaaggtttccgacgcaggcaggtggggttgtctggcgagcccgggggctcgcaggggggattttccaggccaggagaacctcgtggagacacccgagatgagccacttctggggctccccaagggttgtggttttaacccactggagactttgagttctcctacattcatccgccacaaatcttaatgtgttgaaagaatgagggcagaagttcagagtatgcaggctcataactttaggctatctggaatttttctaatggacaaatcaccaaacactgggaaggaggagagaggagggatctctcccatagagatggaaggcacagaaaggtgcgactggaaactttcctttctgttgtgaaaataaagattatattagaatccaaataaaccctgaatatttagtaagtttaaaaagacaaattgagaacaagtagacacactgtgggaggatctgagcttggtgatattttatccccaagatatgacaccaagcagacaggaaaatccatatttaaatggaaactttaatatctgattacttttgcaggcgaagtgcccctttatatatccaaaaacatctatttgtgaccttaaacatgtggacccataggtgcagttagaaaaagacaacctatttttatttatgttagaaggagtagagtatttttttcaagacattttatttttcagagtggtgatacttttactttggatactctgtgccaatttatttatagtcaagtgtttacactttttcctgtggaataatttattgtctaactttttacgtgtttgttgagttatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagttttagtctttttcagggtttttttgtgtctctgttgctttatataatgcaatattttgtagtgaaaatagatataatctggtttctatctgacgagtttttcatatctcatgaatggtgcgctgttttgcatataaataaagg

SEQ ID NO: 539459 - DNA, 769 bp, Homo sapiens
gtacgtttaggaaatattgtcagtgcaattaaatggccgtgacacttgtacacaggtatcatatagaagcaaatccttaaagtatatgctacttgagttcacaaatagctgaacaacagaaaggtgtcattgttcgttgcctttctcacagtcgttgctggtgagaatcacgatgagcatagtactttatgagctaaacactatctgaaagttgtaagatagtatggtgtgcattattgttcttatgtcggcttaagaggataccacatagggagaaggttaatggtcacagctgcacgttcatgtagctttctaagctactcaatgtgattcttgtcctctttgctgttcttttgctcctcccccatggtggtccttcagagacgaaaaggaatgtagatagacatgaagtccctgcagatgtgtcctgacatttcaagggagggacagggtactaatgagtgccatcctggaaaggcaggctgtgtgagaaagaagaaatccaaataatgtggattcttaacaattacaaaatgacattcattctgcagttgttatgaaaggaaaatgtagtttggatacgaagctgattaaatcggatcaaggaaatattaggaatctacattgcaataataatccatgcattgtatggtatatgatttcatactattcccagctagttgtagaatgatgcattcccacaggatagcgtaactcagatggttgctgcttactgagtatctctactataggtagtatattgataaac

SEQ ID NO: 539460 - DNA, 720 bp, Homo sapiens
gaacggaaaatggcgcctcacggcccgggtagtcttacgaccctggtgccctggggtgccgcctgttcctcgctctgggcgtgaaaagggctctggcgctacccgagatatgcacccaatgtccaggtagcgtgcaaaattttgtcaaaagtggccttttatggtaaaacgcgacacgagagctaatgtctgcatgcccgttgctgcctgaatcagaagggcacccatctgtggggcctgcatctcccagaactgttctctggaggaccctggttcccaaacttttcatcaggcacatacccacgtggtcactcatagaacctggcaaggcaagacccctcaaaggttgacttggccaaacacctttcgcgtggctttaactcagctcacagactctgatactgccacaaacattgtcaagtctgtcctggaggaacattaagttgccgtgaatacatatcacctcttaatatagacaaccaaaatttggtccaaggggcacaacagaaccttttgcaatcaaccactgggtgacccagaaattgttgtcctgagacatggctcttgttgtacctgatggtccaggtcttccggcagggtggtgtgctgagggttccattgctaccagtgtatgcgccaggctcgttctcaacggtaatgtcctcgggatctgggagcaaccactcaaacgggtcaatcggttggggacaggggaaagca

SEQ ID NO: 539461 - DNA, 372 bp, Homo sapiens
tagagctcgctcgtggaatatcgatctcgtctctcaacgagaataaagccagaaactcgttgacaattcaaaacaacccagaaacgaaccaaaaacgcgaaactgggccaaagtgacgacgaccagtacgtaagaaataagtcttccttactagatccggtcatcgaccctcctcggcatgacccggcccggaagagttctccgcccttcctctcccggggcacgctcctgacctccaacacgcccgcaataccaccgagacacaacctatacattccataacctatccaccccaagggcataacccagcggcccccagcgcacctatgccgcgcaattgcgattatagctaaccccagtaccctgcctttg

SEQ ID NO: 539462 - DNA, 95 bp, Homo sapiens
gctccttctgttgcccaggctggagtgcagttagccgagattgcgtcacttcacgtcagccttgcctgacagagcgagacttcgccgtcataagc

SEQ ID NO: 539463 - DNA, 559 bp, Homo sapiens
  misc_feature (401)..(401): n is a, c, g, or t
ccccagagtctttttggcgggtcgagaaggggtgggattgtgtcagaccaacccgggggctttgtgtaaaggtttgctacgccaagggtgtgaccccggtatagggggccccttgtggccccctgcaattcgggggcctttgggctccccttcccggtggcccatgtggatggccaaccccccatgttttttggttttgcccggttggagctgttggggcccctgttgggaaaaaaggggttgggccctatcccccccccggtgaaggccgagtttttagtttgcccggggggggcattcttttggtttaaaaaaggcgggccttttgtttacccctgggttcccccttagggcatgggggccgggttttttttttttgaaagggggtttttttggggccngggggagtgttttttttttcccccccccccaggggggccgggaaggggtccccctttacccttggggccccctttttttttttgcctcccaggggccttttggggggccccctttttgttttcccccaaattaccccttttgccttcgggcaaaccca

SEQ ID NO: 539464 - DNA, 727 bp, Homo sapiens
cgtattcctgtggggggggagctcctaactcacgacgacttcataggctcatatccacgcatgctcacaattaactgccacttaacctcatagacccatacagccaggtgcagttgaccacatgctctggccctatatctcatcttgggtctgtggctatgagttattttgggcggaggatgtctatgatgagtacgacactgagtgccttcagtgtcaatactactctactacgatgatggcctgtcacaagatcattttcttcactctactatgctactcactgggaattttccgctgggagcaaggaactcgacagacactgatgatttggtctggagaattacatcttcagtaaaggcacttgatagagacgcttttgagacaatgactccgtagaataggactttcactgtgtccacgagcacatcctcatagtgcctattatcaaagctatatgcatgtacaccatccatcactaggcgaatcactccagctctttcctggtgatatataacctatgccacggcgacgaatcattgtactgactgaacaagggagacaaaacggctggaatatgacatacccacagtactgtcaacaggtcaaggataatgcattagggtgcctccttacattttgcaaactgtgcacaactgctaccatctatccaagagaggcctggttacctggtctcactatgcttttgagctggcggtcatcactg

SEQ ID NO: 539465 - DNA, 130 bp, Homo sapiens
cgacttatccccatgtacattttttttttctccacaaagagtcccttctctaatgtccccatctggatattaagtgcactttaaagaaaggggcaggttggattttcaacgaggtggagaagctcataag

SEQ ID NO: 539466 - DNA, 1099 bp, Homo sapiens
  misc_feature (1)..(1): n is a, c, g, or t
ngggcttacttgagcgtggcaggggtgttctgggattcctgcaagattggccatctggtcaactgcgggtggaaggtgaaagagacacccttgcttcacctggtaacaacgtctgttgtcgccaggctctggatcgcctcccctgtgacaagatgcttcctctctagataggtggccctcctttctggcctctaaccctgcttggtcgacccttttccttgcctcttggcccttgaatcaagatgtcgagcccttggggggcccgcgttttatagctcaccaagtctactgtcaagcgtggagatcctctgcgcagcctctcgaaccctcttaaagcgtgggacagggactatttcacgaggaaaggccgagtgtcatccgttgtgtccgaggtgtttcccccgtggaatgcacgaggttcctctggggctttaggcttaatcgcgccagatttcattactcgcaaaccagggacattacgaaaagccgaaaccgtactgatgacggggagtgactgccagatcttccattctcgttgacgtgctggtgtgtacctggccaccgttaagagtcatcatgctgagtgacaggtcgggggcttcgaggggaaaggacgatggggcatgacctcagtcaggcactgcgctgaatcttgcgagagcggtgccggacaccgctcgtcagcctgctatccatgctgcgctacgagttcttgttaccgccatccttccgctccctcccagccatccaccctgcaggtgcctccgaaattggtgcttcgagccctggcaccctgctgggtgaaacaggtccttcggtggtcagtgaagggactggaaagcagatgtgagcacccagggccgtgttctcccttgcttgggataaggtgcagaccatgtccattggttgccggtccacactcgtacacggaacttgaggtgctctgctcagagtagactatgtcccaagagccataagggagtggcaaataggggagggagaaagggtagttcaaagagtctgtcttgagatctgatatttgttccccctgttaacgctagctgtgccccctctggttattacttccctgaggacagga

SEQ ID NO: 539467 - DNA, 279 bp, Homo sapiens
ttagccctgtagactaagagaggtggagcttcctgtatcgctcacgttctaagcgggggcatcatttcctgctggatactcaggtccttcatacaacagtgaaccactagcctgcatacaattctctgctaaaatgccccaaagtagtctggacccatgaaaggcctctgcagacttagttttcccatgctattttctttctggggttatttttttgaaaccaattctcagttctgataccccaggttgaagatgtaggggatggggcacaacggcaca

SEQ ID NO: 539468 - DNA, 723 bp, Homo sapiens
  misc_feature (88)..(88): n is a, c, g, or t
  misc_feature (218)..(218): n is a, c, g, or t
  misc_feature (231)..(231): n is a, c, g, or t
  misc_feature (384)..(384): n is a, c, g, or t
  misc_feature (398)..(398): n is a, c, g, or t
gggggtgggccggggaatttggccgttggtaaattgaaaaatggccaacaatgggcaaattaccatcctaccatcaggagcgctttcntcaggtttccttcaaagcttctacgtcttgtagtaaaggcgacatcaaatcgagcttttaaagtagcaatgcttttcatcagaccatactgcttcaacacctttgcagtccttgagctttgcaatctgcnccacgactgagcncacagctcagctgctgccattaaccatcactgtttctccatccttcacacctcagatttcgagtaggccatagtaggcagtcaggcctggcatgccatctgtcatcagagcgacagtcagtggtattgtgtcaggacactctgtcagcagctnttccagatctgtcncatcagatatgacgtgcgttgtccagcctgcagcagtcagtacgatagttcctctgagtaggcctactgtattacgttcagcatctctcgtgtatggagacagtaattgtgacgatgtcagattctactagatgtatctgtaaggtcactgaaatgtcagtcaagatccatcgccgatttctaccgatggtattatcataacggagctagtcattgagactcataatttaatgaactatagaatgtgatgtctgcatattctaataggcaggctgatgcaatgctgctcaggctggtcatgaccgcctgaatcctagcaatccat

SEQ ID NO: 539469 - DNA, 204 bp, Homo sapiens
agcatgtgaccgtggaatcccatgatccagccctcggtgggtgcggtgacggcgaatgcccaggcggcgacgtacacgttcagtgtccatgaccgcttcagcgtggtcaccatgtcccccatcacggcgatggactgatcctggcggatggggccctcgggtccggtgtagaggagggagtcgggcagcgcggtgaccaactga

SEQ ID NO: 539470 - DNA, 344 bp, Homo sapiens
  misc_feature (332)..(332): n is a, c, g, or t
ggatgcagcaagtcaggactgggaagcatttgctgataaacgcagagattgcttagtgaaaaaatggaagcaaacctaaatatccaacaatatgggaatggtttaaaaaataaggagactggccaggtgcactggcttacgtgtgtaatcccagcactttgggaggccaaggtgggccaatcacttgagcccagaatttcgagaccagcctgggcaacatggagaaacccccaggtactcgggaggctgagttgggagaatcacctgagcctgggaagtcaaggctgcagtgacccacgattgcatgattgcaccactgcactccagcctgngtgacaggagtg

SEQ ID NO: 539471 - DNA, 290 bp, Homo sapiens
atacagtgaaagtgttaagacgggttcacataacccagtaatccaattaggtttggtcctagcctttctattagctctaagtaggatcacacatgacatgacatccccctttaccagtcgagttccaccgtctaaaatacaccagcgtatacaaagaggggcaagagacatacaagacagcgagagacaatagacagtctacaaaaaccgttttagacttagcccaacagcccccaacgggaaaaccagacagtgaattaaaacctttaagacattaaaacgaaaagttt

SEQ ID NO: 539472 - DNA, 212 bp, Homo sapiens
tcgtacatagagctgtcccttggtacaccataaatcttgacttaccaccctacatcagatggcatgaattgatgctcgacaaggcaccagttgtttaaatgttattctgaattctctgtaagaatatcataaatacattcgtgccatgttggaaatatttatgcatgctcgtgtatgataaaattgcctggcctactttgccccttatcgag

SEQ ID NO: 539473 - DNA, 998 bp, Homo sapiens
  misc_feature (82)..(82): n is a, c, g, or t
  misc_feature (369)..(369): n is a, c, g, or t
  misc_feature (492)..(492): n is a, c, g, or t
  misc_feature (646)..(646): n is a, c, g, or t
  misc_feature (651)..(651): n is a, c, g, or t
  misc_feature (689)..(690): n is a, c, g, or t
  misc_feature (760)..(760): n is a, c, g, or t
  misc_feature (868)..(869): n is a, c, g, or t
  misc_feature (906)..(907): n is a, c, g, or t
  misc_feature (958)..(958): n is a, c, g, or t
  misc_feature (990)..(990): n is a, c, g, or t
taggcatatgtttacatgagtggtcgcgtgcaggagtgctagctgagtcttctcgtcatgcaggcagctgattctttgtagnttagcgtgatgaaaattgggaaggttccctcaagtccaagtatgtctcgtggttcagagcctgtgttaaagcttttggacgacaatgggaacattgctgaagaactgagcattctcaaatggaacacagacgagtgtagaagaattcctgagtgataaggcgcaacgcatataagtcttggttaaattgtgccctattcttgttggaccttatcaagtgggagatttctccgccttacaaactcctttagttttgcctttgttccattgatcatttttttacttgtncaatttgaatttattttcagatgataagagcggcagtatggttcattgatctatgggggagtttgtcagggttagcagaggggcatttccatattaattctcataccatctagataagcgtgnccaccacatcacgtaatgctctagtatccgacctgtcttcgtattttttgcacacgcttatttgtgtgctagttttggtccatgctctatgtaactaggatagctcgttatcatattagatggttcgagacttagacaagtagagtgtactttngcccntccacgtcactttctccgtctttgaacgaagagtggtnncgagtatcttctttgtgtctaggacacttacacaagcgcggcagccagcgtggccatcggcgtaacggcnacagatgtgatgcgttgtaatttgccagtgttttgtgatgcttacgtttctgggtttcgattgtggctctcgagtccatcgcatcgagatgttattgagtatattatnntaaattactctgtatcacactcacgatggagtggaanncatctacgtgcctatagcgatctcactgctcatccggcttgcctgtctgtncctctttatcttgatcatatttaatcgatatnctttgatg

SEQ ID NO: 539474 - DNA, 359 bp, Homo sapiens
ccagatcaaatccccttgggggggtccccagggggacagggggcccccccccaatgtatcaatgggggatttataatcccttttgccctttggggggggaaggggtttcccataggggaagttggcccccccccgggggctttggaaatgttttttaaaaaacccaggggggccggttttgtttcagggcaattattttccccaattttttgtttgggggggggaacggggggcccggggtttggttttccttttaacggggggaatttttggtttcatcccccttttttttggtttccaaggccttttttaaggcaaatatgaggggggggccagaaataaattttttttcccatcca

SEQ ID NO: 539475 - DNA, 150 bp, Homo sapiens
cagagctcggtaccccgattgcggggacacttacgctctcaccatgcgacacacctgctccctcttcaccttccaccatcatagccaccatcaccctcgttaacctctacttctaccttcgcctaatctacttcaccctctacacccaag

SEQ ID NO: 539476 - DNA, 361 bp, Homo sapiens
gatcgtggatgtatacatctttccgtgggcccagagcccattgagcgtggtgcagcgagtacctggacgttgtggagagtacccgttcatgcctgcatactgggagtcggggcttccacctgtgccgcatggggctactcctccaccgctatcatccgtcatgtggtgcataacagtgaccagggccccagtcccctcgctggtcgtccaatggtaatcgaccctggactaccatgggactcctcggagtggacttcactgttcaaacaagcgatggcattcccggggcacttccctgtgcccatgtttgcagggatgctgcacccatggtcgggccgagtgcatcactgactgactcgtg

SEQ ID NO: 539477 - DNA, 571 bp, Homo sapiens
cagctattaccactagaacttcgatattagtcatgaaaaatgttattcacccatacacctggtcttatcacagagtactggaaattggtagcaagagaaagagcacagtcagaatgtagggggtaggcatccgtgggtacagctccattcatctccttagaaaccagtcctgatccaggaaaatgtctctccattacggttgctgctagctctaagtgcacatctatggccataacaggaaattatgtgggtaattcggccaagagttgcctgtgtggtcaaggatgccggtagcgccaggatagtcaagaccaggggaaagaatttcagctcctgaaagggaaatctactgtcattattgcaaccgaatgattcctgaaataagtatttccaccatatgggtcaatgttgtccaggactcaggagtttaagagacactttcctgttgggaatccagaaattcttccttcatctcctccaagtcaagctgctgaaaatcatacttccacgatggagaaagatgttcgtccaaagaaagaagtataaccgatttctcttcattctgaaattc

SEQ ID NO: 539478 - DNA, 92 bp, Homo sapiens
gtcaggaatttttcaaaaaaattaaaaaatgggctggagctttttttttgtgaataaaaactggatgccccagtgattcatgtgggttttta

SEQ ID NO: 539479 - DNA, 664 bp, Homo sapiens
ctggagggcaattgtacaatctcggctcattacaacctccacctcccgggttcaggcaattctcctgcctcagcttcccgagtagctgggactataggtgcgtgccaccatgcccagctaatattttttttttttttggtatttttagtagaggcagagtttccaccatgtgggccaggatgttctcgatctcctgaccttgtgatccgcccacctcggcctcccaagagtgctgggattcacaggtgtgagctaccgcaccctgccattataaactattctcttagcctcagtgggcatatgcaaagcctttaggctgaccccgtgatctccaaacgtgctcttcgtgaaacaagcattttcgtggtgaccgtgccccagtgttgattaacgtgagtttggtgcagataccgtgagtggtggctctaatggcctctcccattctacgtgctttgctcagacccagacgtgacgtgcccaggacccggtttggaggggggcgtgcattattgccacaccattacttctctcaatagaggtgctcctctcagtgagcctctctctctctctctctcattactgactacctcggtgtagaaccccctctattttttccccccagacctatccctgttcccccttgtgcctcttgtccccgggttgg

SEQ ID NO: 539480 - DNA, 272 bp, Homo sapiens
gcataggcggaggggcggcagggctgcctgtctccactgtttggcggtgtttacacgtgtcgctgtcaaaggcccgggtggagttgggtggtagcccttaatggtccccgggtcctgtaggtttcagctggcctggccccgccacccagcccacacccttcccctagggccctttcaccagtgtgagaataggcctggggaagtttgggcccgggaggcccccgacccccactgtccagcttttaataaacttttttttgagaatggttaca

SEQ ID NO: 539481 - DNA, 987 bp, Homo sapiens
  misc_feature (215)..(215): n is a, c, g, or t
aaaatcttagtacaactttgaatttggcccagtgaatcctctagatcccgttgttgatttaactgttagtcctaataggaagagttctttggtgactaggaaaataccttgtaaagagagtaacaccctttaatgaccacgagtagataggcctaattacagcaagagcacctggttcaaggcacaagactgtgtcatggctcatatatccactnacctatgaattcaccacaagtgtatatgcttgaactctcctcgacatcgccgaatgtggtacctacctactgatcatgcctgatataaagatctaaagtcggtatgagtaacatgcaagacttgctcctgtgtataagtgctgcgctcagtagttagtaacactggaatctgtgcatagttatactatgctccaatattctacaatcatgcaacaagtcaattatgtacccttcagttgttcatacgccagggcgttcatggcgattcttcatatacggaacggtgttactatagagtcagaaggtgcgtcggtaattgctttacgccgcctgtttggccatcatacgtcacctgctagcattaccgagtatgagagggaccgtcgtgccgatgtgacacatgtttgacgggcgggtaccctaccgttcaaaaggtcgcttaggtcacttgtgccttacataggggacctgtatgactggtccagaggtacagctgtctcctacgttcagcagtgaaatcgactgccgtgaaagggggcgtgaccagaaggagagagactaagggctgattatgcacggtctgacaagcgagggccaaattacaacggttatattcggtggcgcgcgggaaaaacacccgggaagggatccgcgggaggatacaggcaatgccgaaaccgggggcccttaataaagggggcggcacacagcagggaaacagggttctcacaaactacctctcgtcgcatatttctctgaataggaaaagaac

SEQ ID NO: 539482 - DNA, 721 bp, Homo sapiens
  misc_feature (200)..(200): n is a, c, g, or t
  misc_feature (210)..(210): n is a, c, g, or t
  misc_feature (280)..(280): n is a, c, g, or t
tccctgtggagcagggctaccctataggcatcgtgctcagaggagcagctcagaggcagttctgtagtcatattgatacccacttttaattatatgaaaattaaggggtggatcatgcagacatttctagaaaaggtgtgacaacttccgggtcatcgggtcattgtcatggaaagtggtggtaacttctgggtgttacnaacaatggcnccctggtcagtgtgtcttatgggaaagtgtttttgccccatccctgttttagttaatcatcaattaggtntggtgtccaagcctcacctccagaatccagtactgcctcctacctcattagaattgttttcactgtgtgtcaacatgatcattcctctgttttaacaagggaataaacttaatgaacttcaacttcaggggattttttttttaaatgcaatttgagggccgggcgcggtggctcacgcctgtaatcccagcactttgggaagccgaggcgggcggatcacgaggtcaggagatcgagaccatcctggctaacatggagaaaccccgtcgctactaaaaataaaaaaaattagcagggcgtggtggcgggcgcctgtagtcccagctactcgcgaggctgaggcaggagaatggcgtgaacctgggaggcggagcttgcagtgagccgagatcttgccactgcactccagcctgggcgacagagagagactacgtctcaaaa

SEQ ID NO: 539483 - DNA, 1339 bp, Homo sapiens
  misc_feature (76)..(76): n is a, c, g, or t
  misc_feature (107)..(107): n is a, c, g, or t
  misc_feature (109)..(109): n is a, c, g, or t
  misc_feature (140)..(140): n is a, c, g, or t
  misc_feature (143)..(144): n is a, c, g, or t
ggcggccgagcactggctacgtgcgactgtggggagcggcgcggtgctgggtgctgcggcggcgatgctggccgcngccggggggcgggttcccactgcagcaggancngtggttgctccgaggccagcggacctgcgangcnntctcctccttgggcactgtgtgggccgatggcccggccacatctgggtgtgccaatggcgggggttttgtggaatgcgagcagccgctggctggagtgcgcattctcgtggggtgcgaggacgcctccgagggcgtgcgcgtaggaaggagccggcggccgcggggggcagctgctggtgctgccggggaatggcccgggtcataacggcgctcactgcccatgacgatccccgatgtgtaatgcgacctgcacgctcatcgcaatcaaccccgaacccggtgttcccggcgctttatccaagatcactcggagggtccacacaccatacagaagtacgggtctgaagcttgcttgcccacaggcgacaggtccgctctcgaccaagcactctagtgtcgggccggtccttttcttacaggaggacgatgacagcgccatgacgtcgggatgcgtggccgaagagccttgtgaattgcaacattcttaccaagcaaggggggaacggtttggccccaacgatcccatggagcaatggccaaggaaaccctatgggggaaccaaaggctatggggcccatttgaatcggtccatcgggtgcaccacgagcaacagaaggtcgcattattcaagcgcaggaacaaggctgggcaagcggtgggaaggcccgcgaagtgcaaggcccgagacggcaggtggaaagggaaacgcacggggcaacaaagagacccccagggaaaggggaacgggtcacaacaagccggggtggacacagggaaaagggcaaacgggccgggagacgggcacggacaagcttggcacgcggggcccagggacaaaccacgagacgcggaaaccatgttggacaatctggcagaacgcccaaagccagccaggagaaagacatcacacagggcattaaatcggaaaccccacacggggccagcgaacggcgactagcgacagaagagcggtagtggacagcacaaggagaaagtaaacaaacacaacggggataacacgagggacaagaggacgagaggaagaacagagaagccaggcgaacaagtaggcaggaacagacggatcagcagagaacaccagccgcgcagaaaacaccacacgaggcacagtaaaaccgccacacacccgaccaaacgggagaaagagagcaggcgcgagagaacgtagagcac

SEQ ID NO: 539484 - DNA, 100 bp, Homo sapiens
atgacgcagtgtgtctataagaactctcctccttcttctgcttctcactacgcagcgtcagcgaaggctgtcgcatgattaccccaaacgatgaggttca

SEQ ID NO: 539485 - DNA, 318 bp, Homo sapiens
tttatagacaacctagggtcagtcttgcaggtgagaaagccatttaccaagatagttgtaggtaaagaagggcagatttattagagaaatgtgaaaatatgttgcagctgggcagctcagcagagaaggggctacctgcaaagaggcaagggctggaggaaagttttatagggtcctgctgaagggtgctacgtgtggaatgaggtcattgtgcccgcgggttgtttgtgattagctgtctctaacaattgttcatacaataattgttcattattgttctcaacttggggctctccccaacctggggacccttcctta

SEQ ID NO: 539486 - DNA, 136 bp, Homo sapiens
ctcacaggacctgactgctagttctgaggacactggtggtgtgctatgtgtggccatcctccatgtacctgtccctggtagctgctactgttatagacagcggacagacgctcacgcctaggggcatgtcctacac

SEQ ID NO: 539487 - DNA, 576 bp, Homo sapiens
  misc_feature (76)..(76): n is a, c, g, or t
  misc_feature (263)..(263): n is a, c, g, or t
ccagaccgtcttccttataactaagtcatacttcgacattctgcaatactttctctcctctcagcacaactaccgnagactgtatcacggggacgtgtgagtttttatagaaaaaacaaggtacatgtacattcaaaaactcccacttgtcatgtataggagtctgctgggttgtttgacagcctgactatgagcccataaataacagtccgtcattccccaaccccccgcacctacacacacagcttattttgggaaactcncccctccctgtgtgctctgcgcagagaaagcgataggcatcaagtcgtcctctgcccgcctcctggagagatggctgcgcgctcctgcccttcacacctctcgcgccaccctcatttctgacccactgaatgctcagctgtttggcatttcctttgaatgacccagcatcttcccttttgttgtcggaaatcagacatcactctctattgcttgtacacttaagactccccacattctgtttattatcctctcaactggttatttggcaaatgtgctcatttataaaagttccagctgtctttttaaagtttg

SEQ ID NO: 539488 - DNA, 367 bp, Homo sapiens
catatgaaccacaggtctcacgtcttcaaggaaatggctctcatacattttcaccaaaaaaatggagaaacagaagagagaatgaaaacctgtgtatatggtttgagccaggttcttgacagacattacctcatttaaccctaccatcccacgccccagccgccaggaaggttctctctctctaataggaagaaaatgaagcctggtggggtgactagccccaacagtgtgcagagaggaggtagcaatactgccaaccacatgactcaggtcttcctggtaagcctggacttggaccctgatccatcctcaggtagagggtcacagaggcaaagaagaccctggcctccacaatagaaggtccaga

SEQ ID NO: 539489 - DNA, 177 bp, Homo sapiens
ggccgaggcaggcagatcacgaggtcaggagatcgagaccatccttagctaccatcgcgcttaggcaggagcccacccctcaatatttgtcttatccccaatttctccctccatagaaagaaaagtaaacctaaaggccagaaatcccacccacacgagccacccagggcccacacg

SEQ ID NO: 539490 - DNA, 103 bp, Homo sapiens
  misc_feature (25)..(25): n is a, c, g, or t
catcgagccggtaccgaatctcganagtgtgcaaccctgaatatacagcactagtaatattcataaaagtaagtccttcagtgaccagaccattaaaaagtag

SEQ ID NO: 539491 - DNA, 284 bp, Homo sapiens
ctgacctcagacctcctgattagccgggatacaggcacgtgccaccacgcctggcacatttttgtattttttgtagagacggggtttcaccatgttggtcaggctgatctcgaactcctgacctcatgatctgcccaccttgggctcacaaagtgctgggattacaggcgcaagccaccgcaccatctctgtatacattcacagacgtgtgtgtgtgcatttgtgtgtgtgtgtgtatttttggtttgtttgttttaatagcaccaccttggattctgtgctta

SEQ ID NO: 539492 - DNA, 520 bp, Homo sapiens
tggggagtctgagcccaggactggcaacgatggcgaagagggcctccaggtagacaggagggtgcgcaggtcctggagggcaaagcactcctgtcccgctgctgtcacctgcctggaggagccgcccgcccctggaggtggaggggtggcctccccgccaccctcggctgcctaccgcgccctcccttcgggctccgggaggcgccccctcctaccgggcacacagtcccctgacaccctgaaaagggcgccggccccttctcgacacactcggcctgggtggcgggggcggcgtttctggcttcggtctgctggagcggaacgccccgggcctcggttcggggatgcaccgacccgccgggcagaggcagcgagccggggctgaatcactccgcgggggcaggggcggccccagaagagccgtcggcctcggaggctcccggcgccggcgttcccggccgaccccccccagacctccatccgcccgcggccccgctcggccgagaagggaggcggccgc

SEQ ID NO: 539493 - DNA, 408 bp, Homo sapiens
actttccagctatcgggggatgagaatccacccagcacaccagcgctcgctccaccctgtgcttcgtcaggacagctggtaaaaagtcacaaacaccggagggtagcaggcaggccagcgcactccggtttccacagcgagtctctgtcatgattcgtgacgtgtgtggatcaacggggcagtgaccacaacaaaaggaagtctcacttacgccccgggcctcggttcggggatgcaccgacccgccgggcagaggcagcgagccggggctgaatcactccgcgggggcaggggcggccccagaagagccgtcggcctcggaggctcccggcgccggcgttcccggccgaccccccccagacctccatccgcccgcggccccgctcggccgagaagggaggcggccgc

SEQ ID NO: 539494 - DNA, 736 bp, Homo sapiens
ccgtttgcaaccagaaatcgctgttaattggtggggtcagcactctcgaaatggcgtaaggtcaactcaatcaactcccagagcagtaacatcgcctctgccccctctgatatttaaaccgcttctgccccatcgcagagtgtgtcctattcacctggcggttttacggccagtacagagctagcgatagagtccgctgaggctacacgtgttggctactgagcatcctatcataatagttcgtcaagagtcatagtgcatgctatacaggagccgtacacaaccgctgcatgatcgaatcacacgtgtttggcaccggctcacatccggccacgcaagcagtgatatctctggcacctggccagcgttcggtctggcatcctctcttgctacagcagccagggcatctctcacatcagctgtactcatcccaggcatagcccttatgagcagaacagtgcgcaagcagtgcacacgtcgtaagcatcgccgcctcatcagatttcttgaccacaagagtgcttggattctcaatgtaaacacgggagttcatcgacccaggctctgtctggtcgggaacgttagtggccatagtgtccgatggtaaggtttcacgcaaagcccgcaaatggagctgaaggtccacaaagtctcccacggaggggagggagaacagatgcgagtctgagtctcctactggcgggatgtgcgtagagaactcgactgctgctgtagg

SEQ ID NO: 539495 - DNA, 193 bp, Homo sapiens
  misc_feature (31)..(31): n is a, c, g, or t
  misc_feature (69)..(69): n is a, c, g, or t
tggaggagggccagctcagttgccgaaactntggagtggcggctggctagaaattggtctgtagaaatnaccttgaaaatggagttctggccaggtgcggtggctcacgcctgtaatcccagcactttgggaggccgaggcaggcagatcacgaggtcaggagttcgagaccagcctggccaacatggcaaga

SEQ ID NO: 539496 - DNA, 726 bp, Homo sapiens
agataaattttttaacccactcaagcaactcatatatgaaatacaggtgtatcacctcatatattttgtataattttctgacatatgtgagaccagttgatgggtctccgtctgcagcatatgacaccagattctacagaggttaaactagagaaattacgacatcaacactctcattcaaaataagaactggggacatcaggcagagaaaccagatctctgattagtcagtccaacaaatgtactaaacagattaatagtaattctaacggtagggagaagtgtctgagacagtctcatcaatttagaggttattttaccaaggttgaggatgcaatgaaaaaagagactaggttgcagtagcatctgtgatctgtgttttccaagaggtgttgaaggttcaatatttaaagggggaagagcagcaggagagaaggaggaagaacaaaatagggagggtagggagtaaggtaagtgtcacttctgtgaggttgacagtactcactgaatccaatgttatatgtaaaggagggcgggcacagaagaaatagtggcttctgcattgcactatctgtttaggccaacaggcaaggagtttgtgtgaacaattctcacgtgtaactcttcttttaacatagtgagttggaagtcccaggactctattttgctttctcaggaccacatcaaggtaccttaagcacatgatcagctatttgaaaatctaac

SEQ ID NO: 539497 - DNA, 108 bp, Homo sapiens
  misc_feature (68)..(68): n is a, c, g, or t
ttcaagcttctaacagatgtacggtggacatgagagaaagctgctgccaagaaagactgaggcccctncccctgcccttctccccgaaataaagaacagcttgacaga

SEQ ID NO: 539498 - DNA, 1092 bp, Homo sapiens
cttgtgtcgtttggtgctcttgtcttttctgtgttcctttatcgttggtgtgttcttcttgctttcccccatctcgtgtgttactccctttggtccttgtgttctatcttctgttcttgctgctcccgttgtttctgtgttttgtgtcttcccttgtttccactttttgcatgttgattgtcttgctgtccatgtccctcctggtgtcattccttggtttctgcttttgggcttgtcttggtccgtgttctcaacctgtcctgtctccgtgtccttgtcctcacgttctgatgctcatgcaatgtacatgatgcttttatccgtgctgttgtgtctcaattgacattctgaccttctcttgccgctggtggcttcattcctggggctcttgttgacattggacaggtgtgtatagggtggctgtcttccccaagttagtgttatcatggtgtttagagtgttggttgtccccatgggctccaacttcatgtagcccccgatggcagtctccatccacttggtgtccaggacctgctgggcaacaggactgtagagggttggattggcacccagtgtctacagtgcctcggctactaacaacctgatcgtgggccaggtgtctgccctctgaaatctgcctgaagtcagtcagggtaggacaatgtctggaggctcacagcttttatagactaggggtcctccatacccctgggctacagaccggtacctgaatccgggcctacacagcaggtaggtgagcagcaggcgatcatagggaagcttctatcatgtatcatacagcctcccccccattgatcacctacagcagcctgagctccgcctcctgtcagatcagtggaggctggagattgtcataggagctggaaccctatggtgtactgcgcatgtgaggaggttgccgcgcttcttttgaaaacctaatgcctgatctctcgttgttgcaccatcacctccagataggactgtctagatgcagtaaaacaagtcaggctcccacggatcctacattactgtgagtgtgtatatttcactatatgatataaccgacggtattgcaataaataaccactc

SEQ ID NO: 539499 - DNA, 223 bp, Homo sapiens
tggttgatctagaggatcccaatcagtttacacaagtgtctttcttttcttttttttcaaagtcgaggcctcattcttgtcacctaggccggagtgcggtggcatgatcatagcttaccgtggcctcaaactcttgggctcaagtgatcctccctcctcagcctcccaagtagatagaactacaggtgtgagccactgcacctggcttatttttttttttttt

SEQ ID NO: 539500 - DNA, 662 bp, Homo sapiens
  misc_feature (18)..(18): n is a, c, g, or t
  misc_feature (232)..(232): n is a, c, g, or t
  misc_feature (234)..(234): n is a, c, g, or t
gtcgcgtgtactgcgacntaccatgctgtgtgtcattcacgcacaggaacaaagaacatgcaggaaagcgaccttcatacagcgatcatgcgaagcaagttggaacttgaatcaaatggcattgatctgggttccagttcaagcatggcgtttcatgtgggcaacacgatgacaagctgcccggcagtcatggtgttgccgagtttgccaggttggagtcatggccctcatnancagttactcaagccgattcacgctgaccccgttgcgcccgatacgacgtttgatgaactctggaaatgtacacagcaacactacggcctcacggcagccacagtgatcactgacgcggcgggcatacccataagcaaaattgtggtgggtgcttgggttcacgtcggctccagcaaaaccacgaacctggctagcctgatcggaatgcgctttttccctcgtacgttgatcaggcaacccaccatggacagaatggcaaaggcaacgtctggcacggtgcgggtatttggcatcatcgggcggggcatgcccttcgtcgctgccgggcttgcagtctttgacctggtcagtattggtaagtgtgcctatgaggcgacgaatggaaggtagcctggccagagccgacatcagcgaaaaagtgatcagct

SEQ ID NO: 539501 - DNA, 191 bp, Homo sapiens
acatccgacgaaaggggaaagagaaagaaccagggagaacaagcatctggaccgttgagtccccataaaggcggtgagagccggtgcagctactagacaatctggtaccacaggtcctgtaacaataagttaatcctcatcactggggagtttcgatcatctcccttcatacctcaaactggtggaattat

SEQ ID NO: 539502 - DNA, 107 bp, Homo sapiens
atcagccggtacctgctgtggggactggctggggcatggcaggcggctcggcttcccacccttctgttctgagatgggggtggtgggcagcatctccgctttggaaa

SEQ ID NO: 539503 - DNA, 973 bp, Homo sapiens
  misc_feature (18)..(18): n is a, c, g, or t
  misc_feature (130)..(130): n is a, c, g, or t
  misc_feature (437)..(437): n is a, c, g, or t
  misc_feature (439)..(439): n is a, c, g, or t
  misc_feature (464)..(465): n is a, c, g, or t
  misc_feature (467)..(467): n is a, c, g, or t
  misc_feature (470)..(471): n is a, c, g, or t
  misc_feature (476)..(476): n is a, c, g, or t
  misc_feature (480)..(480): n is a, c, g, or t
  misc_feature (483)..(483): n is a, c, g, or t
  misc_feature (497)..(497): n is a, c, g, or t
  misc_feature (501)..(502): n is a, c, g, or t
  misc_feature (504)..(504): n is a, c, g, or t
  misc_feature (513)..(514): n is a, c, g, or t
  misc_feature (565)..(565): n is a, c, g, or t
  misc_feature (574)..(574): n is a, c, g, or t
  misc_feature (585)..(585): n is a, c, g, or t
  misc_feature (623)..(623): n is a, c, g, or t
  misc_feature (644)..(644): n is a, c, g, or t
  misc_feature (705)..(705): n is a, c, g, or t
  misc_feature (964)..(964): n is a, c, g, or t
aagaaatgcagcaagagnaagaaatcccccgaaccagtcaggtttacttacgctggatgtttgagtgtgaagaaataccggcccaagtactgcggttcctgcgtggacggccgatgctgcacgccccagntgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaaggaagaagagtgtcagaatcagaatcatggagaaaatgggcggggctggtgtggcgtgatggcactcattgtagaaaggaacccttgctcattcttgaggancnttaaggtatttcgaaactgccaagnntnctnntccgnatgnacnctaatgcacccccnattnngnaatactttnnctcatagtattggagcaccatgttactgcttcattttggagcttgtggagntgatgactntctgttttcgntttgtaaattatttgctaagcatattttctctaggctnttttccttttggggttctacnagtcgtaaaagagataataagattagttggacagtttaaagcttttattcgtcctttgacnaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacctaanaaaaaaatt

SEQ ID NO: 539504 - DNA, 626 bp, Homo sapiens
  misc_feature (144)..(144): n is a, c, g, or t
  misc_feature (153)..(153): n is a, c, g, or t
  misc_feature (164)..(164): n is a, c, g, or t
  misc_feature (202)..(202): n is a, c, g, or t
  misc_feature (223)..(223): n is a, c, g, or t
  misc_feature (284)..(284): n is a, c, g, or t
acggaagaccctggtagtgaccataaggtgttgaaactgccagggtgctgtgcggatggacactgaggcagccactgttggagaaatcgttgggtcatagtattggagcaccatgttactgcttcattttggagcttgtggagntgatgactntctgttttcgntttgtaaattatttgctaagcatattttctctaggctnttttccttttggggttctacnagtcgtaaaagagataataagattagttggacagtttaaagcttttattcgtcctttgacnaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaacgagagagagagagagagagagagagagagagagagagagagagagagagagagagagagagagagagagagagagagagagagagctcgtgccagaattcctcagccacg

SEQ ID NO: 539505 - DNA, 1058 bp, Homo sapiens
  misc_feature (18)..(18): n is a, c, g, or t
  misc_feature (130)..(130): n is a, c, g, or t
  misc_feature (437)..(437): n is a, c, g, or t
  misc_feature (439)..(439): n is a, c, g, or t
  misc_feature (464)..(465): n is a, c, g, or t
  misc_feature (467)..(467): n is a, c, g, or t
  misc_feature (470)..(471): n is a, c, g, or t
  misc_feature (476)..(476): n is a, c, g, or t
  misc_feature (480)..(480): n is a, c, g, or t
  misc_feature (483)..(483): n is a, c, g, or t
  misc_feature (497)..(497): n is a, c, g, or t
  misc_feature (501)..(502): n is a, c, g, or t
  misc_feature (504)..(504): n is a, c, g, or t
  misc_feature (513)..(514): n is a, c, g, or t
  misc_feature (565)..(565): n is a, c, g, or t
  misc_feature (574)..(574): n is a, c, g, or t
  misc_feature (585)..(585): n is a, c, g, or t
  misc_feature (623)..(623): n is a, c, g, or t
  misc_feature (644)..(644): n is a, c, g, or t
  misc_feature (705)..(705): n is a, c, g, or t
aagaaatgcagcaagagnaagaaatcccccgaaccagtcaggtttacttacgctggatgtttgagtgtgaagaaataccggcccaagtactgcggttcctgcgtggacggccgatgctgcacgccccagntgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaaggaagaagagtgtcagaatcagaatcatggagaaaatgggcggggctggtgtggcgtgatggcactcattgtagaaaggaacccttgctcattcttgaggancnttaaggtatttcgaaactgccaagnntnctnntccgnatgnacnctaatgcacccccnattnngnaatactttnnctcatagtattggagcaccatgttactgcttcattttggagcttgtggagntgatgactntctgttttcgntttgtaaattatttgctaagcatattttctctaggctnttttccttttggggttctacnagtcgtaaaagagataataagattagttggacagtttaaagcttttattcgtcctttgacnaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttgggcatgaaaggctggacatgattcatgtcgaggccttcatgcccaaggccaagacatcatgggcacttagacacgtgcaaatatgcagagacgtgcgagtggcttccgtgaaccaagctgcggctgtggagaccacccaccaccacagatgtttctgttccggtgtgacctgaccccctggcatgaaggcactgacatgaagggtctt

SEQ ID NO: 539506 - DNA, 103 bp, Homo sapiens
gttttcgaagggagtgatgttcaaaagccgctcttctccgtaagggagtgtcgctcagaatctagtttcttcagaggaaagatgtaagctggctctgggtccc

SEQ ID NO: 539507 - DNA, 500 bp, Homo sapiens
gtgtatgtgttatatcatgagagtatgcttggggaagcatggagagtgatatgatggttgccatattatgtcagtatagactattgactagatattatttgttttgggtgtggagaaaatttgcgaggatagggtctcaagatataatgctttttatagtcgtgcaggtcttaagagatgatgtgtccagaggaacggatgaatcctgcttggaagcatggtgggattgccatttggaaggaggtgtttgcatggaagcatgtccttgtctgggagctgctcgtggagcttaagggttgtaggttgtatgtctgatcggctctcggcctaatcttgtggcttccaggaggaagaggagagatcaagctggctgtctgatgggcatggctttattctggaatggtgaagccaatggagagggtcctgcagatggacggcagttggtgtgctataaatgaccgggtagggtctggtccattgaggctgtagagtttgagggg

SEQ ID NO: 539508 - DNA, 120 bp, Homo sapiens
ccaaccactcacttactacagcaacttagctaacattaccaataagtatagcgatagaattgaaacctgccgcataatatagtacccagcaaagatggaaaattataaccagcataatat

SEQ ID NO: 539509 - DNA, 397 bp, Homo sapiens
tcggcacgagatgggatgttcctgctgggttaggccgcgattctgtgccttgtatgggcctctgtgctatgtcagactctcctctgatcctcaagccctacctgtggagacactccactcctagaggcaggctcagggtctgggatttccctgcgaggagctcagacaccactgtgccatggtgacacaagccaaggcagacattggcccttccttgtcccagaccccagagggctggccttgggttcgtcagaatgggccgaggacgttggctgttgaatcctcctctggctgggagtggctctgtgtggaccacggccttactgggccattctttttttgacgcagacaatctgtgaccactttctcccacagatgcctcctgcgtggattctgg

SEQ ID NO: 539510 - DNA, 405 bp, Homo sapiens
aggtccatgtcaaaataaagctgagtaaagttgtccaaacaaactcaccagacaggttacataagatagtgtaccacaacaaatataaatatatgaacaaaacacatcatctcctcctatggatctcacacagaaattaaagtctccaaatacagacaaatactatccatatctccagactattctccagattcacgagtcccagccaggtcggcccatccacactccccaatgaagtctggtcctttcttcagtagttgctgcatggagtcgtcttccagaattaatgcagctccttcagcacctccagagctggagagctccaactgtgagtctcatgtgtcacacacagacccaaagttccagggagctatcaggtcacacaagaaatagcaaagcacctca

SEQ ID NO: 539511 - DNA, 231 bp, Homo sapiens
gggggggcccccccccccccccccctttttggttgcccccaaggttggggagggggccctttttagggggggccttggggaaaggggaccccctttggggttccccctcccccccccccccccgggggggtttttttttggggggccccccctgccccccccccccggacaaaaaaaatttttttttttttttttttgggcccaaaaaaaccccccccgggttttccccca

SEQ ID NO: 539512 - DNA, 941 bp, Homo sapiens
  misc_feature (806)..(806): n is a, c, g, or t
  misc_feature (941)..(941): n is a, c, g, or t
cgacctctccactcccgtgatccctcggtggtcgccccccgggccccgtcgcctgtcaccatctgaagaatgtgtacttctccctccagaaatatccagttaaaaaacgggtgaaaatacatcccaccacagtcgatgcgtgaactatacattctcattataccccagtcctggctgatgataggatctcgaacaaatcacctgtaggctatgcggaattcttatgcgcggaaatatccaaagaaaaggtctcgctcgattgaaaccgcacaaaaaacgcgtgagctttcttttgtaaccatggcatacctctacctccaccaacagcaagacccaatcgaccaattgagatacggacaattaacatgcgcttctccccaaagaaacattctctccaatcccctaactaacgtggtatagatgctgctctcgcgatctgcccatcggctcatcggactgtaataactacttatctgctcacgctctagctctagatcaggtctaaagttttccatcctcgtagaaactgaccctactaacccgcttttattattcatggccctaatacgcgggctactcacgtgctctctcctatccagcgctggtccctcttccggtacccccacggcctctcctatttccctacctcttaatattccagagtgtttgacattcgccctctcctaaccccttgtatatctacccaacatcccctcccattgatactacccccgcgcgcggcccccgcaagccggtacaccgctcttggactgagggcgagtcagccatcaatgagaagaccccanagcacactatttatatgcgccctactgcaagatgtttctcgttcattcctccccaccctgaagccccaccccccgtcttggccccagatccgctgttctcgcccgcacttcctgttctttcctgcccctatcccn

SEQ ID NO: 539513 - DNA, 383 bp, Homo sapiens
tactcaggtggctgaggcaggagaatggctttaacccgggaggcggaggttgcagtgagccaagatcaggcccctgccctccagcctggatgacgggatgagactctgtctcaaaaaaacgaaaccaaaattttttaagagaaatgtcctttggttttggttttgagacagggtctccctcttttgccccccctagagtgcagtagggtcccggctccctgaagtctctacctaccgggtcaattgatcttccccccccagcctcccaaatagctgggagaaatgtcctgtttttaatgaatttgtcttcccttttgtcttggttgttttaaaatctagtggtctaataaatttggatgatatcttttggctttccattttga

SEQ ID NO: 539514 - DNA, 579 bp, Homo sapiens
gaccctttagaaaataccaactgtgagaaggatttaattgcctaatgttaaaaacctatcatctaaattactttcagagaggatttgttagatctcggttggaaatgttttaattgaatatttaatcataatcagacttcgtatgaactaagctgcatttcaatcagtttaaaacaccttctcagttaccttcttcagattcaacagcaagctaatactgtttcgagatcagacaggaaaatattctcgtcggcggcatgtgcactttggtgttaaggcagtttacccatctttggctgatcgtggggacaagtgcaaacttccagtagaatcccggtctttcttcatccaagtgcttgcaggggcagccttgtagtctgcaaagaaccatgcagaaaccaaagagcttgctttatttggtctctggtaattccttagggtctgtgatatatgccaggacagtctgatttgacaacctaactatgcttactaattctcccattattccctcaaaattgtcgatatcacagcgccacttggcctaacatttcgaaaagtaaggacaaaataataacccag

SEQ ID NO: 539515 - DNA, 503 bp, Homo sapiens
cagttgctaaaccaaatcaactcccttcaccccatctggcagtatggctctctgggaactcagattgatcttgcgtgcctgtttcctattgagttgggggaccacagtggccgttcctgcttcaatcccttcagtaagtagcagggagcatttcctaggctgggtcctaatggcacctaatggtcacaaggccaggccccccaccctcctgaagctaacagggtaatgggggagacaccactaagtacacatccattcctgtgaactgtggggaggcctgccatggagaagcatagggagccaggccagtgtagagaaaggcacaacatccaccagccttagggatccaagagcaaagtcattcctgagaaagtgacattgagcagagttctcaggatggatttgcttggctgaaggcagatgggaaaatcccaggtacaaggaaaagcaccgacaaaggccctagacaagtgaagactcagagaagggaaggagaccatcaa

SEQ ID NO: 539516 - DNA, 117 bp, Homo sapiens
gcaccccgtagtatgtttacgtctggaactaaatcttaaatgatgagatttttctacttggaaaaggatttttcaaatgaaacattgaattgctttgaactataaatccctttcttt

SEQ ID NO: 539517 - DNA, 829 bp, Homo sapiens
ggttttgtggaaaacccacatgctcctcagaaagatgatgcctctggctgatcacacactacaaccggacccgacagcaggatagagatgctggggcttcaagaataagcaccagcagtagaagccagaagaggaagatctcagcaaatgaaagtgctccagtttcagtcacgaaactgcccagaatgcaattgccctcgcgacttctagacctaatcatgagagctagatacaaaatccctcactttaaggagagttatctatcgatggctaccaacgtgcggagaactgtgtggcgatcggaccaattgaggtgaaatctggaggagcaggtagaacccttgggcaccaggatcaccctcctacatcactagatgcctcagtatatgaccagagacctcctcaagctctgagacttgcatgtgtggaaactcccagagctagaaatttgaactgggaatggcagtcctcggggtgcaatgttcaagcacactggaagggctgcgtgaaagacatccgggaactggttgaccaaaaattcctttcacactgggcgacagattccaatcctggacagacggagagactacaggagtttagccagaagatggaccagatcatcgaaggttacatgaaggccacgtttattatggatgatccagcaggaaacagtttacttgcagaatgtgtatgcgcctgaagatgatcctgagatgaaacgtggggcgttaacaaagcggactttgaccaaaatgaggagctagggctccatgactgaagacagagggcttgaaggagctggtcgaagggcgggtggtccaggcactcg

SEQ ID NO: 539518 - DNA, 277 bp, Homo sapiens
ggtcgacaccgaacggatagctgtttactgactttcgccacgctcacgggcaatggcgcggtaccaatgtccgtgcggtagaagcagcctttccagtcgatcttcgccgccagcttgtaagcctgttgctgggcggcatctacgctactgcccatggcggttgcgcacaatacgcgaccaccggcggtgacgaccttgccatccttgagcgcggtgcccgcgtggaacaccttgccttccagcgtacgagccgcatccagaccttcaatcagtcgac

SEQ ID NO: 539519 - DNA, 146 bp, Homo sapiens
  misc_feature (11)..(11): n is a, c, g, or t
  misc_feature (140)..(140): n is a, c, g, or t
  misc_feature (145)..(145): n is a, c, g, or t
agggggctaanggttgggggcaggaggcattgctgatgatcttgaggctgttgtcatacttttcacggttcacacccacgacgacacggggactcagcagaggggcaagacacgacctttagtttcccccttgcgataancttcnc

SEQ ID NO: 539520 - DNA, 494 bp, Homo sapiens
ggtgtttaaaaagaaagaaaagttgttttatctaaccctgtaagtagttgtcatattctggagaatttaatagttttagagttaagatatctcctctctttggttagggaagaagaaagcccttcgccattgttgtaatcctcccccgcctttaaggtttagctccacatcatgcttctcttgagaattctatttggtagttccacttacagaaactgattagtttgtcagtttgcagatagatttagcacagtactcatcccccggatagattgagatgttctttcacatcatatgatctgtggcactgtaagacactgctcttggcacctgtttaatcagttttatttccgttcagtataagtgacctaagttattttgctgtcccgtttttgtaaatcaaatgcaatcaccaaaaaggattctgacagtaggttttttgtacatatgtatatatgttgtccaaataaaaataataaatgataaaaaaaaaa

SEQ ID NO: 539521 - DNA, 266 bp, Homo sapiens
tgagataaccatagattcacaggcagttataagaaattatacagagtgatcctatgtgctccttaccaaatttgctccttaccaaatttcccccaatgggaacatgtggcatcactactgtacaatatcacaaccagaatactaacattgatgaaatgaagacatagaatatttccatcaccacaaggatcattcatgtagcccttttgagggctcactcccttcccttcttcaaccccttcttaacacctggaaaataataatct

SEQ ID NO: 539522 - DNA, 181 bp, Homo sapiens
ggaatttgaggttgcagtgagctgtgattgcaccactgcactgcagcctgggcagcagagtaagacccgtctcaaaaaaaaaaacccaaaaaattaagtgagggcggtaaggttgtcttgtttcaggagagggatcagcatgtatgagagcatgagataacattgtgcagttcaggaactg

SEQ ID NO: 539523 - DNA, 243 bp, Homo sapiens
  misc_feature (86)..(86): n is a, c, g, or t
  misc_feature (104)..(104): n is a, c, g, or t
  misc_feature (146)..(146): n is a, c, g, or t
  misc_feature (221)..(222): n is a, c, g, or t
ggtttggatttgtgtccctgctcaaatctcatgtggaattgtaatcctcgatgttggagaaggggcctggtggaaatgtgactggntcatggaggcagattttntccttgctgttcttgtgatagtaagtgagttctcatgagatntggttgtctaaaagtgcatggcacttcaccctgttctctgttttcctcctgctctggccatataggatgtgccannttcccctttgccttccactat

SEQ ID NO: 539524 - DNA, 228 bp, Homo sapiens
taccgatgcttaggcatggggtctgtagacacaacttgcggtacctctcctctccagcccttctcctgtgtgctgcctcctgtctgccgcaccatgaccacctccatccgccagttcacctcctccagctccatcaagggctcctccggcctggggggcggctcgtcccgcacctcctgccggctgtctggcggcctgggtgccggctcctgcaggctgggatctgct

SEQ ID NO: 539525 - DNA, 491 bp, Homo sapiens
cattcctggttaaatagaaatagaatagattggaattgctaaaatataatgtagaaacaataacaaatattatctcgagcagtgaaacaatggaacaatttaatttaaaattaaggactagcagaaactcccgctatcattgttggtacttagtactatctcagttagaccaaagtctagaaaataaaataagagctggtaaagctactgtaagagaaaataagatttaaaacataataaaattattttttcttaatgctatgttagatgtctacaacatctaaaaattctaaaaaattgataacatttctttaaaaaatgtcttcgatctgaggataagtataaaactgttcttttccttctttcttttttgttttgttctttagcaaagtaccatgaatggtaatggagaaaaaaaaatccctttcataatgacaaaaaagttgatcaaaatcaggtgtgtaaatttaacaaaataatcacatgatcta

SEQ ID NO: 539526 - DNA, 845 bp, Homo sapiens
agcggatcatgtcacaagtcaagggtaacatcaagaaaaaaagcaatgaatgagtttgccgacgttcccctgtgttgagtagaattatttgctggcactattgagttgcctagtcaaatcccactgctgccagtaaggggcatacatggctgctggcaacttcatatatacattttcgtttgtttgcttgtccttccttctaatggttaattcctctgcagagctaaaattctgttgtcataccagtgaataaaaatgtctgaaattaacagtaaaatgtgttagcataatgaataactttgacaataaaaagtgtatctacaggttaaatgtagtctatattgcgaagtacatctgttgtaaatatcagccatcaagtgaaacataaatgtaatttccagacaattgtagttggtatttgtggatgcaaggagcttcaatacttgagtgatctcaaatgccttgcgttatgggtaactaagtgtttagcttcattcttccgtttgattctctcaatgaatctatagttatacatggggacacagagccttgtggggatggcgacagggcaagtgatttgctaatcgactggtggctagctgaaatgagtgtgcctgtgactctttacacatcctatgtttggccagagcagcagccgtcctttacttactttatgaaatctgggactgtggtatgcttgcttcaagctgaacaagaaggacaggaagtttaccgcattaagctaagcccccatatctactgaaatttacctcttcttcaacactgttactatacggactgcatcacatttcagtattcgatatcctgattgcataacttataaa

SEQ ID NO: 539527 - DNA, 254 bp, Homo sapiens
gaccccacctagcaaagacacacagagcaccaagttcatgccagccaccatgctcagcccaacaacacaccttatatatacctgtttttttctgtgctccaagaacttgacctgttttaactcctttaatcctcagaacaacctcttgaggtgaccactgttactatttccattgtacagattggggagatggggtacaaatgctgtccaaggctacatagccaacaaatagggcagccaggatgtaaacccag

SEQ ID NO: 539528 - DNA, 204 bp, Homo sapiens
cactttgcttagaagaggactctcctagcggcagagggtgggaggggcttgcatcacgccttggagctggttgctgcggtcatcagtatggctgcttgttcacgaagcgggacaacatggttaaggcagcgaggggcttgtcagtcagaaccatgttgccgatgacccttgatcgtgagaaatgcgatgtgcgagacctcattc

SEQ ID NO: 539529 - DNA, 118 bp, Homo sapiens
  misc_feature (43)..(43): n is a, c, g, or t
tctctgctgctccctcttcattcgatgggatgtcaggcttcancccaaagaggcttcattatatgcttcttctctgtgtgctggtgaacccacgagtctaggagcttcttgctgtagt

SEQ ID NO: 539530 - DNA, 418 bp, Homo sapiens
gattcgcatttcccaggatggtgtcagttttgaatgttgttctctttcaggcaggcatggtgaatctgcgttcagacaacacgatcactctgtcacgctcctgagcgtgaactgttggagcagtcactctgcgtcatcacccaaggctactccctagctcctgcaactgcgaactccactctccatacttctctccaactgctctcggctagactccgccacttcccccgcgcatctgacaagagttctccaagagcccccacttctcaggcggcaacaggcgcaggtacctggcgcagcccttatcctactcctcataaatcaatctgagttttatgggtgctttttctgaggaaggagcgatccaaagctatgtagcgcccacaaacctctctactaatatttttggcaggctgct

SEQ ID NO: 539531 - DNA, 434 bp, Homo sapiens
gtccggactaactaacaggcaaagcttaaaatttgctggtactttaacttgcagagaaatttaactgcttccctcaacctcctgcccatatcagaatagaggcctttgtatgctagagtttccaataccaaataatggcaacaataataaatagtgacaacattttacattatatattactttaagttatagcaaagcaaattttgagtagggctctctccccaccagcaagattcttgggatcttatcgtttgtggggaggaatctggaaactgtattataatagacacccttttatctgatattattgaattgttagtagggtaactattaacaattaattgaaaagtcagttaatacaaagattcataaaatgatatgttttatattttattaaaatgtgtaacctgtgagtataaggccagtacgcgtat

SEQ ID NO: 539532 - DNA, 164 bp, Homo sapiens
atacaggatggtcatctcatgtctctgcacaacaggaactgttcagcaggctgatgcctaagatctaagcgttacctggctacagacagaagatgccagatgacacttaaggcctacttgtgatcatataaatgatgcactaaccgacctattagaactggctt

SEQ ID NO: 539533 - DNA, 171 bp, Homo sapiens
agaacctggagatgcatgagcacacacacatgcgcacagtacacacaaatgcacacacacagatgcaggttacacacgaatgcacacacatgcacacacagatgcacagtatacactgaatgcacagacagtcacaaacatagagtgcagggtacacactgaatacacaca

SEQ ID NO: 539534 - DNA, 242 bp, Homo sapiens
gcaattcgcccaggactggaatttgccccagggagggttcagatgaagcctgcatacccggggctggttgtcagaacgtgtagttgattgcaaacaggcccaagcctgcggtttcgcgccttaccagcgggttgtcgctggccttgacagcgaattgagtcagcgtcaggctggccagcgttgaccagtgcgcgtcgaaggtgtgctgccagttcagggcagcggagtaggcatagatcccg

SEQ ID NO: 539535 - DNA, 225 bp, Homo sapiens
cacgagcgcccacgtgtaaattcatatagaattttgcggtctgagcacggtggctaatgcctgtatcccagcactttgggaggccgagtcaggatgatcacctgaggtcacgagttcaagaccaacctggccaacatggtgaaactccctctcctctaaaaatgcaaaaattacccaggtatggttggcacacgtctgtaatcccagctactttgggcgctcttg

SEQ ID NO: 539536 - DNA, 256 bp, Homo sapiens
acgtctcaccacccatctgtttctctatagcatgaaagagaggtgctaccatggattactataacaagcaattatcagatgactgtttgggtgcttggactggcttggaatagtatctgcccctactattgactcttcatagttattccagttataaaggagactgatcggaccatgtttctctctgcgagtctcttggggaggttgggctggtaaatatttgcaaggtcatcccgcccgacgccgggcccccgta

SEQ ID NO: 539537 - DNA, 396 bp, Homo sapiens
tcatctaagactagaacttgaaaatggactgactacattgggaaatagcctgctgcgacaggcattgtcatggaagttacctgggttgcgagttgtgtcagacacattcagttctgggagcagcatggcagcaacattcgattcatgggctgtccaagaagagtccgtataatcttgccctatgtctttagattaacctggcttggttggcaggtactacaggcatgtgtaacttagcggatacacacttaactaaagtggttacttctgtactaactatcctgggcgtcaagtcctctactctgctcatctccaagggttctgggcacatagagtagatatgactggccctgcccatgtggctggatgcgcaatgttgggcaacattatgctggg

SEQ ID NO: 539538 - DNA, 266 bp, Homo sapiens
ggggggccccttttttttacccgggaatccccttttttttttggcccccccaagggaaagcccccccctcccgggttttttttttaatttgggggggggggggccggtttttctttttttaaacccccccgtttgggggtttccgggggaccccccccccttttttttttttttttttgggggggggggggggcctttggtttttttttttttggggggggtttttcccccctgtttcccccaaaattttttttggggctttttta

SEQ ID NO: 539539 - DNA, 182 bp, Homo sapiens
tgccggcctcccaaagtactaggattaaaggtgtcaccccaagcacctggctactcttcactaaaaaaattgtttcctctgttgtacagagcttttttaacttgatgtcatcccatccgtcctcttttctttggttgcctgtgtttgtggtcgacgcggccgcgaatttaagtagtagtaga

SEQ ID NO: 539540 - DNA, 510 bp, Homo sapiens
  misc_feature (34)..(34): n is a, c, g, or t
agaacgccgggggcattggaggggtggcattcgnaatccttgctgatggggatgagcgataaaaactagcactcaaaaaccagcaaaaatcccgagaactgacttccagaaacttcagacgtcactctcgtccctgccttacatggattccaatcgggagtcaccgtaagactggaacggctcttgtccgctcgttcccacgctctgcgtgggaacgcatcccgtgacgctccgcgtcaccactgcgcaagacttgagccctgcatcgtcagttggacgcagagcgtccgaggcggcattcccacgcggagcgtgggaacgatcatcaacatggaggtcaggccaatccggcctcgaccaacaacgcctccaaccccatcaaatccggcaccctggccacatgctcccccacctgcaccgccgccagttccagcgggcacaacggcacgtccacataactcagctggctatcgagcttgtacgaacgcggaatcccgactcaggtggtgt

SEQ ID NO: 539541 - DNA, 200 bp, Homo sapiens
ttgagagttatagaggactaagcatagatggggtatctaatacccagaacgggtctatagctatagtagtagtacagacatgtaaaagccactttcgtagatctatttagtagtcaactggagtattttacaactcaggtgagtattagctaaattggggagggggtgatctaaaacactctttacgccggcttctattg

SEQ ID NO: 539542 - DNA, 999 bp, Homo sapiens
aaaatcgtctaacaacctggtcgtctgccggtgggtaggcgcgaagggcgttatcgtgggtgataatgatggatgggtggcggggcgctcgggcgtcgggtggtagtggctgccgtgcgacaggtgcgctcttgggcacctctgtgctgctcgggccggcttgtgtgtatccgaaagtgtcgcagggatctcttcggaaggtttgaggattatattttaggtttgcgggcgttcatatagcggtagttattcggggctgctcccgccgttgttatgtacgtggcctgcgtgcgcgtgggcatggcattacgtggtgttggccgcttccaggtcagtcgacgtgtgctgggtggggggaacgcgcccgggtgagcggtggcagaggggccccgagcggtcactaggttggcgctgggggaagaatcggccaaggggggaagctggtgagtgccgcggaggccgagagctcttgcgcaagcagattgtgcccccggcgagtggagcattgtacaagacgcgccccgcttgcaggccccctaggggcgcccgctggccgagggggggaagcaaaaagcgctgcggggacattgtgaataagtaagcgaaacactgggcaagggaccagaaaataagacattgtcggtgaatcatgagggcaagggagcccttgcgagctgcttttcggaaatctgccctaggggctgcgtctctcatgtagagggcacagcggtgtggccgccgaggaaatttggattgctccttcagtgctgtcccacccggtggttgtgctgtggagcgttgcacacgcccctcatagggatatgtgtacgggtcgttgtaagacaactgcgtgatcgcctactgaagcaattaggtcccgaaacaagtggatgtaatctgtagtcttatcttgcgccccaatgggcgatattcttcaaatcgaaaagcattctttctgaaaaaaatttgctataaaaaaaataaaaaaatcaaaacgga

SEQ ID NO: 539543 - DNA, 430 bp, Homo sapiens
tgccgggtcgactctaaggacccgctgatcgcttagtattacgtgagggaatgaaacttgcatacacacgaggactcataaaattcatgttacatagcagctttattcgtaataaccccaatttggaaacatcccaatggccctccccagggggatggattgacacactgaagtatacccatactctggaatactactcagtagtaaccaagaaccacattactgacaatacaacacagggtgaatttcaaaatactacgctaaggtgaaagatattagctacataaggtaacatactgtgtgattccatttatatgaaatagttctacagggcaaactacagtgacagaaagcagattggtgttcgccaggatccatgcatgggagagaggactggctggagaccgaaggaccttttggggcttaaagc

SEQ ID NO: 539544 - DNA, 234 bp, Homo sapiens
acatgggctcattatatctagggattataccttatctaaggctcaactacgatcaacagatatctaaggctcataaggctgatgccactcaccccatgtgtcagccttacttccatggccttatacccacgagctagtcatatgtcaagatcctaccttgccttgcccccaaggcggggtgtccataagagcaggtggagatggtacaaagaacgagaagatctcattcatatg

SEQ ID NO: 539545 - DNA, 122 bp, Homo sapiens
agagcttgaaataaatagagcatccagacaccctcatggacagctgcatctatgataaatatccacactatggacagaaagatggaagcaaaccaccagacttaagccacatataccagtgg

SEQ ID NO: 539546 - DNA, 645 bp, Homo sapiens
cctggctccacctctaccggacagatctcactgcgctgttcagtctctggtaccatacctatggcctggatccgacctgtccttgcagcccggtgcccatttcactgtctcagcctcagcgatgagaccttatgagggtcatgtagctacgctcgcctcaagactatcgatataccaggctaggtagggctgtgaggaatgcattaagaggcatcggtagtttctgacaacctggctgagcaaagctggaatcagatcctgtgtgcctcgctgagaacgtggccggtccgctgatctactggcctggagcttatcaaatgtcgatgcacaatgactgaaagtgattgactcctatatcgcacagagagtctagttggccaggacagtgatgcctgcagagagagctttcgattggtgaccagagacatgttcgacacggacatagaaaccgctgtctgtgtacatgggattcagtctattactcttgactaccctaagatggaatactgtcattgagagatgatggaaggggcttgtgacggggaaggccttgcccagtatatctgtgagaatcatgattcgagctccagtgtacttgacggatgctgtgacttgtgttggaatatacccagctgttgtcgctgg

SEQ ID NO: 539547 - DNA, 184 bp, Homo sapiens
atttcaagttctttgcctgcagaatggtcaggaatagagcccatcttccaggtgaaccacagccccatcatgtcaacaggtttagacgcaatgacattggagaggcttgacctgctgaaaggtgaagaaggaaagtgcttcctagagatagagttagtaaagagagcttaaatcagatgatgtc

SEQ ID NO: 539548 - DNA, 195 bp, Homo sapiens
ttatatacagagtactagaaataataacatatagaaacagtagatatcataaaatagaacataaaatcacatcatacataggctgatagcccaaagcatcaccattacaagtccatgaatgttaaaatgtacaggtgggatagtgaagatatactgacaatcgaaaagttcttctgagaaattacgccttagaaa

SEQ ID NO: 539549 - DNA, 301 bp, Homo sapiens
  misc_feature (78)..(78): n is a, c, g, or t
tattagcaggcattttagcaggttctattgattgggtatcgtgtgacgcggtgtgtgtagaaatatgacaacctgggnttagtatagactagttaaactttcgttatgctaaaggtaatcatgctgttcccgtggggtgtgctaggtaagcgtctgagctgcatagtgagtgttgatgtgtgtcccttttgatcgtggtgatatagagggtgaactcactggaacggggatgtttgcttgtgtactcttactaagagctaatagaaaggctaggaccaaaacctatagctgcgtaaaagtg

SEQ ID NO: 539550 - DNA, 476 bp, Homo sapiens
tgtagctaacttttcctgtagagagacatacttcgggctctgtggtctgggtggtctttgtttcaatgactcaaccttgcatctgtagcctgaaagcagccacagatcagatgtgaaggaatgggcatggctatgtgccaaaaaagctgtatttacaaagacaggcagacagcttcaacctgcaagccaaagtttgccaacccctgctttagactaatgaagaaaaaagaaggtgaaatggatttggacaaccttgcttaaactcccaaggaccctagtgatcttgggcgatggctgtttgaagaactgaagatgccatatgaatgctaccatactcaaagtactaccatactaccatagtcaaagcagacaggaagaaatctttgaatttcaaattatgtttcagctttgttcttttttttaataccatattacaagcttcaaactattcttttaattatatgatttttaaagtt

SEQ ID NO: 539551 - DNA, 131 bp, Homo sapiens
gagcggtccttttgtctgttggtctcctggactaaagaaggaagattagaggcccaagcctatgatcctcaaaatggttaataccagacctctctgtctggtcagtcagaccattccaccaggcaatgaag

SEQ ID NO: 539552 - DNA, 99 bp, Homo sapiens
gtcgacatcgtgggctctgactgagcccatgtatccaatgacgcctcaagaggagcggcacgccatcacgacgcacatcactgaagaagcatccttaga

SEQ ID NO: 539553 - DNA, 988 bp, Homo sapiens
accgctgcataatgttaagctgcattgtgaccaaggtgtgtgtagctactcctgttcattggaaggcagagccatagctatatccaggtgcatatggtgctgcagtagagtatacttgctcacacaagtacgatgaaaaatgactattggatttgtatccagtttcttcaaggtactggtgtcaagattggagaagtctgaattcagtaggtgaagcgacttacgatgagatgagagtggtgtctgaacaacgagtgagaaggtaagtttcgtcgggagggagtgagtatagaaggcatgaaggggatcgagataattcttgtggtaaagctggcataataatgaattgctaaaagcgttgcatgtttgtaactttgagggtacacatgtgggtggtttataaagttacagcaattgaagtcgtagtgcccatggattcgaaaggtctgtttgggaaaagcgtgggagtgtagacgagctttttatatagaacaaaagtagatcggtaaggtgcgggtattacattgcgtgcgagaagggataatggggtgaaactaaagaagggtctaacataaagccgacgatatgtggtaacctagatgttgtaatttgacatctagggcttgaaatgtgtattgcaagagttaggatgattatggaaaggaaaagattggtccctcgaggatgtatacaaagtggggccgaatgagtcctagatttctggaagtgatgttattgatgcaccagagggtataggatcgggaaagcctggagggaatagttttgtaagattgcacgtttgggtaagatggtgtttggaaatgtggtcactgaagtgtggggggttagaagaatggaatgaggtgcgggttggctgtcacagttgctgagacacgagggtataaataacttacccgggctgtataaaaagggggcggcaaccagagtttgggctttaaaaaatgtgggatatatttcaccagagata

SEQ ID NO: 539554 - DNA, 168 bp, Homo sapiens
aactagtctcaggcttcacatcgatacgcgcagcccttcgcctattcttcatagccgaatacacaacattattataataacaccgtcaccactacaatcttcctagggacaacatatgacggactctccctgaactctacacaacatattttgtcaccagaccctact

SEQ ID NO: 539555 - DNA, 173 bp, Homo sapiens
tcgcatcatatgaaacaaaaaaaatattaatagtccattaaacttcacaaaaactaagagaaacacaagacaaaaatccaacaagcaataaaaactgtacaatattaggtccagtcttttatatctgaaaaactgtgtaaccttacaacaaacaagttattatatcgatataa

SEQ ID NO: 539556 - DNA, 541 bp, Homo sapiens
  misc_feature (498)..(498): n is a, c, g, or t
tggagacgggggtctcactctggtccccagggtgggagtacagtgggtggcaatcatgggctaatcggcagccggctaactccggggctcaggtgctcttcccacctcagtctctggagtagctggggactacaggtgcaaaccattacacccagttaattttggtattttttaatagagacaggttcaccatgtggcccaggtgggtctcttgagctcaagcgatctggccgcctccgcctcccaaagtgctaggataataaggcgtgagccaccatgcctggggcccttcgtctctaaattcatttcttcaccggtaaaactggggataagggcaccacttgctttactcagcgtgaggtgggactgtgcacagtcacgtgggagacggagcgggagaggcctagcagtggtggcgtcccccaggtgctccttgaaccacggggcgctctttcccggggcccagagggcgcggccttccatctgggtagctttggnctctgaacaccaggccatggggcagaggtcaggccagtgaccc

SEQ ID NO: 539557 - DNA, 131 bp, Homo sapiens
gatcccaacacaggcatgctcataaggaaaggttacaaaaagtaaaaggaactcggcaaatcttaccccgctgtctacaaaaacatcacctctagcatcacagtattagaggcaccgctgcccagtgacac

SEQ ID NO: 539558 - DNA, 232 bp, Homo sapiens
  misc_feature (43)..(43): n is a, c, g, or t
  misc_feature (186)..(186): n is a, c, g, or t
aaaaaaaaaaaaaagcctcataatgttttaccaagctgggttnacataatcttttcccccactagacaatgtgtttttcaagaacaggaactttattttattcatctttctatcctgaacacaaattaggcactaaataattcattttttaacaaatgaattttttggcctccactttaaggtttnaattttccccttcggtcccacagtttttgtttagaatcctaattta

SEQ ID NO: 539559 - DNA, 693 bp, Homo sapiens
ttggtggatggatctgtgtgttgagagcaatcgccatttgctactatgtgagcaatgaggagctgcggggaaagtctccagaggcagcagcccaaggtggtgcgtgggtgagctttgctgaattccgtatatacgtgccacccacagcacaagatacctgggtgttcccccaagctttggtgcatcatgcaaccaagaaaaaagggccactgagactgcaaaggaggaaagtgaggcgaaatcctgggggctgctggtactgcctaacctagaaacgacgaggacttttctggttgggcgaatcggagttgacattggctgacacttacagtatgtctgcacccctgtttgtggctctatatagcaggttctagaagccctctttccggcagcctttcaccaattaccaacacgctgttcctcacctgattaatccagacccagttccgggctgctggggaacgcgaactgtttgccaagatggcccagttgatgttacacgttggagagaccaactaaaggagaacacggaagaggagggttcggcaagagaacagcccagcgacggagagaaaagactggctgccctgacgggcatggagtacaggggtctgacacgacggcttgtaagcagacgggggaaaccgaacagacacctcgtcgctcgagtagagcagaagagcaaaagagcaa

SEQ ID NO: 539560 - DNA, 104 bp, Homo sapiens
tccgaggattacttgtggaggctgaagagacggtgaccatcgtccctggccccagatatcaaaagcaccttttctagcacctcgtagtcccccagtatctctcg

SEQ ID NO: 539561 - DNA, 1221 bp, Homo sapiens
  misc_feature (853)..(853): n is a, c, g, or t
tccacgcaagatgtgtttgctggttcttcacaggagatgattttgtctcgttgtggcggcaaccgattgctgtctggttgggggtgggcacgccgccccgtcaggtggggccgcctgcctcccctctttggtgagagccacactggcggggtctgcccacccgtcttgcacacggtgcgtgttatagttcccctcgtggaacactccgctccccgcggtggccgcgcatattagaggggtgctccccgccggttttttgtggacccccccgtgtttacattctggggtttttgcccacccaccacgggtctacaacaccacagttggagcacaagggcacacaagttttttctcctcgagtagccttcgaaaacgtagtgcgaaaaatgcatttgtgagttgctccccccccttttcgtgggctatagaaaaagagctcggggagaaagagttgcgccccctctgaaattttctctggtgaaagattctctcgggtgggagatagcttcgcccccctcgtgggtgtggaataatagggtttctccctcgcgcccagagcccccctaatcgggttgttgggggagagggctttttttctccggaccgttataccccccccctctctgggggttccgcgctcctgtggctcggttttcggctcggataatagtggtcccgcgcacccgctgtgtcccgcgttggggggttttcactccacacaagccacgcttggacacaacagagaaggtctctcgctcggagagactcggccccaaagtgtgcacccacacagttctcgtccccccgcagagaggctctcacacagcacgcggctcataaatggagagaagtntattgcctctcttatattcctcgtccacccccacctcttcttataatccacgctgggtggagaagaaccgcgtgttcacgagacctcttttgtttttcacaattggccacatcttataggtattatgatatgtataaagagactcggtgtatatgagtaatacccactagcactcgttaaaccccttcacgaaaggagaaggaggaatgttttgtggagcccctcttggtttttttttttgcgtgtggcacacttttatagttatattatgtttttcaaaatcacgtaactttttataatgggaaccacaccttggccccaaatttgtccccgaattttgagaccccctttaaaaacgtttaatgaga

SEQ ID NO: 539562 - DNA, 901 bp, Homo sapiens
cgagggccggcctgactgagttcagtctcacgcactagtactcagtgcagccaaacgccgtgccgctcccagacggggaaatgacctaaaactaccaactacagaaacccacactctagaccgaaaccgcgcggtgcacttgacgggtgggcttgagcctcacggggaaagcgaggcagaggtgctgaaaagggtcgtccaaagctgagttcatgtagccacacgcacagtggagcagaacacacaagcctgaccgccaaatgcccatgcacacacacatgccacaccggcgctgatgctcgagtgtgctgcaccacgaacgtgtggggacgctaacacaacttcaggcacggaaggcagaacgggaatctcacgatgcagacgaggcacaagcggaggcagcataaccaggaaggacaatagaagggaaagcgcggaaaccagtagactagatggcctatgtatgaataaagacaacctcggaatgagacaatcaattagggaaacgccagtgcactaaaagcgggatagccaaccagactctaaaacataactactccaattaaaaacatcatcatacataccctcacacacattataaccaaacacaaacaaaagatacagacaatacccaatcctacaatctaaaataaatcctcataactcctctaaatccaccacacaatacaaataaacaacacttatagataaagacaatacaaacacctaacattatacttaataaatcacaaacaaccattgattacactacaataaaagtaaagaactaataccctatataccacgtctaacaatacatcagatattaaatctcacaaaaacatcataactccataacatcccttactagtagatcaatattcaataacctaatacaccg

SEQ ID NO: 539563 - DNA, 515 bp, Homo sapiens
tagcgttcagaggatccgcgtaatccgtacactggctaattgtttaaattccaatagtttgtgtgtggattcctgaaattttttatacacaaaattacattatcggcaagtagagatagttttacttctttccaatctggatcccttctattttgttttcttgcctaattgctgtggctaggacttccagtattatgttgaaaaggagtggtgagagaggtcatccttatcttgtgccagttttcaagggaagggcttgcagcttttgcccattcagtatgatgttgggtgtagttttgtcatagatgggtcttgttattttgatgtatgttccttggattcctagtttgttgggagtttttaacagaagggatgctgaattttgttataagccttttctgtgtctattgagatgatcatgtggttttggtttttagttctgtttatgtaataaatcacatatattgatttgtgtacgttgaaccagctttgcatcccaggaataaagcctactg

SEQ ID NO: 539564 - DNA, 415 bp, Homo sapiens
cgacgagtgttcaaaggatgataaataggtgccaagatggagcactcaagtgtgatgagtgccctcaccgtggaatggagtgagaagctttctgacctcataaactgaaggctatcttcagtcatagtaattatatatattacgtagcattaatccgtcatataaccccagagaggtaaattacgtataacttatcgcttcatatgtaggtcgacacacgttgcagacacagcaagaatcaacaaaactcttccacggatcaaccacgtaaaaggcagaccttgcgattcgaaccaggcaacctggctcacatatcagttttaattactacactctgtactttccaagatttgtaaacagtttgacaatgcatgccgatttaaaactatgaagaaacaaacacaatttttcacaa

SEQ ID NO: 539565 - DNA, 158 bp, Homo sapiens
cccaaccattaggtcgactccacgatgcatggatttcacatccaagcagatgtatagaatatattagaaaaacaagaatttgcatctgtactgcacatgcacagacttttttttattgtcatgattccctaaagaatatcgtacatcaggccgtgcac

SEQ ID NO: 539566 - DNA, 569 bp, Homo sapiens
  misc_feature (46)..(46): n is a, c, g, or t
  misc_feature (167)..(167): n is a, c, g, or t
  misc_feature (178)..(178): n is a, c, g, or t
  misc_feature (185)..(185): n is a, c, g, or t
  misc_feature (190)..(190): n is a, c, g, or t
  misc_feature (211)..(212): n is a, c, g, or t
  misc_feature (451)..(451): n is a, c, g, or t
  misc_feature (481)..(481): n is a, c, g, or t
  misc_feature (549)..(550): n is a, c, g, or t
  misc_feature (569)..(569): n is a, c, g, or t
gcatttgcttttgtgttcttggtcatgaagtctttgcctaagccangcgtctagacgggtttttccaatgttatcttctagaacttttatggtttcgaggtcactagatttatgtccttgatccatcttgagttgatttttgtgtacagctgagagttgaggatccnagtttcacttntctcccnccccncccggggccaattgtggcttnngccaattatcccagcaccatttgttgaatagggtttaccttcttcactttatgtctcaggtgggcttctgtctgcaacaattccagcttggcgccctttaactacggcggttacttttgaacgctttcatactctctcatagggggtttacttcctaagtttcctggatatccccaatttggggatcgcttactcgttggaccctttaagtttctcgtctcacttaattccacgcttancgcagtgggcttaatttcttctggcgcggnactcattgcgcccctttattagcttattagctcttcgcacacattccagcgctaacttggttcattgnncctccaagcacttctcgcn

SEQ ID NO: 539567 - DNA, 2829 bp, Homo sapiens
ttctatgtaagagcaagcgagttccacagcgcggggaggccagtggagaggagcgcggccttgcctggctcatgtcctgtttccagcttgccctgaaaacgaattactaaatccatggaggaagagcttggggcctgcctggtcctcggccacggtggggctggggcctgtgactgcgtgtgcagagggtccgcgcccagggcccgggaaaggggctgcgctgccccgagcgagtccccgggcgcccccagcctgctgcagccacctcgggctccacatttcggccccttctcctctccgctgctctgggctcagccaccaagctccacgctgtgggcagaatccactggggcgcaggaaacctcagcttccgcagcccacctggccttcgcagtcttcctctccagggttttatttcaacatggccttttctgctgcgactcagctgtggtaggggccaagtttgggtgtgtgaggccagggaggtgcgttgtgttctcgcggaagagagagacgcagcgagggagcccgggcacacggacccagctcaccaaccgcagccaaaccaccaattctgtcccgtggcccttggtgaccggtgacagggagggaaggaaacgtggccagcttccgccagaccacaggcgaacacaggtggggcggcccactggcttgggcctaggagctgcaggagcaggggccacggtccagcctgacgcccctctcttggggcaggaagttccctctgtctgccatgagcaggggcacttgggagggcccagcataggacctcaggagctcccggagcagcctcagcagccgcaacccctcgaccttgtccagcatcacgccccggtgccagggagacagaccgaagaatcccaccactgtgcaggagaggaagcctactttaattctgttcttgaagtaatggcaggtgaagattcgtatgtcataattaattcctcacttcttaggaatcgcagcgattagctctgtcattcctttgttatcagagagaactgtgagtcctgttattctcactgcttcgccatctgtgagcatgcgcagccctcggctaagttttctaaaaggaacatcacagcgacttccctgacctcagccaggacaaaagcagggagaagaggaatgaaaagcacaggaaaacaggccagggagttcatggatggaaatggcatcacaggcaacagccactcacgaagatggacgaggacccaagagagaaccagcgctgctctacacctgcctgtcagtttgtagtggagaggggcactgtccgccgagcctccatccgtggaaacgctcctcttcgagcccggccattgctctggctgggcctggtgaggaatggccgtcatcacggacagtggcctttcctagccctgaccctgcagagtgcctctggagcgcatagtgctggcggacaggaagtcagcagatcgaagacagggtcccggcttcacggtgggtgagccgtgtgatgtttgggcaagtccctcagtctctccactgagctgggtgtgaacgtggtgctctgtggcagtggcacgtgatgactcctgcatggagttctcgtctcagcaggggcagtgccttgcaccccgattttcaagcagcaacctgagagtcctgggaggcccgtcttttcccctcggtctttctgttggccccaccactcacatatttcaggcctcaccaagtcctgttaatcccatttccaaaaaatgcctggaagcttctactcctggctctgcagcctccacctttctctgagctctgcggacgcttcctcacatcagccctggatgactccaggagcctccaaagggagcccctgcttcctgttcccctcccctgcgacctgctgcccatgtgctcccaaggggctcgttcctccgtgtggatgggatcgtgttcctgctcccctgccccacaacccactgcccgtgtgcacccgaggggcatgtttttctgtgtgagtgggatcatgagcctctttccttggtagatgttctctttgcgctggaatgaaacctcagctcccctgtgacaggaagctccccatgggccagtgctgggttttggtctgtcggcatgtgctctccacccagagaagactcacagctggctgctcctctcacccctgaggcttcacagtaaacatcgactcacaggaggggaccacgtgattcccaccgcgtgtcctgttccctccacggagcatgagcttgaccatggtacaaagcaccgcacagctgctttaaccctgggagagaagtgtctttatgagattctctgtgtccccagggaatgctgccttctcctgtgaagcagtcagtgggccaggcccagtccttaaagatgcagagaacccaacaggcccctcttctgctcacagcttcaccttatgttatgcaaaatccccacaccactagagcatgctggcactgggtcatgggcgcctgcacttcccgcaagcttgtgactcggggtgcgatacctcagcccgtttccaagcagccccatgagatcagggcttattgtgtttgctccatgtatcatgagggtgcatcctgagaaggagagactcgcaggtgggtgcaaatgatttgcagtcacagaggagccaagagctcctgacgggactaatgaaagcatgcctcactttagccctgggccaggttcacgcctcaccttagccctgggcgggttcacgcctcaccttagccctgggccaggctgctgtgtgccatgtgctgtttcttcatcggggggtttgggtacagaaatactaaaaatgaatcttgg

SEQ ID NO: 539568 - DNA, 914 bp, Homo sapiens
cgcggtggttcacgcctgcaatcccaacactttgggaggctaatgcaggcggatcacgaggtcaggagatcgacaccatcctggctaacacggtgaaaccccgtctctactaaaaatacaaaaaattagccaggcgtggtggcaggcacctgtagtctcagctactcgggaggctgaggcaggagaatggtgtgaacccaggaggcggaggttgcagtgagccgagactgcgccactgcactccagcctgggcaacagagcgagactccatctcaaaaaaaaaaaaaaaaaaggaaaagaaaagaaagaaattgagcacggtgaaagggtttcccccagtctctgacacagcacagtttgacgaaacagaaaagggggggcacgagaagactaggggaaagataggacttgagacaggtcaccagtgggttcctttcccagatgatgctcaattaccggaataagggccgcccccaggcaaaatgtaaccgaagcctgaataattttgagacccaaacacagaaatacaacaaaaaacatttttgctgcccacacggccccgaaagagtgtctgaacaccaccttgtgttgggcgcagcccccagctggtctagtgacacggggcacatagcggggtgccacgggaacactgggccaaccatgcgtgtggtgtctccccaatataacagcgcgcgggcgcaccggcgtgttaacaacccacagagggagttgggaggagctcggatcttcaccggggcacgcgactcgatacatgcgcccccgcgggagacatcatacaacaaacagcaacaccacgcaaggcgacggacgccgacagaggacagcacatcacagacaattgacgagaccgatgacaagacaaggagaagccgcgcgagcaacgcgagaacacg

SEQ ID NO: 539569 - DNA, 255 bp, Homo sapiens
ctacacctctgtaacacgagaatttatgcattacagtacacagtaacactcttatatttaccactctaaatgaaaggttcaggccgtgagcacagtggctcatgcctgtaatcccagcactttgggagggcgaggtgggcagatcacttgcagtgctagcaagttcaagcacagcctggccacacatggtgcaagcccgtctctacaaaaaacattacaaaaattagctgctattgaaacttctaaacactaggg

SEQ ID NO: 539570 - DNA, 300 bp, Homo sapiens
  misc_feature (18)..(18): n is a, c, g, or t
  misc_feature (94)..(94): n is a, c, g, or t
  misc_feature (157)..(157): n is a, c, g, or t
  misc_feature (185)..(185): n is a, c, g, or t
cagatcatggcacctctnttttcagaggagaaagagaacagtgcagatgcctggccaaggacacacagcaatcagaggcaggctggcttctttnccccggtcccgccacccggcgacacctgtcagcccccttgcaaactctgtgctccttgagggngggggggggggggggggcggggtgggtntggaccccgttacaagggattcctataaatggcgtggagaggattaataatgtatttataacacattttggtggtagtcgaaaatgatctataaaatgtgcagtaaatgttttat

SEQ ID NO: 539571 - DNA, 357 bp, Homo sapiens
gccccagtcagtggcttgtagcagacttaaacatccctgcctgatggatctgaagagagcagcagaactcccagtgcagcgtaccagctctggtaaggctcagtctgtctcctcaagtgggtccctgacccctgtgtgtactgactaggagacacctcccagatggggccgacagacacctcatacaggagagctctggctggcatctggcaggtgctccgctgggtcgcagcttccagaggaaacaacaggcagcaatcattgctgctctgcagcctccgctggtgatacccagacaaacagggtcgggagttaacacatccactcaaagaccccactggaaggtcaccaacatca

SEQ ID NO: 539572 - DNA, 939 bp, Homo sapiens
ggtctacctcaaggtcttactgtcacgcactatcccttcgtgagggcgagtgccagtggtcaggatgtggccgcgtatgcttctccttcttcaagacctcctttccatgacctgtcagtctccctcaagccccgaggtagctctgtcattcccatgaaggctgcggtccctccccttcccgtcattctgtgtgagagacctggacccaccaggcgagctttcccatcaagttctcagtcatgctggactgtgcagttcttgtgcgccctaacaatcaagctgtgtcctcaataggctctcatggcagggtgagggtctgcctcttcccgctgcgccccgtgaccattacctggtaggtgagcaacctgcgctgggccctggtacctgtgggactagacgggcaagaaacgttaccgacacgttgggtggttcgttgtgcatccgttgccatccgtcccgtggctgtctgctgcgacgcgaggtcggtcgaatgggttgctcactttcacgcgtggttgaccccgctgtactgatctgcacgtgcacggacctccgcgtagacccaccctctcctcccgtggtgacgttcgatacctgggcagccgtccgctgcgtcggagttcatggcggaggcgaaggaccacctgttgttctcgggatcgacagctgcttattctactgtacaatgcaagtcgtatggtcctctgtcactcaaggcgcagctaggtgatcgtcccttacattatcacagtttgacagccgcaggaactacatgcatatctgtatagtcttttcttcggatggcacactgtatccccagctaggtctggttcactcagccgatggaggcaacgagtcgaaaaggcctgaacgcaggccagtcgggctataagagaactataggtcccgtcctatcattgacgtttggattcgaaaagc

SEQ ID NO: 539573 - DNA, 425 bp, Homo sapiens
  misc_feature (4)..(4): n is a, c, g, or t
  misc_feature (6)..(6): n is a, c, g, or t
  misc_feature (8)..(8): n is a, c, g, or t
  misc_feature (11)..(11): n is a, c, g, or t
  misc_feature (22)..(22): n is a, c, g, or t
  misc_feature (24)..(24): n is a, c, g, or t
  misc_feature (27)..(27): n is a, c, g, or t
  misc_feature (31)..(31): n is a, c, g, or t
  misc_feature (41)..(41): n is a, c, g, or t
  misc_feature (49)..(49): n is a, c, g, or t
  misc_feature (60)..(60): n is a, c, g, or t
  misc_feature (70)..(70): n is a, c, g, or t
  misc_feature (106)..(106): n is a, c, g, or t
  misc_feature (126)..(127): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (140)..(140): n is a, c, g, or t
  misc_feature (144)..(144): n is a, c, g, or t
  misc_feature (151)..(151): n is a, c, g, or t
  misc_feature (153)..(153): n is a, c, g, or t
  misc_feature (179)..(179): n is a, c, g, or t
  misc_feature (185)..(185): n is a, c, g, or t
  misc_feature (190)..(191): n is a, c, g, or t
  misc_feature (193)..(193): n is a, c, g, or t
  misc_feature (195)..(195): n is a, c, g, or t
  misc_feature (205)..(205): n is a, c, g, or t
  misc_feature (212)..(212): n is a, c, g, or t
  misc_feature (218)..(218): n is a, c, g, or t
  misc_feature (221)..(221): n is a, c, g, or t
  misc_feature (229)..(229): n is a, c, g, or t
  misc_feature (231)..(231): n is a, c, g, or t
  misc_feature (236)..(236): n is a, c, g, or t
  misc_feature (255)..(255): n is a, c, g, or t
  misc_feature (270)..(270): n is a, c, g, or t
  misc_feature (281)..(281): n is a, c, g, or t
  misc_feature (318)..(318): n is a, c, g, or t
  misc_feature (324)..(324): n is a, c, g, or t
  misc_feature (327)..(327): n is a, c, g, or t
  misc_feature (348)..(348): n is a, c, g, or t
  misc_feature (423)..(423): n is a, c, g, or t
tatnananatnattttatttananaantgantttcttagtnaccttgantaaaaaaaaangaaaaagatntggtttaaagacctttcaaaaaaaaattttaaaaantttaaaaaatgaaaaattannanttaanantcantaanacttaananttagtaacttctgcatttacgtgtanaaaaantccannanancaaaaaaggntgggganttttanaantcaggaananaaaantaggttattggtcaagganaaattggtcaagganaaattccccancactgggtcagctgtttaaacctggagttcttacccncctganaanaaacctgttgcagcaattcanacttactgtgtaggcatttttaaaaatttgagaaagtttattcttatttctgcatttagtaaaaatataattaanca

SEQ ID NO: 539574 - DNA, 1298 bp, Homo sapiens
  misc_feature (1298)..(1298): n is a, c, g, or t
atgcataaatatggcgtgtggagtcatgtttctcgccgtcccggggagcgataaatgcctcagtttataacacttatcacgtgagcctatctgtaatgttatgtcgaatgtctgccatgatgtgctgaccaaagcacctaatgtgcatgagtgttagtgtagtgaatgggttacggacacgtctcactcgtatatcagtcaagacatctcgacagcagccctgttagcgcgtgttgcagtgcccttagtattgaattgaaacaatccacttttctagtagcttgtggattgtactaactgatacaccaggtgaagagacgatccgttgctattagtgtagactagctgagtgatggtcgacctttgttgtccccgattgcacttcgtaatcttgggaccggaccggtacagacgtgcgttactagtcagaactttgagagtaattcttttcacatggactttttttgcaatgaggccgtatagccttcgctcgtcattgatgccgacgtaggacggttaactggcgctaggtttgtcacctcgggttgaacacgacgtttgaatcatatttcacttattccacctacgtgggaaccgttgaggaggagtttccctaaggaaacattggcaacccctaattacgcgcattccgaaaaggcaataccttttaaacattcgcagagcgcgacatgagcgcctccggaagcaatagggcccccccttttcgtcgcgttgggaacataacggccgagaggtaatattgcccccaggacatcgttcgaggtaaaacaaacgcggtggccaattaagagggttaagcggcattccgcggtgaaatgattaaggtgcactcgcattgagtgagggtcttgccgaattttgccccgtatatttaccgtggcacttgcgttggggaggtggtggacaaaagggtctttggcaataggtgggtattggcgcttagggaagcttcaatgggccattgtacgaacttggacacgggtttccagggtcctaatacgtaaagaaggcaaggaactttttaggcttcccattaaggatgccgctcgaaggaagcaaggaaaagactcccattcgcgagagttagagaaagaccctcttggtgggcaaggaatgcgcagccttgatccttatgttctggaggcacgttgcgctactctctgcgcgcaaacgcgcttcatggaaggacggaagacaagcgcagttttgcggaataggaacacccgcacgggggtagcgtttgcggagattcacgccgagcttcgatcgacgccatn

SEQ ID NO: 539575 - DNA, 695 bp, Homo sapiens
gcctgcaggcccctggctgccctgccacgggccacggacaccttcgaggcggctcctgacatgtgccctgcccacctgagcccgaacttcctccgggcagcaccacgaattcctctaccgacctcttctccgagcgactacgcgtgggcaatgaactagcaagaagctcagtgccgaagtactgtgctatcgtgagacctgcgggcgcctgcggtggccgtccaatgtggcgtcgctttgcagacaccggaattgattcgcgcccctgaaacgcaaacaggacccagccaggaccagcccagcacagcaagagaacccagcgccgaaggcagcaacacggcgcaagaacaccgaaggagcatacacaagcccgacagaccaggacgcgcgccacgacccgccaacagagacacagagagcacaacgagaagccaaccacgcagggaaagcaacacacagacaaggccgaaagagccacgagagcacgagaaacaaaaaccacaccggcaacaacgccgactagcccggcacccaaacaaccaacagcggcataacacaagagggcggagagaccccgaaacacggaacaacgccgacccacacagcagaaggccacacaataacaaaagatgcacacaaaaacacagcacacaagaaccaccaaaccagaggcagccgccacgcaaacccgcccc

SEQ ID NO: 539576 - DNA, 182 bp, Homo sapiens
ccaacaactctgataggtttcctcccgtagcaacactcttagacagtttaacgtacagtattgtgctatcctactcaattgcaataatgaaatataggaacaaacaggacggactggcagtttaaacgagtaacgggagggcattttacaaacttcagggaggtaccagaactcggaatgcg

SEQ ID NO: 539577 - DNA, 327 bp, Homo sapiens
gttctttgctgggacttacacggtgtgacggactgccctggcacaacttgcttttagatataagcctgtttttgtagtatgatcatagattagatgataaggtaaatataccgaaggctgaaccagcgaaggcttagctgctcatgttaactaagaagccatttatggaatataaattgttctcatagttggtcaggttaacaagtttcgcttttcaaaaaatacacatctggatgattctatccttttcctggaattattagttctgtgtagtatatctccactggggcaattttatattccttccgacccatccccaggtaacat

SEQ ID NO: 539578 - DNA, 360 bp, Homo sapiens
ttcccccaatgacttatcttggcaccttggccaatactcagttgtgcatatttgtgtgggcccgcaattcgtgttccacgtgatctaaagtgtatatcctttgaccaatactccaaattgtggacttcggaagctatccagcaagtcttgaactcagaaaggttgattcctccatggtgcacttctttctcaaaatggttttggccactttaatcccttggccttttcatataggttttaaaataatactcgtgctatgcgcaaaatctcgtgctgggattttgacagcaagtgcatcaaccgtgaatcactatgtgaggagaggtggcactcgtgcagtatgcggcgagagctcgtgcc

SEQ ID NO: 539579 - DNA, 464 bp, Homo sapiens
ctgcatgcatcccaactagagtcttccttccacattgcagaaccaagcacagtcctggggctttgcagtgcttagctgggctgagctgtgactgagttgcacagtgggtgctccctaagtctgtaagtgactaaaacgatctcgatcttccctgtgacttccaggtgagggaggaaaggcaaaagtcatgtgctcaggccccggtggatccactgccaggtttctgcacagactcagtgatctgcaggtgcccagatcattgctatggagggtttcgctcatggacctgggtccccaacactctgccagctgaccatgcccctagtccgagctgagcatccccagcaaaagctcaggagtccaagcacacacagccttcaacagctcagaaataactttccgaatgggttttagaaaataacacgagaatgtcttaaggaacagaggaacctcctttttttttt

SEQ ID NO: 539580 - DNA, 766 bp, Homo sapiens
gcctgtgtgcattcacagctgggtcttcccaaggatgctgttctcaggagtggtgggtccccagcccctcttcacactgggtatgatggaggtgtgggcgggctcgtccaggccgatcaaggcacagagtgagcagcggaggctgtggtggggaatggactctcgtgggatcctcttgcagaggatgccccaggccttgaaaccctctagtgatccacagttgtgtggagactgcactctcccagccctgtccttgaactgagagtccagcattttttcagtgtggcccctgttttggtggctcaccccagcagggaggaggcatccgaatccacatgggacggcacgttgccatggttatgcatattgcgtgccgtggatcaatggggccgtggcactggtcctaggatggaagcccccaagaagggcaggggttctgtctgtctgtcagtgaatcatgtgaaggtgtttgccaaaggcagttttacgcaaaaaaaaaagaataaatataatataaataaaaaaatatgtgtggggcgggcttgggacgcttagagaaaagattttataaacccatttgttgttggcgggcggggcccgataggtttgttatgtgtacacttgggaaaaggtggtcccaaaggagactgtggacaagaacagtggggtgggtttctcacaattaaaaagcagcggggagacgggggtgttttgacaaattcgaggtggttggggcgactagggcttatacagggatcaaggagtg

SEQ ID NO: 539581 - DNA, 1540 bp, Homo sapiens
gaccgcagacggacagcgccaagtgaagcctcgctatccccatccgcggacgaccagggcccgagaccgagagtagacagttagtagctacccgcccagaaactagacacaatgtgcgacgatatacgagaccaccgccctcgatgtgcgacaatggcatccgagcactggatgaaagccggactatcgaccgagcggactgacgccccatagggccgagattcaccgtacacatcgatggggcacgcacacaccgaaacacccagggacgaacatgcgaaacggataaaggcgtacagacacagaatatccctacgctgcgctgcgcacgacgcgacatcagaaggcaaggacgcaggctataccttgcacccccatgacacgataccacctactcagacgccaacacggcactccatcacacaaacatgagactgacacacctcggccgcaccaggatccctgagcaccacaacaaccattactacacaaaaccggcaagccttatcgcccgtaggacacacaccagcacagctacacagaccaatccacaccactcagaaccagatagcaaagcagactaacacgataggacaccacgccaacacagacatacaccacacaccacactccataatccaatcccactaactccaaacatccacgacacacaccaacattacacaacacaaaccaacccataaacaaaccagcaccatccactgcaacaccctgctaaaacataccaacaacaatcaaaaataacatacacaccctcttacattccccaacatcaacccgagtccaaacacacagaaaacacaataaccccatatatatagtcatacccaacatagaacaacaaaccacctgaacccaacgaacacaatacaacaacatcaaaacagacactcacaaacacacatacaccaacaccaacaaaacatcacaaaatacaactactcacacacacttcaacctcccaccacccaccacgactctcatcacaatcaaaacatataaactcacatcaatcaacataaacacatctccgcacatcaccacaacaacaacatcaccccgtccatccactcacgccaatctgcccacacagacactaactcaactaccacaactcatatcacacacctcccacacacacacacaaaccacaaccaaatcaaacaaccaacatccacccgctcacccgatctcacctccacacgccactccacactacacccaactgccaaacaccatccctaaccatcacacactcctactcacacaagcaaacaaaccttcacccaaactcacaacacacacaacaactctaacccaccacacatcacacaccacccacatctactaccaactccaactacacacccaacaaaacaacaacaaacaacataccgcacacaccaacccagccaacactccatacccacaacacacccacaaataccacacagtccctacacactatcccaacacaacaatacacaaactccatacaatcaccacacaactaattacc

SEQ ID NO: 539582 - DNA, 740 bp, Homo sapiens
  misc_feature (1)..(1): n is a, c, g, or t
  misc_feature (98)..(98): n is a, c, g, or t
nccagctctgatgaaccctactagtattttcagtgagctagattgcgcatacttcttactccacgaaattttaggtacattgataagccatgtagatntgttgtcctctgctaagcaccaaaagttagatatctgctcgcattgattctgtacacacattaagtcatcctttggaatttaggtctctggcaggtatctgtgcattcatagaactcatataggtcccagaatctcttttaacggatttttattagtttaaaggtaaatacatctatctgaatctacatgtctcttgttttatttctctctaatcttgaaaacagtacatctgcagatactgtgaggcacaaattatcgtgtcaacctactgttactatggttatatcctcccacttcatacattaccaagagtcgatcagtgatttaaaatttttaatttccatagttaagatttcctgcataatataggatatatagttaagttaacatactaacatttctcctttggaggaagttttaatctacttcagtatgcatattattatcaagatactttcatatacaggatagcctaattttatttgtttaaatatgcttaatatgccccagatttcaaatgcatccagtcagtaatatcactgtctgtatgtgaagcacatgttcccatggttcatatgttaaaatgtcaataagcttgcattaagccgggtgctttgtaagtggattggttcataaataac

SEQ ID NO: 539583 - DNA, 104 bp, Homo sapiens
agttctaataccgatttacaattacattgaactagaggatcccctcactggaggtgaagagacttggcttcatatgggattgtatctgtgggacttgatatgta

SEQ ID NO: 539584 - DNA, 399 bp, Homo sapiens
cagaattacttgttcttgaagagagggtacctcagcacagagaaggaacataggtctttctctgtgacttgataggattctgtttccttattaataaattgagaatggcaataagaatggctagtatttgtcaaccatgtactgctgaccaggcactgttcagatgtggctcacctatattaagtaatttaatcttcaaaacagctctttgaggtaggtactgtcatatataatgtgtatatatatacttttatatatgtgtaaatattaaatatatatgttcacataaatataaattatatatccttattttacagatgagaaaactgaggggttaagacacttgcccatgttcacacagttactcagtcttgcttgaagcctgagctcttaacaatg

SEQ ID NO: 539585 - DNA, 258 bp, Homo sapiens
gagggtggagaacgggtttgagtataatcagttgggaccagtgcaggcggccgagcacagtgagtctgagggcggggtgtgcgcggtgcgtcaggagaggagcgccctgggtgccctagggctgcgactggacgcgcgggctttgcagcgagcacccttatcgggctgtcgcctgacagaatacctctaaaaggcctagctaaataaacctgtaagccccagcattttgagagaaaggtaggggtgtgtatattataa

SEQ ID NO: 539586 - DNA, 208 bp, Homo sapiens
tcagttcgggctttacggcgccgcctcctggggttggtccccggttcgttatggccgtcgccggtaacggtgcgggatctggaggccgaacaacgcgattggtacccgagcctggcaaccatgcaggagtcgctgcgggtgaagcagctggccgaagagcagaagcgtcgggagagggagcagcacatcgcgtagcgcattgtccata

SEQ ID NO: 539587 - DNA, 344 bp, Homo sapiens
ttttttttgagacagtctcgttgtgtcacccaggctggagtgcaatggtgtaatcttggttcactgtaacctctgtctcacagatttaagagattcttgtgcctcagcctcccgagtagctggaactccaggcacgtgccaccatgcccagctaatttttgtatttttagcagagatgggatttcgccatgttggccaggctggtcttgaactcctgatctcaggtattctgcccaccttggcctcccaatgtttaggattacaggcgtgacgagccacctccagtctcattatacaacattcttcaatcattcacgcacacacacacacacgtgcacacacac

SEQ ID NO: 539588 - DNA, 144 bp, Homo sapiens
tttaaatagtataaaagaaaacttgtgatctatatattaatgtatcaccttcattgtacatttagcaggatatgcatcacaattatattataataattgcaccagtgaaacaataaagatgctattgaaacttctaaaactagg

SEQ ID NO: 539589 - DNA, 900 bp, Homo sapiens
ttcttggagaggttcttggagagattctgggagccaaacactccattgggatcctagctgttttagagaacaacttgtaatggagccttcatctcttgagctgccggctgacacagtgcagcgcattggggtgaactcaaaatgccacccaagggatgagagggtggctctccgcctagatgaggaacgatacgctgaggcacttcagggagtgcttttatattcccaaaataccaggatctgcctccagtggatttatcattagtgaatacagatgaaaatgccatctattcttgggaaattctcttggcttcaaccaaaaaaaatggttaacaaccatatctttgaagaaggaactagattagtgggccaaaatagcaggcctatggttccatgaaaggtggggaagcgtcccttggattacaggagatgagagtatggtaggccttatgaaggaccattgtacggagccaatgcgaacgaaatagccctaatgaatgtttgactgtaaatttacatcttctaaggtaatcaatttaaagccttacggcaaaagggattataaaatttcttcttaaaggcaaagccttccctccctgaatcctatggctatgagtcgccaaatacaactacaggactaccattgacgaccgaggcggagacacgcccggagcggcagaacctaccaacagaggatccgtacgcctggcaggagacacaactggagacggtaaggggggtaaacacaacgaaacatacagcacaaaacgcagcgagggaactgacagcacccgccccaaggacacaccgagaagcagagcgcacagaagagaaggcggaacacaaagcagccgggagcgacagcaacaccagcgcacacacacaccaagaggtgaaacg

SEQ ID NO: 539590 - DNA, 476 bp, Homo sapiens
acacgtggaaaccgctatctatgtatgtgtacgtacgcatacgcacaacacacactcacgtgcatccatgtgcacgcttactaacccagtgtacataaacactattctctatatgtacaatcacgtgcacactcactagagtacgtgcacccacgtgcacgaatcactaaacctcacgtgtaaatatacactaacactcgtgcaaacatgtgcacgctaaacaatctatatgtatattaatgcatacacaaatccacacgtgcacaatcgtgcacactagcatctacgtgcaccccgtgcacaatcaagtcataccgtacacttacgtgcacgctaaccatctacgtgcagctacgtgcacacaacccattatacatgtgcattcacgtgcacactaactatctccgtgtacactcgtgtgtgttccaattcacgcgtgcacctacatgcaccaaatcactacgcataacaccaaa

SEQ ID NO: 539591 - DNA, 135 bp, Homo sapiens
accgaccaggcatgggaagataaggggttatcaaggagtgatgacgacttagtaccttaggcacccctccatttagagggggtgaagtttaggaggagccaaaaaaggcgcctgacaagggtagcccttaaactg

SEQ ID NO: 539592 - DNA, 601 bp, Homo sapiens
  misc_feature (480)..(480): n is a, c, g, or t
tgggaggctgaggcgggaaaattgcttgaacctgggatgtggagatagtagtgagctgagattgcaccactgcactccagcctgggtgacagggcaagactctgtctcaataaaaaaagacaactactccttgatggtggctctccctgtcaaaaccacatgtgctctgtagcatctttggttgtggtggtcctgttttcctaggaactttgttaatgtgctgtgaaagattgaaaatttcagtacgtagtgtctatgatataaaattgttcattgatggtacttacgtaacaggttatccacatttgaagacactggcatttgatatcttaaggaaatttggccttcaaatttcaagcggcaaagtcatgagaatatctgtttttaacgcttacaatacatggctttttagatttttggtacaaaattgtgtacaaattgtgtgcaaaattgtgaaatgtctgtgtacgtactgatccncaacacaaccaataaaatctcaattagagagaattgcttgatccaacctgccctggcctcttggcagcttgccagtgacagccccctgccactgcagttgcttcctctcctcatgccactc

SEQ ID NO: 539593 - DNA, 376 bp, Homo sapiens
acaacaggctttggtatcaggttgaatggccatactgcccaaggtgatttacagattcaatgtcattcccatcaaactaccaatgactttcttcacagatttgggaaaaactactttaaagttcatatgggaccaaaaaagagcccgcattgccaagacaatcttaaggcaaaagaacaaagcttgaggcatcacactacctctacttcaaactgtactacaaggctacagtaaccacaacagcgtggtactagtatcccaacagagatatagaccactggagcaaaaccgagccttcagagataataccacatatctacaaccatctgatctttgacaaacctgacaaaaacaagagattggggaaggggtgccc

SEQ ID NO: 539594 - DNA, 713 bp, Homo sapiens
tggctgctgtaggacggttgctccgagcgtcggttgccctgacatgtgatgtgccattccttgagggcatttctgccatctgcagccctcaggcctggctgcatgtggaagaacgatgcttgacgaaatttattggtgttctgggttccagtcaatgcaaaattattcatgcaccgagttcctcattgccaatgcaccctgcttgtcacccatgcatgcaccctaattttacagggtacatgccggtatgtcaatgggacgatgttcaaatgaccttaagccttggattgacctttaacaggggcgcacaatatttgaggtgggcttattccttcgtaatcctttgtgggcattttcaaccattacgggtggtggtccataacaggaaaacttgggtcgggctcttcaacggtggacaaaaaggcttacacggacattgttcaccggattggtggaaacctggttggcaaggtttggtaccggcaaggttccttccaggctggggattttccccaaagctctattacggccccactccttgggaccctgggaacttacacaatttaccaactacaaagggacaaacggacacttggggatggaggattccgggggaggcccaaccactttggaaaaccaatttccggccaaacttccgtatggttccaaggaacccttataaacccttaaatgtgcagggaattttatccccg

SEQ ID NO: 539595 - DNA, 183 bp, Homo sapiens
  misc_feature (3)..(4): n is a, c, g, or t
ctnnatacacaacgccagttaagttttgcattatcagtagagacggggttcaccatgttggccaggctagtttcgaactcctgacctcaagtgatccacctgcttcggcctctgaaagtgctgggattacaggcgtgagacactgcgcccagccttcaatcccctgtgaatttctttattggt

SEQ ID NO: 539596 - DNA, 209 bp, Homo sapiens
ggaacttctgaaggtccataagaaagaaggtaccctcttttgtagaaaagacattctcttcaaaattaccaccactttgggaggctgggggattaaagagagtataaaaagagtgaggaagatggggggcgggacgcaactctgtccagctgcgagaaaccgatcaacctcacagcaaggtgtgatggctctgatgcaagcaacatacc

SEQ ID NO: 539597 - DNA, 410 bp, Homo sapiens
  misc_feature (84)..(84): n is a, c, g, or t
  misc_feature (134)..(134): n is a, c, g, or t
  misc_feature (404)..(404): n is a, c, g, or t
cccactgcaaaaactggcatccttcgctccctcattattttctctttggtgtatcgatacagcataaagaaagctgggccaggnaaaaataacagcaatcaaggaaaaggggaaaatcagcaattttctgaaanagatgccctttccggcggcaaagggcatcatggtaaatcagttatagttaatcttaaaagcaccactgtatcgaggggccagcctcgatggggggtgcctggattggacgaaagttcagccgtataggttttttcgtagaccaacatgtcacttgtgaaatcggcgtattcagcatatttattgaggtattaggccgaggcgttttaatcagtaacgtagcttcagacccttaccatcacaatgcttttcttcttcaccacggttttcgntaaagg

SEQ ID NO: 539598 - DNA, 797 bp, Homo sapiens
  misc_feature (250)..(250): n is a, c, g, or t
gcacgtactaattgtcgtggttgatcaacgagcggggggctgttcgtatcattggttcgtttctagtcagcagcaggcgtggcgcacattgaacgatagtgttttggtcgatactgcgccaccgcggattagtgtcgcactatccctgccctgtgtccttattgctggcgttagagaagaactctcacagagtgtgtcgtctaggtaaagctagcccgtcgttctacagcatgaacaagtatttagtctntttgtcgtgcgtgagacgctaccagcacatgggaaggaacaacagtgttcgagtgtgctcggtctcgttactagagagataaatgatattgtgcgcacatttacatggcgaggatatagcgttacatatttacaagatatctgcattatctgctgttttcgcggcaccccgcaccttcgcatttttagtggccgcccctctctctctagaatgtatatctcgccgctactgtcttcactatagctcacctctcttatataccgatatagccgtggataaatatccgacactactcactcgctcctctcgaaactcttcctcgtgtatatatcactctctcattcgactagtctctatatcttttgcccagttgttccctttaatgtggcggaccaccgtggtgcccgctgcgtgtaggaggtgtcccctttctctctttctatcgccccgtgtatagtcctctacgagctcctccataaaggcccaacgtatggaagtcagcggcggccacccctcttgtggcggaacaaaataacagaacaaacaa

SEQ ID NO: 539599 - DNA, 402 bp, Homo sapiens
gtaacatagtacttgcggtccatatgccagcgagctcaagacccaagaagagccatttttcagttggcgtctgaaagcagaaaaacttatgtcccagcccaaagcaggagttcccccgttacttgagagaagaataagccctgttggttacattcagtgccttcaacacgactggaatggggtccacccacattacgggtggagtttgttctgccactgtgcagttatcattctgggatgggggtaccttactctcccaatgagaaattctaaatttcctcttttgagcctggtgcctccaccttctcagaactgcatagggcgtgagcttggtgggtgatgtgacctccagaacagactgtgagcagattttgtgctttaatcctgatttccaccttgcca

SEQ ID NO: 539600 - DNA, 258 bp, Homo sapiens
cgtcgggctgttaacctacattggttacccactacatttcctcattataatcagatgctattttatccacttcttggctttatatttttctatcttctatacttctccaatcacttgtcttagcttgtatttccttttctatctgacactcttgacaatattttcattttctatcttgtttctatcttccaattttcttctcacagtttgtcacattttagcccttagcttttagtttcctagctggtgtaaccactg

SEQ ID NO: 539601 - DNA, 179 bp, Homo sapiens
ttccaagcactggggatacagagaacgaacaacacacggttcttgccctcatggagctctcagtttggtgggggagacagacacgcaagcaatcgcaaacgcagtgtgtatggggatacatggccccagcctgccttgtctcaaagaagatctagggtcatccaatacagtgtggttgt

SEQ ID NO: 539602 - DNA, 939 bp, Homo sapiens
gcccgtttgaccttgtctatccccttcaccatcaatgaagggcgagatcacagggggaggttcggagtgccctcagtgcaaggctggggcagcaccaccatcactgacagtaaagacggcaacgtgatcgtgcggtatgcacccagtctgaggcgtggactgcaccgagaatggacactccgctatgacaacatgcacatccccaggaagccccttgccagttactatgtggattatccgtcaagctgtgtggccatgtgcatcgtgcctatgggcctggcctcgatgccatgtgagtaagtgaacaagcctgtccacgcttcaccgttcagacagcaaggatgcaagagaggggggcctgtctctggccattgagggacccgtccaaagcagaatatcatgctgcactgagaaccaggatgggactatgcagtcgtgttcctacctgaccatgtgcgtgccggggggacctacagtcgattctagatctaagtacaatgaacagcacgtcccaggcggccccttcactgctcgggtcacaggtgacgactccatgcgtatgtcccacctaaaggtcgggtctgctgccgacatccccatcgaacatctcagagacggatctcagggctgctgacggcactgtggtcccgccctcgggccgggaggagccctgtgtgcgtgaagcggctgcgtaattggccacgctggggattttcatttcgtgcccatggagacggggggagccctggttgcatgtgacagaagaattggaccagcctcggtggtccgtcaggccccatccggggttgatccgccaggtgggaaattggggatgcacgtcgggttcggggtctctgggcaaggcttccagaaagggcacctttgagcctgggaattaacatggtgcccgggcggtatgtgggcacattgatgaggcca

SEQ ID NO: 539603 - DNA, 194 bp, Homo sapiens
  misc_feature (28)..(28): n is a, c, g, or t
gggagggtttggttaatgttggggtttnaatttaaacccttgattaagcagggggcagggctcctgtgttccaggaggccccctgctattcagtgattttgttctgtactaaaaattttatcagcattgatgtgtcataaaggaatgacaggctttggtgtgatggttgagattaaatttagccttacctgtta

SEQ ID NO: 539604 - DNA, 95 bp, Homo sapiens
  misc_feature (19)..(19): n is a, c, g, or t
  misc_feature (54)..(54): n is a, c, g, or t
ggttgagtagcatcatcanagagaagtgaacatcacacccaacttccttatgcnttccagtggctaaaccacttaacctactctgggtgttacct

SEQ ID NO: 539605 - DNA, 825 bp, Homo sapiens
ctatcaggattttagcagcaatgctgggaaatgacaggaaaatgacaggaatgaatctcaccagattttttatgtactcagcagagccttgaggttcacggtgtttattgttccaatcaagtgaagatatctcctacttctcctactggaacatctcaggcttctgcagttgatagaacagagattgcctgtgatagtttcagttctgttagctttgtatctatttgagacaacataaaaaaccatcatttaaatgatcccgttggttcagcggctctccattaactgactgagtgaacagtgcctatctgtatattggactaaaccttttcctaaggctatctctcatggttcctatgttttttttgtcataattaaaagcaagaaccatctggatcacctaacagtcagaggtcagtatctcagcgtgtgaccattatagcaggaacatacagagagaacctcttccacttggttatcatttctcgtaccaacagtaagaatgcatggtgtcaccagaagttgaagatcgggttgaggatgggggctacgcgtcgatgacactatggccccaacatcgcgggacctgctgtggcgcggattccttaggaacgctgttctagccggccccctctccagggtcggcgtggcgggcattatttcctagttcttctgtgtaccctgaggtgccagcgcggggagttgaggagggggtcagggggttaaggattggaacttctggacgttcttgggccttcctagggggagtcttacttgtgtcgcggatttcccaagcaatgggagttggttaataccagtcttaca

SEQ ID NO: 539606 - DNA, 772 bp, Homo sapiens
cacatcagcagcccccgctgcccgtagcgggaagatgactggcagatgaggatggatgtggagtcccatcggctgaggcggtctgggtatgcggatgtgcacatgcctgtcaagcccgtccggtgcaaggcggctagtgtggctagataaggtgcgaacgagggtggctgtaacgagaagtgagagtaagtggcgcacgcgctggggaccgggatggaacgtggtgctctcccaaatggagccttgaaccatagagttctcttactggaaccatcaagcctctaatacggccccagacctttcgtgtgagaagtgctggttggtggagagaataaacgagctcttttgcgcagccgcagaatcagtacgggcgaaaggggtagtagagatgttgctgattgcgatgactggagatgacagtttgtatccagtactttgactgataaaggtacaggtgcagctttctctaaagctagtcctctggtccagcagattatcgctgagggattggtctcatgtctgggagacacttaggttgttttaggatagcgacggtcacggtgaactaaaaaaagttgtcacgtatcttttcctgcatgatcccctttgattgaatatctacttgttgcaaaccctgtagacagctttgtccagaagcaagggcagatccagggggtgaagaaatccaagactgctgaaatttcctgactttctgttgaatgggacacagtatacaagaaaacctaaaaaaaccaggcctagcgatgtgcat

SEQ ID NO: 539607 - DNA, 350 bp, Homo sapiens
tctggtctctcacgtctcaggagaagtttaaggaaacttattcacagatgtaggttgtatagtgtagtagtatgggatattaaggaattctcacctgtctacctttctcacttaatacaggaagtcaactcattaaactgagtgagaattgagaaggattatctgaatattcagaccactttttctattgtctgaatatttttatccatgttactatcatttttattcctaagtatgtactttgtcgatttatcattaatctcatattttaaaactcattttttgaccctcttgcatttggtgttccagatgttttggatgctgcccatttaatgtcctgcaaattttgg

SEQ ID NO: 539608 - DNA, 1019 bp, Homo sapiens
tacgtatggcttatcacgaacttgttttggtttcgtcatatattcttgccttcacaaagttttacactcattcaaacgtgaagattagaacataaatttctagaaaatagtagaactagtacttgacttactgtccctgtacatagaactctccagtaggacgtcaattctgcggcacaatcactcacatatgagcatttactaatctgtagtttatatttatactcttacacaatttactagcaccttctctactgtgagctacccatttacatactgcaatatgtacaccacacgccactttccacttctttatagatccagccatcttatatctggctattattccacgaccacacgcgtgcacagttgcgattatattaatctcacggaatctataggctcaaatactctaacacataagtccacacctttaccttcctgcccccatatacatattacataacatcaacattacatgcagcacatctttatggcacccgattatctcgcactccttacctttcgtatgctacacaacttaggcccccttgggatccccatcccattttatcaccctcgatatctcgaaaggttcaaatctcctggtgccgcgcacatctctggctcatcactcttggttatctacagcaacaccgaaggcggtgtctggcagacgaatcgaacacatgtccaggacgaaatattatgggatcaccatcaaacgcgtttcccaatttcacctgcacttatctcactctacacaacttccaaacacactccattacacaaactaatcctaccctcaaccggactcgacttaaaatttcctacacttaacaccctccttacaatattcctccccgcacaaacaccacaccatactatatgactcacaacataatcttacccacacacaacacattcatctggtctacatactttcacctttctcctcaatcgcccctcacttcacatcaacattttgtattgtactactttcactcacttaataacac

SEQ ID NO: 539609 - DNA, 310 bp, Homo sapiens
tcgggcatgatgaggatcggcaaattctggttgtatcttttatttttgagatggaacgattaggatttgatgatgaattaaatatcgggtctgaggtcaagggaggaaccagagataaatactatggcaaaatagaagaacccctgccctccctactcctcttctcataacggaaaaattgacacaagatattggaaattcactgagtgtggtgactcatgcctgtaatctcagctacttgggaggctgaggtgggaggatcaattgaggccatgagtttgagatcagcctgagcaaccaagcaacccct

SEQ ID NO: 539610 - DNA, 275 bp, Homo sapiens
  misc_feature (88)..(88): n is a, c, g, or t
  misc_feature (95)..(95): n is a, c, g, or t
  misc_feature (229)..(229): n is a, c, g, or t
tgggactacaagtgtgcccccccatgcctggctaattttttgaatttttgtagtgatgggatctcgctttgttgcccagggtggtttngaatttntggcctcaagggatcctcccacctcgacctcccaaagtgttgggattacaggtgtgagccccctcgcctgggcccccttttccatatgcctccaaaaacatgtccctggaaagtagcctgctccccccctgtcnctggatgtcatggggccaataaaatttcctgcaattgtgtttttca

SEQ ID NO: 539611 - DNA, 494 bp, Homo sapiens
gccacgctgactggtcacagaggagaaggtagaagatctgattcagatcccgatgtgaacctgcataaggaaaacactaatttatgttacaaaatgacatgacatattatggtttcaaattctattaaaccaccaaggaaatgcgcggtcacccctgtgtgggcgtcatttggaagacaagattgtatctctggatgaagaagatatttgacttcgttgtaattcccaaaactcagcaagtcatagaacaccacaattacatgtattgatcctaaccacaaatatccgatatttgtggttctggcaatgatgtggaacgttggataactagttggaggtacagaagactaaagaggataaataaatgacggaaattattggtaacccaagtttattttacgacgcccatctctttaatttctggtggtgcagaagttataaggtaaagcttgagacgatgagggtgtccacgtaggccagaacctcatatatcg

SEQ ID NO: 539612 - DNA, 339 bp, Homo sapiens
ccttagcatatcaacaagtactatagatctacatatagcaaggcatggagtgcggagtgcagggacaaaatgtgacaggcatgtaattcttctgctcttatcaatatcttataaatttcctgctcagaattataatagaaaagtccagaatcaggatgctagcaatacactcattacaggcagccctctgaacatatctcctatacaaggatgtacccatgtaagagaaaatcaaaccactaagttaaaaaaaacattacgcatccctgttatcgggacaagaatgcagaaaaatagcctctgcactaatgaagaagatctgaccgatgtacatcagcc

SEQ ID NO: 539613 - DNA, 172 bp, Homo sapiens
gggcgcggaaaacctagtgggcgcggaaaacctagtgggcgcggaaaacctagtgggcgcggaaaacctagtgggcgcaggaaaacctagtgcgttagaagtcggatgcggtggctcacacctgtaatcccagcacttgaggcaccaggcaggcggatcactggagttagga

SEQ ID NO: 539614 - DNA, 291 bp, Homo sapiens
gggtgagtcgcgtgatccttctgatcaggaggtccctggtggatacatggctacgcggtgctcggcaactaaggccttgtggatgttcaaggtgatgtgctccgattgggcagcagccttccttggcagccggagagttgcatatgggtactggggtacccggtcgacctcatcttcgtgaaaggatctgctgtagtccctctggcgctcatatccatagtgggctgaggaccggtaggacgggttgacacaatcagtttaaatgctgcaagcacactgttagtttccggc

SEQ ID NO: 539615 - DNA, 166 bp, Homo sapiens
gggcgcggaaaacctagtgggcgcggaaaacctagtgggcgcggaaaacctagtgggcgcggaaaacctagtggtggctctgagaaggggaggacccctgggcctttgattccatctccttgctcttttttctttcgtttttacgagacagaggtcctggctattt

SEQ ID NO: 539616 - DNA, 360 bp, Homo sapiens
tccgtgagcctgtgcaccggtcctaccggggctaaaacttaattaattaccatacaaaggtctgaccagacctagtagaaactcccttcaggacaggacaatagatggttccttccgggcgattgaggtaaaaagacacaatgggtattcagtgagtgataaggaaattcttgtagaagcagagttaggaaaattgcctaataattgcgctgctcaaacgtgcaagctgtttgcactcatccaaaccttaaagtacttacagaatcaggaaggagccatctatatcaatactaagttaatatggactgaacaaggtcttattaatagcaaacaataattgaaatcccaaacttacaaggg

SEQ ID NO: 539617 - DNA, 530 bp, Homo sapiens
ctgtgaaacggtatacattctggacaagggatgatactagggagtactgccagaggacagtgttgtgtctgtggagcctggcgctgcgtgtgggaagctgtagattcctagactgacgcctggtatggtggtactgccaggtaatgccgatgtgtgcgttagagcctggtcggctgtgggaggtggtggattctacactgacgcctgagcttgtcgtgctggcaggtgacagtgctgtgtccggtgatctggggctactgtagaagagtggtacatttctcactcaggcctgctgtagtggtactgccaggtaacgctgttgtttccgtagagcctgacctgatgggtgacattgtaggttctccaacaagtactgaggttgcagagcgggtcgggcagagtgctgttccagttgcacctgggctgctgtggactgtagtagatacctcactaaggactggcgtgttggtgctggcaggtgcaactgtagagtgagtcgagcctggttggctacgggaggtggtggattt

SEQ ID NO: 539618 - DNA, 404 bp, Homo sapiens
cacaccacattaacacaaaggcaatcttctggctcggactgttctttactactgttcttaaagaacacgttcattcgctgcagctaactagcctccatcttctacaccaaatactattccatgccctggaagtgtacgcaataactctcccaggtagcaccttataccgcttaacagcctttacaatctccaatctgaaggtgccacagtcccagaaatgtacacacttaggaacacaaaactgtacctacctgatgaagccatctatgtccatggaacgggcccgtttgtcactaaaccctgtgctggttaggactgcctcgtatttctatctgctctgctgaaatcttccggtactatctatccatataagattcagaataaatgaacgacatatctttaaa

SEQ ID NO: 539619 - DNA, 624 bp, Homo sapiens
acccacgcgtcgcccacgcgtcgcgctgcgcggggccggccgcgcagactttctcccgacccctccccgaccccacggcagagcccggcggctgtaatggttccatgggcgggggtggggtggttgccccaagacccatccttcagtgcgagttaactcattcgactgaccagtatcatgtgatgcaccgtactatgtgcgcaggctcaattgctcgagtccgcacaggacgcgcagccaccatgctgaggaggctgtgtatcgcaggacacgggcgtccaaccaggcttggcgtgggccaagggcaagacacggccagatgccagagacgaccaaggtccgctaagggttcgacatgccgccgctaacatatccttcctcgcacgcgtcaaaacaggtcgcctgcttgtggcatcaacgtgggcgtcatacctgttagagcttacggccctttggactctcagcgtgagcggggacacgatccaggggctcctgggacccccacacaggttggcccactggctctgagtcctacggggcaagcacacagtctgccatgtgccacgccaggggcgcaagagccaatggctggcagaacgaaggggtgcccagcgtgaagcccta

SEQ ID NO: 539620 - DNA, 420 bp, Homo sapiens
tgcagagacctcatagcagtgttgggagaattctgtgtgagggacaaaaaattcagaccctcatagtcaatgttctggaattctatgtgagggataaacattcataacagagcgggagtgtactgggttccccatcgaagaacacacatgattgaaacccttgtagcagtgttctggaatcctatgtgaggaacaaacattcagacccccgtgttagtgttctggaatcctatgtgagtgacaaacattcaaacaacagcgggagtgttctggaatcctgtgttatgggcaaacattcagaacctcgttgtagtgttctggaattctgcatgagggagaaatgctcggaacccagcagcagtgttctggaattctatgtgacagacatacatgtagacaccagcagcagtgttctggaat

SEQ ID NO: 539621 - DNA, 952 bp, Homo sapiens
gatttttttcgagttaagaacccggagccgaaacaccggtagtagcggggaggtgggtactacacaatcgtctccagccttggtcctgagtggactgtcctgcaggaccatgccccgtaaaggcactcagccctctactgcccggcgcatagagggaagggccgcacgcgcctgtccctctgagaggacgtcgagatagcgaccgcggtactccttgaggccgactgccctgccggtagggaggaggctcatagccatccgggggggtaaagtactcgcaaagtggaggaaccttttgctaaattcactagtgttatcgacagtaggttttgtgggacacgaggatttcttacctaccccccggggctccagaattggacccaggtggaagtagagaggcttccatgcgtgtttatgaatagacttcccttttgtgtcaacacccagaatcttccaaattcacttattgctgggggacaaaaatcctgagaaccctgttccaataaaggccgctgatcccttgttttactcgggcgcccaaggggggtggttgcacaactccgatggtattggctctactgctatagggtgtctggctactcgggccacaagaatttggttttaaagaacctccaggtatttaactacttaattctggtatggaccacagggaccttcagacgtgtcctgtagaaggttcatgtaccaaggcttatgaaaaaggagggatgataatgaaggcatcctaaaggatcttgtatccagaaggcggagagaatatattctggcttcaattggggggaaggaataagggtgggaatcttggagccgattgtggccacaaattaataggggaggaccagtgtgttacagcgagtcatggtgtgattgaacatgggggggcacaacaggggtaaagaaatcgttgtggttctttttagtttctttcgat

SEQ ID NO: 539622 - DNA, 387 bp, Homo sapiens
tagaggcccctgatacaccctatacacctatgcagctgcctcagctcccagtactaggattacaggcataagccagcacaacggcgcaaattttctaggaaaagtagatcttttgtttactttcttaaccacaaaatagtaaccagtggggcggtggtatatgcctataccacccatttgacggctttctggggatgggggcaggccggggaaacaggtccttggctcagggcttgttggccaaatgtcacgagaattcccaatgcccgggcactagcagaacacaggtccaccgcagtaatttgtcctggtcggagcagaaggtcggctttcaggcagtaacagattggtctttcctgggtttcacgccggaaaaagcacaatcag

SEQ ID NO: 539623 - DNA, 745 bp, Homo sapiens
  misc_feature (14)..(14): n is a, c, g, or t
  misc_feature (18)..(18): n is a, c, g, or t
cgttgattgccacntctngggaagcgcttgattgccttctagcgaagcgcgccattgcgttgtggccgggaaaacggttatgatgggctacaatgctgacttcggtacacacgaaattgaggaagattattgatgacatatgcaaaggctaactcgacagattgcagtgacttatagaatcaggcaaaagcatggctaagactaacttaagactcagtaatttcatgaaagccatattcataaggcccaagcggtaaccagctttatagtagcacgttgcaatcatagattgcagcagtgaaggcacggactccgtagccacggaaaacttgggcttatcaaatgcgacaagctcacgaaacaccatctgtccttggaaaggaacgcttattctcacagaatgaccgtgtgagccactaacgccagcatatttatacatcggtcgaagattggatgacgaccaggagatcattgtcattgccacaatcgcttaatggggagtcgaatgaagtctaatggccgggggttcaaagctatgtggatgtaaaaaccctggggtccccaattaaaacactttgcagaacaccccgttttagccagttgtagaattggccaaattgtcccaccggggcgattttaacaaattgggcaatcgagcttaagagggaattttacagtaaaagttcggggaaaaaccggttaaattggaaaaccgggtttttcaaaaaaaaggcgggacgttttt

SEQ ID NO: 539624 - DNA, 947 bp, Homo sapiens
tgatctgcctctcaactgccctaagtcctagctaagtatcagggaaaaaaaaaaaaaaaaaagcctaacaaaggggataagactagggctgcaagtagtgaggatttggttggatacctctgcggggatgtgtgcttcccatatctggccttcaggaataacactgtgcctttcccccaggaatatgggctctgtctacccagtgctccagttcccggtaaactggctctggaccattggtgggacaaggggcagggtctccatattttggatcatccctttctcccagtgaaatccaaatagcccttacctagagtctagggcacaaagacttcgggggaagatacactggagatggacctgaggagacatctacacacaccagtggaagttgccccagggctgtttccccttcctaagtctgggcatcctctgggaagggatggggtgggtgctccaatctcgggtgcctaaaaacccaagtttatttctctctaaacactggcaataaccagtccacaccactgtggcctttaaaaacctcttaataatctcatgcggggtggtctcgatacaatccatttatcacagggctgtgtgcgtaaatgctttaaatgctctctcatttgtcttccccataaccccatctaggtatgtattgagctaacctggtcctaagtaaggtatcctgtcctgtggtttccatattgatattctccaacatgggtcttggggtgggacttttttttcatgtgggctttggaaagatatagtaaatgtgtagtagccctggaaccatagaggtttcttagcacaaacaaaaaggggggtcaaaatcaccagggcgatagacacgttaaaggcaagagtaaaagacgaggaaaagagaagaggattgagatgtatgacaacacagaatatgcatggtatagtgaaaaaggatttat

SEQ ID NO: 539625 - DNA, 159 bp, Homo sapiens
ctggcccgtgttttacactggccgtggttttacacttggccgttgttttacactctcctgttattttaatctttctttctttttccacttcttttttttattttatatttttcctttttttctatctcctcttattcattctctattttgaatttacag

SEQ ID NO: 539626 - DNA, 851 bp, Homo sapiens
  misc_feature (493)..(493): n is a, c, g, or t
caaacctttatatttttagtagagatggggttttgctttgttggccaaactggctaacatggtgaaaccccatctctactaaaaaatacaaaaaattagctgggcatgggggcgggcacctgtagtcccagccacttgggaggctgaggcaggagaatggcgtgaacctgggaggcggagcttgcaatgagccaagatcgcgccactgcgctccagcctgggtgacagagcgagactccatctcaaaaacaataaataaaaaataataataacaataataaagtataatataaacagccctgtatttaagcttatagactcactacaatcgactcaatgagactattcaaatcttgttgttcagaaatctacctctgtcaaataattgatttgttttcagaaatgctttacataggccaggcgcagtggttcacgcctgtaatcccagcactttcggggaccgaggttggcagatcacctgaggtcaggagtntgagaccagcctgaccaacaaggtgaaaccccgtctctactaaaaatacaaaaaattagctgggcatggtggtgcgcacctgcaatcccaagctacttgcaaagttgaggcaggagaatcacttgtacccggaggcagaagccttgcagtgagcttagatggtgccctgcgctcagcctggggaacagagccagactcgtctccaaaaacaaaaaaaaaaaaattttgggccccggcccaaaactttaacacttttggggccggcccaagtataaacggcacacaggcgcccagaaagcggcaaaggggttcccaaaaaccggcccggttaaccagggtggacagtaaagagaaccca

SEQ ID NO: 539627 - DNA, 790 bp, Homo sapiens
ggcctcgcctactgtcaccaccgcaaggatcctgtaccgggacctgaagcccctagaacctgctacatcatcgacgagggggtgagctgaatgctggccgactattggactaggtcaggtccttagtacatgtgcccacaaagacttatctccaactgatgtgtgtgttgacccatgttggtacatttgccccactcatactagtgctagcaggagagtccatcattaagtacatccatcctcactcatttgattactagtaggggcatgtggagcttgctattatcaatatatcttacgtaaaggatcacagtggtaagagtctccttctatctcactgggcatcaaattatgttcaattggatgagtagcatagatcactctatcaatactttatcagctcttcacttctgggaaccaccttaatatgtaagaagattgttagtgacccgactgttgcaccatgagcataactacatagaaatttcactgttatcttatcaagatatatacacctatgatatatcttacctagaaaaacacgctacatcatatcatctcagccacaagagatatggaatacaggactagagtattcctaacataccaatgaattctgtacctgcatccctagtagtagaatacccactatttcagcataggcaaagccagaaggaataggactgatgatcaatccttatttacctggtcaactgaggacaagcaagttgtagcaccaaaataatacataacaacatgcccttccacaaatctatctctagttaatgag

SEQ ID NO: 539628 - DNA, 305 bp, Homo sapiens
gcaccttccaagacggtgtttctgttccccgatgcatatcaggatatggtcggtcccaattgctcttgtgtacaggtggttcggggcccattgaaagtgttgtgaagggcctcagctttaatgcaattggggattatctcctgagctcctccgatgatcagtactgggctttctctgacatccagacagggcgtgtgctcaccaaggtgacagatgagacctctggctgctctctcacctgtgcacagttccaccctgacggactcatctttggaacaggaaccatggactctcagatcaagatc

SEQ ID NO: 539629 - DNA, 201 bp, Homo sapiens
aggttacacttgctgcattttagaatcccaggtcggagttgctttataacatagcttattttagccgggcacggtggctcacgcctatatcccagcactttgggaggcccaggtaggtggatctcctgaggtcaggagttccagaccagcctgaccaacatggtgaaatcctgtctctaccagaaatacaaaaattagccg

SEQ ID NO: 539630 - DNA, 240 bp, Homo sapiens
aaatgtgaacactcacttgaatattttcattttttttttaagttccttcttggtaaatatcctatttgtggggtaagatttactatatcttagtttaaattctgctgtgtagactttggcagctgcctctatggtgacgaaacaagctttttttttttatttttttttttccttaaaaccgggaactttggggtttccccacggcatcatcttttggcctttttctttaattaaagcgtg

SEQ ID NO: 539631 - DNA, 296 bp, Homo sapiens
aaaattttaaataaaccggggaatttgggccaaaaatgtttttgccttttggttgatttttttttccaagccgaccggtaaagggaaacaattatttatctgttggcccagattggattatgattttaatgtttgaaaaattgccccgggttggttttcccaaatgggggggaaaaaatattttctgttcccaggaaaagaaaatatggggtcatttaaacaggaaaaaaaccctttggggaaggttatttttggtttggcaaaggatccatttaactatatgggttttttttcca

SEQ ID NO: 539632 - DNA, 97 bp, Homo sapiens
atgaatcacttgagcctgggaggtggacggttgccgtgagccgaacgaaattgatgccacttcaccccagcctgggcgaaagagtgaaattccattc

SEQ ID NO: 539633 - DNA, 343 bp, Homo sapiens
  misc_feature (277)..(277): n is a, c, g, or t
agcccggctactggacttctcgtgtctgtctctgctgtacgaggtgttttttacatttaagaaaaaaaaaaaaagaaaaaaagatggtttaaaaaaaaaaggaatccataccatgatgcgtttaaaaaccaccgacagccctgtggttgggcaagaaaggcaggagttatgtttgcaggtccatccgggccttgagcagtgggttcacccaccgggccttgaaagaggtgagctgggcctctctgggtcccctagggatcttagggggcccaggcanagaactctagacagagcttaggggggccgtagatgtgattcgcagctccctggaggtgggcctggc

SEQ ID NO: 539634 - DNA, 452 bp, Homo sapiens
agcggggacagaagggaaaaggccccgcgcgtctccacgtcaacaggccgcaaaggcagacagaagggaaaaggccccgcgcgtctccacgtcaacaggccggaaaggcagacagcaagggaaaaggccccgcgcgtctccacgtcaacaggccggaaaggcagacagaagggaaaaggccccgcgcgtctccatgtcaacaggccggaacaggcagacagaagggaaaaggccccgcgcgtctccacgtcaacaggacggaaacggcagacagaagggaaaacgccccgcgcgtctccacgtcaacaggccggaaaggcagacagaagggaacaacgccccgcgcgatatccacgtcaacaggccggaaaaggccgacagaagggacaaggccccgcgcgtctccacgtcacacaggaccggacaaggcagacagaacgggaaaaggaccc

SEQ ID NO: 539635 - DNA, 301 bp, Homo sapiens
gcgtcgacaaagcttccggactgacctgagggtgggggtgcccggctacatcacacttggcgactacgctcgtactccccgaaatgcatttacggcgcagccttgacgacgttacctaatgtgcggtagagcgacggatcagatgcgagggcttcaccgcctatcacgtcttgataacctccgaatgcgcattagttctatctcaggagtgagggcatgggtgctaaggtccatgtcctcaaaggagaagaatccagaccatcagctacggtccccaaatccccactaagttgcactcacg

SEQ ID NO: 539636 - DNA, 175 bp, Homo sapiens
  misc_feature (103)..(103): n is a, c, g, or t
gactctcgaaggatctccattcgattggcgggcaacttatgcacgcttactatcttaacaagcttgagtgcagagatgaagagtcaaatctgaccaagatgtngatgttggataagagaatctctgctccccacctctaagtggcccgccaatcgaagggtaccggagctcgaat

SEQ ID NO: 539637 - DNA, 550 bp, Homo sapiens
  misc_feature (517)..(517): n is a, c, g, or t
gcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacgntatgtggagcattggagtgttaacatatgtcat

SEQ ID NO: 539638 - DNA, 250 bp, Homo sapiens
tttttgagaggatccccccaggtggggcatcacgggttagcatctgtgggacattttggttggaatatgctagaaatcattccccagtttattataattcaggggattccttatttctggaaacaatttatatagaaagttcttcagggcaaaccttttcttgggcgttcttcagaaggccccagggtacggtgtactatttatcgtagatattccaacaaacttctggtgaactcagtgatgcccaggg

SEQ ID NO: 539639 - DNA, 952 bp, Homo sapiens
ggtgcgatcttcgggctgtcagagtgggtctgtaactcggtggtggcggagtcctacggaagcccgtttcgcttcacttttcctgctgtagaggctttccccctggcggtgagagtgcatgagacgaaggtgcgagatgagcactatgttcgggacactctcctcatcgtaataatctctgtgtgcacggtctgctcggaaaagggggcaataaccctgggtcctgttttaccatggaacagacctcgtacaaggcgactgaagggccagaactggtgggaacaaccaggcgtgacaacacaacttggacacagcacagcacgggaaccacataacaggaagtcagatgggtcgaaaacactagaaacaacgacacataggacgagaccaaggcacggagacatttgaaagaaataccgcacaccagcgactctatcacatgttcaggaatggaaattccccatgttctgctaatgtggcttttgtgttaacctggaccctaaatggaacattgtccaacttccaataatttgagtgggtacaaggtgggtgacaaaagcttcctttattacccccttctttctaacattccaaagggaatgtctcatcgaaatctgtggggcagattgacacacaagacgtgtacattcaatttcctgtattattcgtctgtactatgtcggtcggaagaacatcagaacgattctcggcctggcgcctttaaagagcgcacacagaggccaggtggaattcttggccacaacctctttgtgggaaggtccatggaactcagaaatcttaatgttatcatcttcagaccacgcaattcaactggcgcttgttgggcagcacctaggtagctaaactggcccttccagttgcaattaacctgtgttgtaaagggacggcccacgcatgctgctgccaagagtccaacggcgagacagcgatc

SEQ ID NO: 539640 - DNA, 503 bp, Homo sapiens
  misc_feature (470)..(470): n is a, c, g, or t
ttcccagttccttctctaaatttcaaaataataatacattttttaaaaaaggtatacagttactgccagactgtaattaatttactctgtagttctggtgtaagtgttcgccatttcttatgagttatatattactttaattttgcccttctctagtgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacgntatgtggagcattggagtgttaacatatgtcat

SEQ ID NO: 539641 - DNA, 979 bp, Homo sapiens
gcgctgccccgatgaagctgagccgtcgtgatctacctgcacacttgcagacatgactgccccaagcggcgcctcaagtgcgagtttagtggctgtgacttgcagctgggtgaggcctatgtagagccactgtaggggtatgtagcgccgcacagtgagtagtgtctgacttgtgatgaatatagtgtgagtgctcgctgcatgaatgcaggtcgtgcgtgcatggtcccacgtcgatgccagcctctagagatgcgcccatgccgcactcagtcctgcacctactgcgactaaggagttctgtctttgagcactctatccagaggcgcagccagataccaagtgcgccgataggctgctcgtgttagccttgggccgcaagccaattgtggtgtgggcactgtggctcggggaggacctgccaggaccatctgaaggacgagctgtaacgaccgccctgtgtgcgtctgcccattcagaagacatccgtgctgctaagtcactaggtgtgccctaagcgtggcaatggcgacggctatgtgtgaggagagtgtgaagccacatcgtggccatgatgtgtgccctggttgagccggcaacggaaggacgctgcaggaagcttcgcgtgaagacctcgtgaggagctcatcaggtgggcacgtgactggcgtgctcatctggacgattggcagggtatggacggtggctacaggaggccaaggccagagcccagacttgagtgcttcagtccaggcttctacagacataagtatggttacaccgctgcaggtgtctggattcctcgatggcaactggcagtggtgagggcacacgacttctcactggtgcattcgtgtggctgctggtgcctttgacagtcgtccttgagtgggccttttgcccgccgtgtcgccttctcccggctggtcagagggacctgggctggttagaccgagcccgtcccttggcaccttccggc

SEQ ID NO: 539642 - DNA, 369 bp, Homo sapiens
cagctagagagtgcaccggcgtggtatctggtcactgcagtctctccctcccaagtgcaagtgaatctcctgcctcagcctcctgagtagctgggattacaggcgcctgtcaccacacccggctattttttgtatttttagtagagacggagtttcgccatgttgaccaggctggtctcgaactcctgactgctggtgatccacccaccttggcctcccaaagtgctggaattacaggcgtgagccacctcacccagcctacaataaatctcttgaacggtattcctcctagctaactgaaattctatcttttgaccaacatctccctaccactctctccctgcaactaccctagctgaataatctcaa

SEQ ID NO: 539643 - DNA, 230 bp, Homo sapiens
  misc_feature (86)..(86): n is a, c, g, or t
tagatgacaggacaggacagtatagaacattgaagaatcacaattccagccagacgtggtggctcacgcctgtaatccccgcattntgggaggcagaggcgggtggattgcttgaggccagaagtttgagaccagcctggccaaaaaagcaagaccctgtctcttctaaaaatataaaaaaacattagcagggaatggtgacatgcctgtagtcccagctacttgggagg

SEQ ID NO: 539644 - DNA, 302 bp, Homo sapiens
ggtttgcccgccttgcattttgacccctggaagaaagagttttaccgcaacttcaaaagcatctccaaggccttggtggagcggggtggtgtggtcaccagcaacccacttggcttctgaatactacccgccagggcctgtcccagttatgtgccttccctcaagccaaagccgaagcccctttccttaagagccctggtttgtcacgaaggggcctagtgttcccaacaatatgcactgctctaaagagaaaatactgacctcgcaaataataaaaaattcatagccagacaaaaaaaaaa

SEQ ID NO: 539645 - DNA, 179 bp, Homo sapiens
tcgagatggggtcttgctcaggctggagcgcagcgttgcaatctcgactcacagcaacctccgcctccaggttcaagcgattctctctcctacagcctccgagtagctaggatacacggcgcctgcactgcgctcgctaattgttttgaattttatagagacgcgtttcaccaagacgg

SEQ ID NO: 539646 - DNA, 892 bp, Homo sapiens
catcaccttatatgtacactgttcgtaattaatgttcgagatttatgatgctggcttctggaagtattagtcgagtgctactttgtaaaagatcccagacttgtaactaaatgctgacatatctgttactgttgactcacattgcattctccgccattcaagtactattttttatccacatttttgtttggttcccaaagggtatctgtacaaggatatgtgtgataatgctcggaattcgagtaactattgtcttttgtctgtccaggaaacactgcgttgggatatttagggatagatttacaccataatttggggatagggatatggtctcgaatgctgatccacattgttttaggtcataagacattaaatgtgtcgagaaatctgggtgaagagagactctgcagctggcagtggacggtccgatccatgtgttacagagatactatcttaatgggagggaattgataatataagttcagaagcagaagtgtggtaaaatgttaaatacatgtacaattgtttaagtaggcaatcgatttgtagcatgggtgcctccaaggtttcaagcaatgggcagagttgaaaatactatcagattccgtcgcacctacgtttattatctcacgagtaaactgtgaatacctcttaggggtcatttatcacttaaataatactgtaccctaggtctttcaaattaaaattatacctgaatggaggtgctgggaaacataaggaattcggtccaagtaccgtttccccaattgtttcttgttccggttatgggacggcaagatttagggggacaaagtggttaagaaaaagaggtggcatgtatttatatagccggtgaacgagaagtttaaaaacacaatataaggcgggaagg

SEQ ID NO: 539647 - DNA, 718 bp, Homo sapiens
tccttttcctggctgtagtgtggaaaataaccgggaaagaggcaaaaaatgggttcagtgaaggtcagttaaacaataacaacttttataagtgaaaaacaacggcagcccggactaccggggtggctgtggaaatgggtgaagggatttgaaattaggagatagaaatgctgtggaactgtgagtgggttgtgcattagtgggcagttaaggacaaaagggtgtcctataagcccctaggtttggggctacaagaacgtgcaaggcacaggcctcccattatcaccaagtctcgtggagaattgtgaaaagggctgtggagattctctgaggagaacaccagtggtcttaggttctcaagatgtgtggggacaccattatatatctctgtgaaagaactcacgtgtggggtgacccctcttcccgagtgtgtgtgagagtctcactcacagaacagagagtgtgtcttatacagagtctctcgatggttctcaagagaaaccagctgtgtgattaatactataatatatcaaagattgtgtcttccccgcaccccccaagaaatatgagggagagaaaactattaaaccgaagatttcctctccttttcatcccaaacatattaaaccctattaacaaaacccacgaccaagacaaaaacaaatataacacgctgtggtttcgcaaaatttataactaaacacgtttatatttctct

SEQ ID NO: 539648 - DNA, 350 bp, Homo sapiens
aacatgatatatctagtatagtcgtatgtctataagtatatacatatatacaagatacatgtacagtatatgtaatattgcatctggtaatagctattaaatgtatactgtatataatagctatattttatatacacaatgaatatatttatattttaataaaatttgtgtatgtaaattttatgtttatcatatcaacagataatcatatacaatacacatcacacaatattatcacacatatattttgcatgcatatataatcacaccacattataaaattcatttatatataaatatatatggcaaaaatagctattagttctttttctaatctgggtagtcacaga

SEQ ID NO: 539649 - DNA, 490 bp, Homo sapiens
tgacttttcatttaacgtctcaaaaattgatgaataagacttcgcatgaattgattccataaattggatgttattcaaaacggcttcttctttttggttaagggcatcaaacttcagttgggctaacccatcttgtgattgcaaagtatccaacgtcgtgagcccaccacgacaaggttcatcgttttttgttcttgcggtgtcatgttaccacgccaatgccgcatgtcatttgatatcgggatacgcgtgtcgagccaaaattgttgggtgagcttttcccacgttgccttgtccactcgtcttcatgttgttccagttaattgctgtatatgaattgtcttttaaatgttgtaccacagttattctccaatattggttgattaagtgataagctttgtctgcatcgatgtgcttcgcgtaattcgtaggcatatacatcgggacgttaaaccgttcagatacgtgcgctgcaaatgaattgcgtaaa

SEQ ID NO: 539650 - DNA, 924 bp, Homo sapiens
actgaagaccttgcccagaaagtcaagtaggccttaccttcgcacaccccgccagaagatcatcgggagcagcagtgccttggtccagcagaagaggcaatgaattcctggcatctgtggctcgtgggacgtagctcctgcagactcaccagaatgctccaaggcgcagctttgctggtggaacatgggatagggaatatgtaggattagcatgaccagacggaatatgctgaatttcgagtatcggaggaggcacagactaatgtccgtcggaggagatgttcacgagtctactcacgtaatcctccagaccctgatgagccaggtgaacagcagttaagatattccacgaaggcggcagtagcagccgcaggcctggtacatcctggggcaggtgctggcatctactgagtagcgctgcacagctcttcccggcgtgactagacccctggcagtcggtctgaaggagcaggactctcttcaggctcggagttccttggatgaagacgatcccaatatacttctggcgatacaggtatcactgcaagagtctgggctggccctcgatgaagaaactagagacttcctcagtaaggaagcatccttaggtgcgataggcacttctttaccttccaggctggacctctggccccggaaatacggatagccctcgggctggcttgagcagctctgagcttttgggactggggggaccggctcatgagactaggagccgagaatgcgccattttcaactgggaccctgagcttcaaccctcttcagggagggccggaaagtggatccggggccctcagtctagtggagtcctgaatccacttggccaggaccccgaggatcatgagaagcctctcgggaccatcaatggtggggcctgacattgaccctaaaattggccggaaccaa

SEQ ID NO: 539651 - DNA, 500 bp, Homo sapiens
tgaagatgagtcatcagaagaagactctgagtgatgaagatgccggcacctaagagaaggttgcatgaagaaaaccccagccaagtccccaggtaaggccgcatctgtgaagcagagagttccaaacctgctacctaatagtctcagctgcccagcgggggaaagctaggcccttgcctaagaaagcacctcctaaggccaaaacgccgtgccaacgaagaccagaccctcatccacagtcatcaagcaaacctagtggtggctcctcaaagcaagcctgcaacctagtgccacagcaccaggcaacgtacacacattgccgggccacacgggcaaatccagccatgcaagaagtcttctcaagcacgtcgcaacaacacgttcaacatctttcactagggaaacacaaccggcgtatcaatgactgcacacatctccaccaaattcttcattctctctcaacggtccacgtcgtgccatcccgtctcaacgtttcggaa

SEQ ID NO: 539652 - DNA, 355 bp, Homo sapiens
gggtccgtaggttttataggggagcttcattctcctgcagggaggatgatgatatgtaggcataacctagactgggaggaagctagataggaaagacaactgacatttatggaatatcatgcactagtcccttacatatgtcatatgctcattatcgaactcagcagcacacagactctcggggattttccatctgacttccctggccactctcatcccatccttgcactaccagacgattcatacactcttgagactccagcgagacgctgttctcaccccttcctcctcctagcctctctcccaaaccgtaccacacacggctgacacaccccaacaaaccacaaacaaacaa

SEQ ID NO: 539653 - DNA, 1778 bp, Homo sapiens
  misc_feature (440)..(440): n is a, c, g, or t
  misc_feature (1726)..(1726): n is a, c, g, or t
tagaatcctcaagcgtgacggaccatcatccttgcgacaaatgtcagttagtctttttcacaggcgcatgctgccagtgttataggtcggggaaggtctctacaaaaggaggcaacattgagatcacacgccactcgcgcagagctagattccgctgctctgtgattcacgggcgtaggcgagggaagccagttgtccgatacactcgcagtcggagagtctccgattggcgctgcatgacaatctactcattaaccttgatcacgcgagaaggtaccacgattcgctcagataagcgtaaggccaaatgcatcgagttacattagagttaatttacttctataaaatcgtacatagtaaatcaactataacacataagtgaaaataaagtaccacacgaagagcaagatatcatagattttcatacataaaaatgatanagacgcataggtagacaacacaccacaacaatagatagtcccatggatacacttgcactattcaataacaatcaacattcgaatagagaacaaaataagtacgaggccacatacgatacaaaactcacaatagtagtgtcgccacacagtaatccctttggtctcactttcccacaatctagtcacaagggttgacagtccacggttccctatctgtgtccgaggggtcactcaactccaagactctgtgtaaattcacttatttcgtagttgagggctatgttgccacagtggttgcgcagagttaagggtaaagttaacccacacttgaatagcactccagaagtttaaccggtcggtacacaattccctctatgacgaataacaatccgttccagaggaatgatcccccgacgagtaagtagcattggaatcattacacttaaagcgcgaggatttcacttaatcgggcttaggataaaccgcattggaggcacctagggccccagttattcgtatagcgttgctttaccaacatcgaatttttaaactcacttaagttcccataatgcgtgaaacgtttaccccgggacaggtttttccacttaataataatccgttccgagaggggctataaaagacgctgttcctcagcggagcgaaggccaaacggcaattcctccctataattgtaagcgtataatattcttttccggcgcccggcgtgttgagaatatcgcccaatgggcgtttcaccttgttggcaacggtaagagcaacgtggcggtttaaaacaatatgcggggtacacaaacacgcatactgtcctaccgcatgaagggcagggaggggagtggtgtaccccccagtcgtgataaacccggacgaggtatttatatggcgccccaagagggggggggccaataaattcaagaaagagcagcttctctcaccaagaggagcagagccaacaaagggcctttagtatgattatccccccgaccaattatctatggtcgacaccagaatagccgccgctccatataacgagcgtacacattatacaaccatacgacgcaccgtgaaaatgtaggacccccgctagaatatacaacacatgtggccgccgtgtgtatacaaaggcggatggtagacaaatcagttagggtgggaagaccaacaacacagacccggcggtggtagacacagtgagactgcagcctcaccggaacagaagaacacgacgaccacgcaatcaaaaatcatagaattgaataaacagaagnatgacaatcatatgtactagcgcggtgacagccatgactcaagccagacaca

SEQ ID NO: 539654 - DNA, 858 bp, Homo sapiens
tgaaatggagtctcactctgttgcccaggtggattgcgtggaatgatcttggaatctctacctcccgggttcaagcagtctcttgctaagctccagagaccacgcctgtggtcccagctactggggaggctcgaggaacatgaacaattcgtcttgaacccgggaagtgaaggttgccgtgagctgagatacacaccattgccataaagcatgacaggtcctttgggacttttgtataacctgtattgtttcataatggatacatgcataatttctcaaggagaataaagatggagaattcatattattacggttcattcttttcaagctcgagagcacaatgagtttgggaaaagagggtggccactttcgtgactcggataagggaaatacctcctcattatactttgtagtgacaatctctcgggtatacctcaagatcatacgtctgacaaaacgggggacatccaagcagaaaaaaaacgaggccctcttccttggaataggtgacccgcagaagggtgggcataggcagccttgtgtgtgttccttggggaagacaacacgaaattcgtggtgtattcacggaagggattgacattcatcccaggaagaacgagtttctcaggcccacacgttttgtggtttgcgtttcccataacgagttacccgtgggtttaaattactgcactctttaaaagaaaatcagcggcttgacccgcgattaaaagaaaaatacggccgttctggggtgcccttctgtggggttacactggtcgaaactttcacaacgcctgcttttgggcggaaccctctttaccgataagacacgctcattttgcacctttcggaaatttt

SEQ ID NO: 539655 - DNA, 221 bp, Homo sapiens
gagaggggttttcactatattgtccagggtagagggcagggggtattcccagatgggaacataggacacggcagcctccaactcctagcctcaagggatcctccggtttccccctcccaagtaggattacaagcaggggccgacgaggcccagaatccagaacttggtttatccctttccccaacaacctaaatgggaaaacagaataaatttcccccaga

SEQ ID NO: 539656 - DNA, 117 bp, Homo sapiens
tgactgctctactctctcgtggttcttcttcatgacagagcagctccttcttgagcagcctcgatctctgtctccacgctgcagtcgtgagatattaggagtatcaatagaccttga

SEQ ID NO: 539657 - DNA, 222 bp, Homo sapiens
tgtatgcagcgggtgtacaaggtcgcagaaggaccgtgcggacagagtgcccctgtcttcacagcaggaagcctgcggcatggtggagcacccccatggagccatcgaccataacacagcacgtggagaagtctgggcattcgaactgactatcagggcactggatggcacccacggatgttgtaccttgatcttaggcatgcaggatctgcccgactgcac

SEQ ID NO: 539658 - DNA, 357 bp, Homo sapiens
gcgtggtcgcggccgaggtacggaatagaatgcaatggaacgaattgtaatggaatggaattgaatggaatggaatggaatggaatggaatcaacgcgagtgcaggggaatgtaatggaacggaatgcaatggaatggaatcatccggaatggaatggaatggaatggaatggaatggaatcaacccgagtgcaatggaatggagtggaatggaatggaatggaatggaatcaacgcgagtgcaggggaatggaatggaatggaatgcaatggaatggaatcttccggaatggaatggaattgaatggaatggaatagaatggaatggaataaacccgagtgcaatcgaatggaatc

SEQ ID NO: 539659 - DNA, 371 bp, Homo sapiens
taaaattgtccttttttttaaaagggggggagttttccctaaaacacttattatgtaagggtcattaaccaaatgttttgaagtagacatggaatttatgaagggttttttatcattttttttcccccttttgggcatccggggtggcctccagttttaggtcctttagtttgtttttgtaagcaaggggaacccctgttgagggggttttttccctcatgtatacttcaagtaagatcaagatttttttgtgaaattatagaaatttactatgtaaatgcttgatggaattttttcctgctaggggagtttttgaaaggggctttttccatttttttaaaactccccatgcatttaaaaggtccaatgca

SEQ ID NO: 539660 - DNA, 838 bp, Homo sapiens
ggcttcttttggggcccccccggatcggccatgctgccttcacctggacgtcaaccccgcccggctgatggtggtggaggagcgatgtggttactggtgtgactctgaccacagtggctggctggatccccccggagcctcgggtctcctctagcttatttggtgtctccagggctgtccacgggatttggtcttgcccgattccaaagccacgtggcccagactatgaagggttttgaatatatcttggctaagctgcaaggcgaggccccgttcccgagaccacttggttgagaccagcccagggtagcccaggagaaggccaaggagacggcactggcagctaccagaggaggcccaggacctcgcccagccaggcggccccccagaagccagccagccagcagccaccagtttgtgtagcccagtctacccacccccccccagcaccccacgacacgctatggcttatgcctctctgccctcccttcacattgtaactttatcacgttaaaaatcaaacttccacgccctgtctgctgtctaacgtggtgggttgtggggaatacacatttggcaatctgcacgtacaccccagcaccactgaattcaatgtctgagccacggtctgcttaattctccccgttgggcacagcctgaggaccgcaaggcacagaggtgcggtgacttgcccggggctcccggtagcctgccggtttactggcggtaaggtgctagactgtaagcccgaccagggccgggcttttggttttgttttctgatgtgtttccagtatctagcacataatagaccctccataaatacttgttgaattcca

SEQ ID NO: 539661 - DNA, 662 bp, Homo sapiens
accccgacttcatttaccagctgtattcagaagagggccaagcgtgtttgactcaggaagaacctgctgggtcacaagcagcacgggtggggcaccctctccctttgatagaaactttgggacccaaatctctgcccgagctatggagtggatccctgccaaactcacaggaggccccgggcagaggaaaaaaatttaccccccgatgattccatttgtgtgctgggaataagccaaagaaacgttatttttcaacctgtggcagagctgaagaagccaacggattttgagcaccacggattccccaaggacccgtggtggctccagctacggcccctcatggaaatcctggcccagtacaaggccacgctatgacgctgtcggaactcacggccacgctgggacactgtgcacgccctggaggtgtctgagcccacgtcccgcctgcatgtgcctgcagcccccgtggagctgtctctttttgtaacaccttaagttaattttatcagcagctttaatgcaccgtattattgacattaatacctaatcggcgagtgcccatctgccccaccagccccagtgcgtgctgtctgtggagtgtgtctcatgctttcagatgtgcatatgagcagaattaattaaacatttgcctacaactccca

SEQ ID NO: 539662 - DNA, 885 bp, Homo sapiens
ccttcgctgtggggtcccccgccggcgggtttttccggcccccattcccactcggggtccccaatttcttgatatgtctcctcgctattttccaacccccgacgctccctctctggttgagcgctgaacggtattttccggtaaagggtcgggggtcggccgatttgttcctctgtcggaggggtcgcccgcgcggagcatgtgtcgaggccctctcacagggcaccttgggtacgcatcttccggggcccctccccggcgcccatcaggcgccgcttctggtctgcccccgaacgcccgagcagttcctcttctcttctttgggaaatcatattcaggaacataaatcttctccggaatttctggccccctcccggtgttccaccaaagggaactcctttaccacatattgccgcttgttctctctctgggtagccgagtctccaccaatttgatggcgacttttctttcttagggagcgagtcttgtcgtctcccactgctcactcccacacgaggggttggttttatataatgatatctcttatgtcatacgatcgggccggcgtccaatatcagaaagcttagtgtacggtctctctcaatttgtcgtgccaaccttacgaaagtctatatttttctattttcctcctcccttatcgattacttctatatcttcttaatatttctcacgccccccccacatttatcagctatttttccaccaaagcccactgactctaagaagtccccttctaatatttcctgaggcgcagccatccaaggtgtttctgaactaccacatgaacttgtctcccaccaccctcttgaaattttcccccccttaactaccacggcttccccgaccaactttgaccacaaaaca

SEQ ID NO: 539663 - DNA, 856 bp, Homo sapiens
aacagtcccctggccccaacccgtcgtgtactctaccatctttgagggcacactcgtcaaagcggctaagctcgctactgatcttctttagcctgagtaggggcactagaaaataacacactgcgatgagcattgtttatttccaggtagcgtagaacctagatgaataatttgagatccactcggtttccgacagtaaagctgtacatcgagagtaatgtgtctctcgacgtcaagcgaagccgtcatccgatagatcctatgcataaataggcgtattcggcatcgtatcaggaaatgatatctctgcgcgggataagtgaactcggaatagagcacagatagctaaccgaaatgcaattatctcattcgatgtaagtaatctagtaattggactatagacaattgaaactaggagatagcccagctgttcacttctgaggtcaccagagggtgaccccagaggtacccccactctgactgtccggcgtatgctacatctcgtctacatggacataagaaactaagaccgcccgattctgctagaatcatatagccgataagtgctctgccgcatcatctaaacgtagagcacttacttcgcaactgctctcaaatcttaatcccatcatagcaggacaaggttgagcgtgggaggtgtaccgaaaacccgagcatgacgcaacagcattcttagcataactgcctcagattaacccgagattgggatgacgtatctggaggtcatccaggaaaagcgtaaataacaattttaattggatatggtatatcctaaatagtaccggatctagattgaacttaaaccaaggccaagaccaaatttggccctaaaatg

SEQ ID NO: 539664 - DNA, 1537 bp, Homo sapiens
  misc_feature (1537)..(1537): n is a, c, g, or t
gtagtatatccaaagacaatcatcattccccctaaataaattaaaaaataactattaaacccgatataacctccctccaatagaattcagaataataacacacccgaccacgaccgcataacaatcaatactaaacccctcataaataggagaaggcttagaatggaaaagcccataaaccccattactaaacccactactcgaacaggaaacaaagcgatacgattcattgattctccgcactggcataaatacacaaagaacagagagaaaacacaaaagaaaaaacaagaagaagaagagaacaagcaagataacatccataagaagacaataatcacacaacaataccaacataaagagtacaccaagaaaagacaagaatagaaagagaacaccaaaagatatagagcgggttcgacgccgtccagcaaggtcgcaactatagccctcgtgttaccgcataaaatccaacttaatcagagcgaggggggcagcgagccacgtcaaactcggagcgagagagtactcgacacacaaggtagcgacggaaaccacaacccaaccgggccagatagacacaagcatggcacaacggacaacgcaaggatgcacatagatcgacgcaagattccttttaacccaatgggataaaataaaaaccaaaaacggctgtcgctgctcacatacgcaacatggaacgttcgccgttgcaatttctagtacccctagcgcaacaatcgaacagagaaacagtcgaacaagcgtcaggcatagatgaacgagcatgccattaagccagtagcaggccctccaaccgaccagcacagtaacattagccacaacatacgcatccagctactatgttgacacctattaaaacccaaatacaacccagacacgcatctgtccggagagcagtcggggcgacgagtcacaacaaggggacaattaaactacacggggcacaagagacagacgtaccaccacggaccctgttacgcaacccccagtgaaactcaacgtaaacaaagggcaaccaaaagtagcaaggacacacgggaccgaaagggatcagcaagcagtacccacaatacacggcgcaaaagtggaaaagtaaccgaggcaaatgagtgacgacactataggatgacccaacagacaggcaaaacgagacaaaagaacccatatagagaacaactccagaggcacaaacacaacaacagaccaacaagacacacgcacaaccagacacaaaagcaaacacaacaacaaagtaagcagtgcgcgacgagcacggtcgaccacacccaccagaaagcaaacacagcgctacacgaaccaaacacagcaccacgacagaaggcgcagacggaggcgagacgacgcacagcaaaggcagtcacagagcgaagaaaatagagcggtacaccagcagtagaagagacaccagaagcggagagaaaaccccgacggagcacgaaagagaacacactcaaagcgagtaagagcacagtaaacaacagacaaccaccgn

SEQ ID NO: 539665 - DNA, 905 bp, Homo sapiens
attgcttgaacccaggaggcagaggttgcagtgagctgagattgcaccactgcactccagcctgggtaacagagtgagactcttgtctcaaaaaaaaaaaaaaaaaaaatctaagaataaaggttgggccaacagggcttaataataaataaaaacctcctgccattctaatttccctggtgaccccaatcccccgagaaacccccctcagcgaactttgggttgtaagggcgggttatttaccccgggttttaaggatgggtcccccttgggcttttggtcatttccagggcacggggtttccagggaagaacgcaaccaggttgctgtggcgaacagaatcggggtacgcactggtggaagcgttggccccagggcctggtgtacaccgcaaatacggtgggtgacggccagtgggggtctctcgcgacagcggcctcccttccccggccaccattttcagggcccaaccaattttaagggtggctgacgtggtaagggctcctccatggtcagtacgagggctcgcccttggtagcccggattcactaccagtacccctttccaaagacaaccgtgaggtattttggaagtgccttggccttcccctttgtgtccaatgaaacattgaagagagtggttaatggtctctggagttcctctgagcagagtgtcgtgaatctctgtggaggacgttaccccatttcttcatgagccatttttctacattcctaagaatgacccgtgttttaatcctttgtggaagaccattttctgccttcttattttccctggtgtgtccaagaaacgaaattccggggaaaaaggggcggggtttaaagcattcctctttccacaacagattgtttgtcggaatttccttgggccccaaaactggagcttaa

SEQ ID NO: 539666 - DNA, 588 bp, Homo sapiens
  misc_feature (23)..(23): n is a, c, g, or t
  misc_feature (62)..(62): n is a, c, g, or t
  misc_feature (74)..(74): n is a, c, g, or t
  misc_feature (78)..(78): n is a, c, g, or t
  misc_feature (90)..(90): n is a, c, g, or t
  misc_feature (99)..(99): n is a, c, g, or t
  misc_feature (118)..(118): n is a, c, g, or t
  misc_feature (120)..(120): n is a, c, g, or t
  misc_feature (146)..(146): n is a, c, g, or t
  misc_feature (180)..(180): n is a, c, g, or t
  misc_feature (213)..(213): n is a, c, g, or t
  misc_feature (231)..(231): n is a, c, g, or t
  misc_feature (256)..(256): n is a, c, g, or t
  misc_feature (269)..(269): n is a, c, g, or t
  misc_feature (273)..(273): n is a, c, g, or t
  misc_feature (275)..(275): n is a, c, g, or t
  misc_feature (291)..(291): n is a, c, g, or t
  misc_feature (309)..(309): n is a, c, g, or t
  misc_feature (316)..(316): n is a, c, g, or t
  misc_feature (326)..(326): n is a, c, g, or t
  misc_feature (330)..(330): n is a, c, g, or t
  misc_feature (346)..(347): n is a, c, g, or t
  misc_feature (352)..(352): n is a, c, g, or t
  misc_feature (359)..(359): n is a, c, g, or t
  misc_feature (361)..(361): n is a, c, g, or t
  misc_feature (369)..(369): n is a, c, g, or t
  misc_feature (371)..(372): n is a, c, g, or t
  misc_feature (377)..(377): n is a, c, g, or t
  misc_feature (379)..(379): n is a, c, g, or t
  misc_feature (386)..(387): n is a, c, g, or t
  misc_feature (390)..(390): n is a, c, g, or t
  misc_feature (393)..(393): n is a, c, g, or t
  misc_feature (421)..(421): n is a, c, g, or t
  misc_feature (428)..(428): n is a, c, g, or t
  misc_feature (431)..(431): n is a, c, g, or t
  misc_feature (438)..(438): n is a, c, g, or t
  misc_feature (444)..(444): n is a, c, g, or t
  misc_feature (450)..(450): n is a, c, g, or t
  misc_feature (467)..(467): n is a, c, g, or t
  misc_feature (485)..(485): n is a, c, g, or t
  misc_feature (490)..(491): n is a, c, g, or t
  misc_feature (564)..(564): n is a, c, g, or t
agtacatagtggttagttttgcnataatttctttttagccagatgtcatatcatcatataantctatgaatatnacanatgacataagancagtataantcagtttttgtagtatttncncttacccagaaactagcccaaatggngtcctaagacattgtttacagttaacgtgaactncggattccccatcctgcccctccaatgcttttncccgtttcgtattatttnctatcctagttttggctatggtttngcatgggattccntatnangtctgagcctttcccntccccgtcggggcttttngtataancgtccaaccncccnggcccgggccggggcnnatccnccgcccncngcgttttncnnccccncnggcttcnnccnttnggggcccggggcccccttgccccccctngtttgcngcngggggtnttcccngggggnctcggggttcccatctncctcccgtagcctgcggnccccnncggggtatagggggcggggggggttttccggggggggggggcgttgggcgttggcgccgttggcggggggccnttgggcgggggcgtcggtcgcagg

SEQ ID NO: 539667 - DNA, 420 bp, Homo sapiens
  misc_feature (154)..(154): n is a, c, g, or t
  misc_feature (296)..(296): n is a, c, g, or t
ttatagatgataggatgttttatgtggtgtatgtattggggtagttcgagtaatgttggggtattttggataggtcgagaaagtgttgtgggaagaaagttagatttatgtggatgaatatgatagtgaaatggattttggtgtaggtttggtntagggtgtagcttgagaataggggaaatcagtgaatgaaagcttcttatgatggtaaatacagttcttattgataggacatagtggaagtgagctataatgtagtatgtgttgtgtagtatgatgtctagtgatgagtttgntaatacaatgccagtcaggccacttacggtgaaaagaaagatgaatcctagctgactcgccacactccacggaagcaatatgaaatgatctgctgcagtgctctgagccctaggatgtcgacgc

SEQ ID NO: 539668 - DNA, 359 bp, Homo sapiens
  misc_feature (5)..(5): n is a, c, g, or t
  misc_feature (41)..(41): n is a, c, g, or t
  misc_feature (283)..(284): n is a, c, g, or t
  misc_feature (307)..(307): n is a, c, g, or t
acggncagtgcgttcacgatagacccagaaatagacgccgncaacaatccacataatggacataaaaaacggccagaagaaaacgaacctcatcatcagttcaccagagtgaaagtacgctacgcataggggtatgcataacaccgacataatataaaaaacgatacgatgcgattaatcatttttcggataccaggctgttgaaaactcaggacgaataaggtctatttcaggttggttatgcagaaaattgtcgggataataaccatagtttttcactccnntcagttgtaataggctcatccantgagcgagttgttgcgaagaaatagcctcctgctgaccatttttctcccact

SEQ ID NO: 539669 - DNA, 439 bp, Homo sapiens
  misc_feature (1)..(1): n is a, c, g, or t
  misc_feature (57)..(57): n is a, c, g, or t
  misc_feature (103)..(103): n is a, c, g, or t
  misc_feature (266)..(266): n is a, c, g, or t
naaaacttaagcccaatgaacaccaaaggagatgagagaggggattgtgagtaagtngagtaaacccatttgggaatctggtgaaatggatgacccaggtgtncagcagcagagtcatcgcagggcatcagtagcacagctgtggtgcatgtgcccctgtgaacattaaccataacagggctatacatctgccagcagctgaggctagacagccaacttggactttatgggccattcctctacaggctcaccactcatcccatggncaaggcagctttcccttctgtgttttctgtgtcctcagcctccacctttctgccacccacatggacaaggacaatgggaacatgtaaggccgcataccctgaccagccactgattttcactgttgtgaaagtgatttgacttagaattaaatggttttacattaaaaaaaaaa

SEQ ID NO: 539670 - DNA, 161 bp, Homo sapiens
gtgggcggacgcgtgggcgcggagacgacagacaccagcactgccgacacacatggacgaggagcatgctgcacagcttccttttaccaggttcttgtgttttgtggggcttgggttttggtaacttatttttataagcaataaaccttttgtatcctgga

SEQ ID NO: 539671 - DNA, 191 bp, Homo sapiens
gagagtctgagagtggggggaaaattttaaaaagataccttcatggtgtcaaggagtgtgccattctattttggtatcagcatgggaagtgcactttccctgtggggcgtgtgggtgtgtgaatgtgcaagtgtctgagggtctgggcggtgggtggttggttctgtgcatttctggttgcaccggggcgc

SEQ ID NO: 539672 - DNA, 591 bp, Homo sapiens
tagttaactatccaacttaataaggtgggattacttcaaaggaaagagtatcgtgcacgctgcgtgtaagggggctaccaagtatgctgaacctttggagcaggcaacatgcaatattctggtgccagcaagaaccaaaccgctgctcaaggggacacactggagtagtttgctgaagggaggtcccggcataccgcatggaaggtggaatatcctcgagggaccaatatacaccagttattaaaacaggcttaacggtgcaatagggtactggcggatgtattaatgttggggcaacacataaccttgggttgaggaacaaacatatctgctgctcacaggcacataagctgaatgcagtgttgttagaccttcattcagatgcttcatttaagcattaaaaagtgcgatcctctgacctaaaatatctttatgtacgccctgcgcatttggagggcaaaaacaaaatgtacccggtatttactggctacagtgttgatcgaaccaatcgtaggaacagccaactggagccggattgctgcaccacggttgaagcagttggtctcggaggggcgccaccgctatcgatcc

SEQ ID NO: 539673 - DNA, 999 bp, Homo sapiens
cctcacttcccctcctcccccttcccctggtcacctgtccctgaaataaagaacagcttgacagaaaaaaaaaaaaaaaaaaaaagaaaaaataaaaaaaaaaaaaaaaaaaaaaaaaaaaaaaaaaaaaaccaaagaaaaaaaaaaaaaagaaaaaaacaaacaacaaaaaaaaaaaaaaaagaaacaaaataaaagcaaaaaagaacaaaagatagcgaagcaggaggtgtcacggaccatagaccaagacctggccatatggacgccagccaaacacatggacccggggcagaacagagcaggctgcgggcatacaagaccgagcagctgctgcatcaactaactggagcagagtaaagccaactgacaactgaccaacgcccgtgactaccttctcagaccgaccgatgataaacagcaaaccaagaccgaccacaagattctgttagagagcgccagacagcacacacattacgtcatccctcagcgcaccacgaagcagagagtgtaccactaccaccaggaacacaacatgtcaacagcgacaacgcaaaagcgtcgctgaagcacgcagacaaccaggcagacacaactacaagcacgccaatgcaatgatgaaaacacatacatgggcggactagtagggccaaaacacccaaggacgctgccatagcaaggaaccacaatcgacatatccgagagcgcaagacaaatgcgagacgagggacaaagaagatgagaacatgaccacaaccagtaccagaggatcaagcacagaagcgcgacagcgtaaacacggaacaccaggagggaaagacagaagcataagagcagcaaacaagctacgcgcagagacgagaagaagacaaagacagacccgaaagatcaatgacacatcgacacaaaggaaaagaaacaggagaggaaagaaacaaggaaagacagaggacacagaccaccgcagcgcaaggagcagaccgagaccagacaggacgg

SEQ ID NO: 539674 - DNA, 396 bp, Homo sapiens
cgtcgacctttgcgtgagtctatagaatggatagagagaacactttctcagcctcccattacagtcagtgcctgaagtgtactttgcatctagatagtgttgttgctctgaaaagagcagacaatcttgaaatcaatccacttgcaagtctaatgtcctacaggagtaatttagcaaagaaaatagcaaagatggcaaagtcccccgcaaactgcctccatggtaggataatcccagctgtttgcttcctgtttattcctaagggttgctagttaaatgagagctgttttatttttttctgctgcccacatacaggagccattgtgagttagtgtgatgaatgtattagatttgcatggaaatgtcgacgcggccgcgaatttagtagtagtaggc

SEQ ID NO: 539675 - DNA, 120 bp, Homo sapiens
cgttcacggggactctccttgggcccttgcctgtgtattttgccagatgcttggtgctgcatatgtctcccggaagagaggggcttacaccttctctggtaagcctgtggcttgggtcta

SEQ ID NO: 539676 - DNA, 656 bp, Homo sapiens
aagttgatagacagatcatcataaactcactttcggtccaaatgtcatcttacgactctagcagcagagctggctcttcaccaatggttctactggcattacagaggggcaaagggcagctggcactgagctgaacaccgcataaggcaagattctcaaactgcagaagccaccaggagaacggaaccaatacagttttgtctacgtggttatggtgagagcagactcagtggcagagatgaagatacaggacagctagtccaaagaagtgaaagtccacaatctctgatcggtgagatcggggctaggggaacagtcctttaattctgaatagtcattcgtatctcctgtctgacatggatacaatatgcagtgctagcctgtattttcctatttgaatatcccacataaattactacagataggataaaaaagacacatatctatttaaatgacttcctagtttccattccaaaagcagaagatatgtacttaagcagcacatgctacagtgtcttctctttcaaactatctgttcctagcctctagggattttgtcttgttatgcttcattccactgcctaagaaactaagattttgccagcaagagggccaatatgacaaatcatcgatgattcttagcatggagccaagaa

SEQ ID NO: 539677 - DNA, 325 bp, Homo sapiens
  misc_feature (37)..(37): n is a, c, g, or t
  misc_feature (40)..(43): n is a, c, g, or t
  misc_feature (46)..(46): n is a, c, g, or t
  misc_feature (50)..(51): n is a, c, g, or t
  misc_feature (61)..(61): n is a, c, g, or t
  misc_feature (63)..(63): n is a, c, g, or t
  misc_feature (84)..(84): n is a, c, g, or t
  misc_feature (133)..(133): n is a, c, g, or t
tgcgtaagctggtgaagctgcgacattgcccgctgcnacnnnntancagnncgtggctgcngntgatgatggatcgcagctggnatgctcggcatgcggcgctgatggatcgttatggtcaccaggcgatggncggcatgagcatgaatcatggcgcgatgggcggtggagacatgaaaggtatggaccacggcaacatgaaaggcatggaaaagggcggcatgcagggcatggaccatggcaacatgaagggcatggatcatggcaagatggccgggatggatcacggtggcgcgcagggtaaagccaaaccgttcgatttcag

SEQ ID NO: 539678 - DNA, 169 bp, Homo sapiens
gctgcggtactctagagttaccatctaaaacactcttcacgccggctctattggctgggttatcgtgtgcacgcggggctggcacgaaattgacaaccctggggttagtatagcttagttaaactttcgtttattgctaaaggttaatcactcgccaatgagcagattt

SEQ ID NO: 539679 - DNA, 155 bp, Homo sapiens
ggaacacacagataccgccagtgagacgagaaaggagacacgacagaccgaccccgagagacacacacccgcccggaaaccacacgaacacatagggaaccggaactcggccccgcggaccaaccccggggtcccactccggcgtggtacgcgag

SEQ ID NO: 539680 - DNA, 1126 bp, Homo sapiens
gccgacgcatgagtggcaggcccttcagccaggcaggctgtccctgcaggatcccacgtacggctgaatcttcagactggggaaagagaggcaaaactccaatcatgaggcacacagttccgcacacataatttgaaacggccccacaggctgtgcatatctaactacccaacacctcacacatctccaggatctcgaagcagtgcactggccacaatattcacaggcagggggcagagcatggcagagttcaaaggaagacccaggcccacggccaggcctgaggtaaagcggctcttccgccccacttcgacggaactgaacgaaagacttcgactgacgctgaagtgttcgtcattgacgactgaccatgcacgactcactggtatcggctgatcacacaaagcttccactagctcccacgctccacgcttctggacacgacgaagattcgcctgcgcatcatattgatctttgacactcattatgctcccatcgagcatggcaccaactgccgcagcgacctgcgtttccttcggcgctggctccttcacagtgcgtgactctacttgcgcgctgaacagccgacacgagcccctcgctgcaacggagtatgcctgccgtcagtgcctgcggccgctgcccttcttcccagcatacccccatatggctccacggctgcgcagcgccctcagacacgccggagccctgcaacaaacccagctgcaaacattcactgacacaccggcaggcatgcccggcctcaacgtcggccaccggacacgaccggtccctcggtctcgccctggtgctctccttgtcttgtcgcccctctgccccctactgcccctgtcgggcacgttctctgtaccgctcgcgcgctgcctgccggtcctggccggacccctggccttcgccacgggactcaacgggccacctgggtctggttgcttccgcccgtcggtctccggtgcctcccccctggttccgagcgaccctgggttcccttggacgccgccttcgttcgcctcacggagcgcggcttgctccttgggcgccaggttgattggctacgcggagcgtatcctcgccccctccatctcctcccggcgtgccccttctcgcc

SEQ ID NO: 539681 - DNA, 169 bp, Homo sapiens
atctgccagcttgactgtgggttcatgaccagcttcctaatgacctgggagccatgggaacgtgggcatctccaccagagctgctgggcacaggtttctcgaccgtgtgtgggcgcacagggcggctttcctttttactccgaccgatgcttctaaggaagtcttcgac

SEQ ID NO: 539682 - DNA, 279 bp, Homo sapiens
agtaagctgacgggcgtggtagatcagagcgtcgtgctggtgctgattcagtagcagacgtattcttgggcatcaggcatcacagtcacgggagctgcgctggtgaaaggcagtcggtggtgacgacatactcaaacttggcgtgggtgctcgaaggtatcgccaggtcgtcatcgtgattggcgtgcgggtcgaagtagtccagtggcttggtcatctatcaggtaggtatctggcgtagacaacgcccgagaactcctcgccctggtacgcaggtag

SEQ ID NO: 539683 - DNA, 109 bp, Homo sapiens
cggactccccaagagacgtgtaactcaagaccgtaggacctttaatcgtgaacaaacgaacctttaatagcggctgcaccatcgggatgtcctacggtcgtgatggaca

SEQ ID NO: 539684 - DNA, 88 bp, Homo sapiens
  misc_feature (73)..(74): n is a, c, g, or t
gtcagctaatagcgtacttggggatgaggagcaaggaatattaccagatattaccctagatgttaataaaggnnatgttcaaaaaaaa

SEQ ID NO: 539685 - DNA, 186 bp, Homo sapiens
  misc_feature (122)..(123): n is a, c, g, or t
gcctcgtcctgggcggcggtggtgcggcggtcgccgttatggccactggtgctgggcggctgaccgccgggctaggaaagggcccaggccccgaatctcggtgtgccgctgctccagcgcgnnctgcgccatggcctcctccgccgcctcctcggagcatttcgagaagctgcacgagatcttcct

SEQ ID NO: 539686 - DNA, 402 bp, Homo sapiens
aaacacgaatctgctggcggatgataccgcgctacgtgcactcatcccacaacgggctgatcgctttccgatgaacgcggtacgtagcacgttgaaagaggaggaaaaactggtcaactccagcgactggggctacggacgctcaggcctttgcccgctggcgaccggagtacggttattttgccaaacaggcggggtttaccgttaaaacgtccgccagccttgctgctttatggcaggtagtgaaccaaatcggcggtaaagagcgttatttctttggcaatattttgtggcagacacgggcgttgatggaccgcgcgatcggtcataagctggcgaaaggccgcccggagcgcgaatatttacagactggcgatgcggtggatagctggaaagtgattg

SEQ ID NO: 539687 - DNA, 1328 bp, Homo sapiens
gaattgtcatcaagcccattgacaaaaaagccccggacttcgtcttctatgctccccggctgcggattaacaagcggatcttggccttgtgcatggggaaccatgaactatacatgcgcctgtcgccaagcctgtatacccatgtgaggtgccagccagatgcacaggcacaggcccgggcaggagaagcaccagacagcagatggcagcgtgcatatgctggcaaacatgagcaagaagaagccgtgcaacatggcgagcagcaaggagacaagcagaaagacttgaccctggcgacgacacgcgacggaagctcgactcgcgacgacgtgctggacacgtccacaattcagagcggaccgcaggaccctagacgaaatgcgactccacgggaacagaagacggtgagaaaacgacaacagcacccgccggtaggaggcctgcatgcgcgacactaatggacgccacggcaaccccgcgacaacaagcagcatggcgcgcgaaaagcacgcagaggacagggcacttggcaaaaatagcctctcgcggccgagatccgggcaacagccgttgcaaaaccagaacaagcattggaccatgaacgaagcaccatacaagaggaaagcgcaccagtcctggccttgggcacacgcacgaccaatacgacccggcgggacacacacccacgggccacaaccaacagaaacattgtcacaagaggacaaccacaaagacattaggtgccactttggaagacaacaaattgggaacgaagaaacgaccatggaatcgcacgacgacatccggaagacgtcccgtacacaccacaagagacatgagataaacgcacaattgaggacacacaacgagaacactacgaacacagaaaaccgtgggaaagaacgaatcgaaacgagcaactagaacagagaaagagtgaggagacacaaagcacaacgcgcaactgagggcaacgcacaacaataccactgggggatacacaaacaagcgtaaaacatgcaccgagtacgagcagacagcgaaacaacggtcaccgacacatgaacagaacatgagaaaggacaccatgagacacggtagaagtgtcgcgcgcgcgcataggaacgactatgatacaaacccacatgacgccacacgcatggaggcgaaagagacacagccagtccgacaaaggagacaggcacacaagtgagaggagaacgcggaaagtgacacagcgaagaagagaacatccgcacaaccacaatacgacagaccacacactacacaggccaccacaagccgagcacacagcaaccaataataac

SEQ ID NO: 539688 - DNA, 82 bp, Homo sapiens
catgccatttcaccaaggttaaggatttaacgaggcgatctggaggtttcataaacatttgactggaataaaaaaaaacaaa

SEQ ID NO: 539689 - DNA, 159 bp, Homo sapiens
tatggatggggtctgaatccatggaatcatgtgactgtagccacctgcatgcccactttcccttttccagaccatgctgtgggactctagaataccctatcccaaactgccaatgcctgactccattggtctgcacaattcctctatcccaatgttgcg

SEQ ID NO: 539690 - DNA, 350 bp, Homo sapiens
  misc_feature (9)..(9): n is a, c, g, or t
  misc_feature (115)..(115): n is a, c, g, or t
  misc_feature (175)..(175): n is a, c, g, or t
aaagaaggngaaaaataggcaaggtcctggccttaaactggatggacattcccacccattggtgatttggtcctggccccacccctaactggatcaattgaccttgtgacaatanaccttcccccacccttgagaaggtgctttgtaatattctccccacccaccccacgcccgnacccccggacccttaagaaggtattttgtaatattctctccgccattgagaatgtgctttgtaagatccaccccctgcccacaaaaaattgctcctaactccaccgcctatcccaaacctacaagaactaatgataatcccaccaccctttgctgactctttttggactcagccc

SEQ ID NO: 539691 - DNA, 81 bp, Homo sapiens
  misc_feature (1)..(1): n is a, c, g, or t
ntctcaggtgactggggacttggaacccctaggacctgaacaaccaagactttaaataaattttaaaatgcaaaaactcgg

SEQ ID NO: 539692 - DNA, 218 bp, Homo sapiens
  misc_feature (47)..(47): n is a, c, g, or t
ggggccgctcagggagaagaggtgctttcccactcatcttacctgtnaatactatatgcagtgggtgtcatacggagaatgacttttagtatggaaaacaaaaccagtcggcttatcaaataaatgtgattttttttttttttttttttttttttttttttttttttttttttttttttttttttttttttttttttttttttttttttttttttttt

SEQ ID NO: 539693 - DNA, 127 bp, Homo sapiens
tctggcagcgactgggaatgcctcccactaactggcgtcctctggaattagaaggtgtatagtgacaattgttgagtttgcaagctatttgcatttacgcacagagaagaaacccctttatccctta

SEQ ID NO: 539694 - DNA, 135 bp, Homo sapiens
ggggaaaagggatttccctatgtggccccgggggtttttgaacaacaacccccaagggattttcctgacccccccccctaaaggggggggattaaaggggggaccccccgccccgggcccgtttttgtttttcca

SEQ ID NO: 539695 - DNA, 424 bp, Homo sapiens
tctcatatagcaaatatcgtatacaatataacaaaaataacaacttcaccttacacattcctttttatatacttttcttttctttatcttttgatttaagacagagattcactctatataggccaagggctagagtgtaatggcatgatctcacctcactgcaacctcagcctcccacgttcaagtgattctcctcaaccttcaaagtagctgggattacaggcatcagccaccacgcccagctgattttcgtacttataagtagaggcagggtttcaccatgtcggtcagtctggtctagaactcctgacctcaggtgatccacccgcctcagcctcccaaaatgtcgggattacaggcatgagccaccgtgcccggcctacacattcatttcttatgcgtgcgtctttttcctccaaactat

SEQ ID NO: 539696 - DNA, 384 bp, Homo sapiens
accagggaagaccattatcacaggcagcttctgcatccagagtcacattgtcagtgtggtactagaatccccagtcaagaaattatattaatataaaaactgagatgggcgcagtggctcccccctgtaatcccagccctttgggaggctggggcgggtggattgccttaagtcaggagttcgagaccagcctggccaacatagtgaaaccgcatctcttctaaaaatacaaagaattagctgggcatggtggtgcccccctgtaatcccagctactaggaaggcggaggcaaaaaaatcgcttaatcccgggaggcggaggttgcagtgagctcagatccccccatagccctccagcctgggcaagagcgaggctctgtctca

SEQ ID NO: 539697 - DNA, 419 bp, Homo sapiens
  misc_feature (9)..(9): n is a, c, g, or t
  misc_feature (34)..(34): n is a, c, g, or t
  misc_feature (75)..(75): n is a, c, g, or t
  misc_feature (95)..(95): n is a, c, g, or t
  misc_feature (105)..(105): n is a, c, g, or t
  misc_feature (209)..(209): n is a, c, g, or t
  misc_feature (247)..(247): n is a, c, g, or t
  misc_feature (285)..(285): n is a, c, g, or t
  misc_feature (296)..(296): n is a, c, g, or t
  misc_feature (305)..(305): n is a, c, g, or t
  misc_feature (315)..(315): n is a, c, g, or t
  misc_feature (323)..(323): n is a, c, g, or t
  misc_feature (385)..(385): n is a, c, g, or t
aagttcggnaccgacggctgcagtttcacccccnaatttcaagtattgtgactttgtttgggccaaatgttggtnatcataggaccgatgataanacgttttcantttctttaaaatagagatggggtggctgggcgtggtgacttcgcctgtcttcccagcactttgggaggccgaggtgggtggatcatgaggtccaggagcttganagccagcctgacccaacatggtgaaatcccatctctanctaaaaatacaaaacttagctgggtgtgatggacaggncgcctgtagtncccagttanctcgggaggnctacaggncaggagaactgcttgaagccgggagacagaggttgcagtgagctgagatcacgccattgctnctccagtctgggcaacaagggatgctccgtctca

SEQ ID NO: 539698 - DNA, 132 bp, Homo sapiens
ccagtagtttgtgatgtgtccatcacatactactggacccatcacaaactagctgggcccatcacaaactactggagcccctcccctctacttgtcccatcacaaactactgggcccctcacaaactactgg

SEQ ID NO: 539699 - DNA, 102 bp, Homo sapiens
ctccacacagcactaggatagtcagtagaattagaattgtgaagataataagatgtaagcgggaaggttaataggttgaatattgctagaggatggcgctat

SEQ ID NO: 539700 - DNA, 707 bp, Homo sapiens
  misc_feature (22)..(22): n is a, c, g, or t
  misc_feature (62)..(62): n is a, c, g, or t
  misc_feature (66)..(66): n is a, c, g, or t
  misc_feature (72)..(72): n is a, c, g, or t
  misc_feature (74)..(74): n is a, c, g, or t
  misc_feature (77)..(79): n is a, c, g, or t
  misc_feature (86)..(86): n is a, c, g, or t
  misc_feature (103)..(103): n is a, c, g, or t
  misc_feature (105)..(105): n is a, c, g, or t
  misc_feature (113)..(113): n is a, c, g, or t
  misc_feature (126)..(126): n is a, c, g, or t
  misc_feature (128)..(128): n is a, c, g, or t
  misc_feature (137)..(139): n is a, c, g, or t
  misc_feature (146)..(146): n is a, c, g, or t
  misc_feature (152)..(152): n is a, c, g, or t
  misc_feature (172)..(172): n is a, c, g, or t
  misc_feature (182)..(182): n is a, c, g, or t
  misc_feature (184)..(184): n is a, c, g, or t
  misc_feature (188)..(188): n is a, c, g, or t
  misc_feature (699)..(699): n is a, c, g, or t
attattatagaatatataaaanaactataaagttcataaccacactctacatcatgatcganggtntaactnanaannntcaaaanaaaagaaatagcttgtnanattcttanaatattctaaaantnttcgatagnnnggttgtnatattngccaactttctttataagtncgtgggattnanatgnacatacatgtttttgctaagagcacatacatttcattctcctcactttgttcataacctcagcattgtcagataccctcagtgagttaactcaaagccttttattatggaaagaactggcacagttacatttgccagtggcaacatccttaaaaattaataactgataggtcacggacagatttttgacctagttccttcttcttttagagcaaaaagaacttttacctcggcatccagcccaacccctaaagactgacaatatccttcaagctcctttgaaagcaccctaaacagccatttccattttgatagttggatgcggattgtacccttcaatctgaaagtcttcagctttgaagtcatcaattttctcaacttttcgaagaatcctgagctttgggaaaggtctgggttctcgctgaagctgaattttcagtggctcgatgtgattcaggtaaatatgtgcatctcccaaagtgtgtataaagtcacctggcttcaggcccgtnatgtgcgc

SEQ ID NO: 539701 - DNA, 170 bp, Homo sapiens
  misc_feature (19)..(19): n is a, c, g, or t
  misc_feature (25)..(25): n is a, c, g, or t
  misc_feature (45)..(45): n is a, c, g, or t
  misc_feature (73)..(73): n is a, c, g, or t
  misc_feature (83)..(83): n is a, c, g, or t
ctaaatatgggcataattnaatggnccgtgctggacaggcccctnttgtcccaagctactcgggaggctgagncgggagaatncgcttgaacccaggaggtggaggttgcagtgagccgagatcacgccactgcaccccagccctgggtgacacagtgagactctatctc

SEQ ID NO: 539702 - DNA, 102 bp, Homo sapiens
ctgcttgtctgctctgtaaccaggacttttcgaagctgagacctgacatttccagactcttgcaaatgctaaagcaaaggggtggtgaatggacagtttttg

SEQ ID NO: 539703 - DNA, 860 bp, Homo sapiens
  misc_feature (264)..(264): n is a, c, g, or t
  misc_feature (458)..(458): n is a, c, g, or t
  misc_feature (490)..(490): n is a, c, g, or t
  misc_feature (651)..(651): n is a, c, g, or t
  misc_feature (654)..(655): n is a, c, g, or t
  misc_feature (657)..(657): n is a, c, g, or t
  misc_feature (661)..(661): n is a, c, g, or t
  misc_feature (698)..(698): n is a, c, g, or t
  misc_feature (701)..(701): n is a, c, g, or t
  misc_feature (708)..(708): n is a, c, g, or t
  misc_feature (749)..(750): n is a, c, g, or t
  misc_feature (757)..(757): n is a, c, g, or t
  misc_feature (760)..(760): n is a, c, g, or t
ggaagtgcaagtgccacggcacgtcaggcagctgccagctcaagacgtgctggcaggtgacgcccgagttccgcaccgtgggggcgctgctgcgcagccgcttccacctgctgccactgctcatccggcctgcacaacctgcaactggctggccatgctggatgcctgggcccatgcgtgggtgcacccttctgcctggcttccgggctgctccctgggcctgcgcctgactggtgccatgccccctgcctgacctggtctacnttcgaaaagtctccctgacttctgcgagcgcgatgccgcgccttggactctggcgggcaccgttgggccgccttgtgcaacaagatgcagcgccggctcggatggctgcggcagcatgtgctgcggccgcggccacaacatcctgcgccagacgcgcagcgagcgctgccactgccgcttccactggtgctgtntcgtggtctgcgaagagtgccgcatcaccgantgggtcagcgtctgcaagtgagcggccggggtcccctgggccctgatcgaggtcccctcctggagcctggccctctgaggcttacggtcttggcaaggcagcatcgccttggctcttgggaagaggagattggaccacatgatcttataggaacccctcanttnngnggtntgtgatcgccggacagtccaggcttgtctgaacccancantcacttnttgtgggctctaggactgactggggttcttcctccctcccnnaagccanacnagttcagttgggtgggggggggggtttgctccacacccttaaaacaaagccttagcccagcaacccccgggtgagttttgtctccctcctttttaccctt

SEQ ID NO: 539704 - DNA, 986 bp, Homo sapiens
tgcacatacttgatcgtagttattcgtgggcgggagcgtgtatgatggctagggtgagcgctgagtgctccttattcgcagcagaggtagggccggcagggcaactgctaggtgacgagcacagtctaccagcgttatcgtcacattgccgcgatgcattgtgtagtagaatctaacttctatcaggtaactaccaccatacaagtgaatccggcacggcgtctggggcaaatttggactaggtagcgcacgttaatagagtcggtggcgccctgcaattataggcagtgttgcgccggcgatcaaaccagagccatatacgcttggcgtgatctcgtataccgtccggtcatcatcgcttacatccgtgcttcgctgtcggcctatagtggcgagggccgggagcgaggatacccggttcgaacagtcataccttcccctttagcgagggcaacttaggtccccacaccgtgggagcagtccgtagagctaacagatctttgctccctgacaacctaggcaggatggtgtcacctcgtatcttgtcagcgggccgagacaaagtttcaatccagcaaaggaaataatgcaactatataaatcccccgtggcataagcccgaatatcaaaaggcccccgtctttcggtctcggatcctgctccctgtagtccacaggcagctgggtacttcgtgctatcggtcccagtccgtaggctgctggcatcactatagttatgtaagcagacgcagaaaaccttaaagcaccaccgtgtgcttctgaggcccgccggagggaggagacccattctatacaaaaactattctgagtgtgcggtcaacatgaaggtttatattggttatcctaccaggttcggcataatttcccatatatggagagtaactaatccggaaaaaagaaacctttgcgtccgctcggtttggcatgagcttgaaattaaaaaggttcaagggttatcctgggggc

SEQ ID NO: 539705 - DNA, 420 bp, Homo sapiens
gctcgacgcattggtggcagatgctatggtcccagctgctcaggaggctgagacaagagaattgcatgaacgcgagaggtgggggttgcagtgagccaagatcatgccactgcactttaaccctgttgaaagagcaagactcagccaggcgcggtactcacgcctgtaattccagcactttgggaggccaaggtgggcggatcacaaggtcatgaggtcgagaccatcttggccaacatggtgaaacctgtctctactaaaactacaaaaattagctgggcatggtggcgcgtgctgtagtcccagctattcgggaggctgaggccggagaatcgcatgaaacctgggaggcagaggttgcagtgagccgagatcgcgccactgaactccaacctgggtgacagagtgagactccatctc

SEQ ID NO: 539706 - DNA, 188 bp, Homo sapiens
gcaaaaagtcggcgactttcaccatatcatcataacttgaaggtaataaatcagaatcaccgttgccaccttgaaagcgggcgttcgagattccaagccgttttggccatgtcgtacaaaataaaatttagtccatattaaatcttttctagcaccccgcgtgccacaaggtcatcaacaaaaaaatt

SEQ ID NO: 539707 - DNA, 596 bp, Homo sapiens
  misc_feature (581)..(581): n is a, c, g, or t
attaagtaaataatttaatgatagaacactgaaatttggtccgacacagaagatcccatgttataatctttgtctgtggcacaaatatggctttacacttcccgttctctgaatgtaagcttacagaatgaataaatgaaaaatgttcttccacatctaagtttccggttctaatattccacttttctacattctttttatactcgaacaatatctagtttatatagtgaaggacggtctttattaagatttactggcaacaaggatgactgtcttttttaacaacacctgccttttgtctgggggctctgacagcaggacacttcctgtgcgaagacaggcccaacagtattttactgttagacaaggctattcagataagagcaccacttaaagttatttgccatttcagtgtcccgagaaatttgaacaaaataaatggttttctcttgaagaagcagcaaattgcataccaaacctaatttcttcctcagacttgagatattctgggatctactaaccagaggttctcagaagaatgttaaagttcatatccctgtgcctcagtggtttggctctgngaataccggagccat

SEQ ID NO: 539708 - DNA, 347 bp, Homo sapiens
  misc_feature (58)..(58): n is a, c, g, or t
agaggaccctgagtgcacgtacagatattacttatactggaggtagctcgtcatatanggcaaatttatgttgtcttttatttggaatataagggttttttagctcctggaatctatattatagtcctataattttattatgtttgggggtaagaaggggcacaacatattgggaacctaataaaattatcccgtatttttaatggttatttattaaattcctctccattaggagcccgttattaatggattggtatgtattttctggttataattttactggcatttattaaattctaatgacttaaattgtctggttttcatgagggcacacaggtgacactcaa

SEQ ID NO: 539709 - DNA, 248 bp, Homo sapiens
aactcatctccatcaagtacggcggaccctaccacattgggggcagccccttcaaggccaaagtcacaggcccccgtctcgtcagaaaccacagactccacgggacatcatcagtgttagtggggtctctgaccaaggacaactgtgcccaccagcatggggccccgggtcctgcgcctgctgacgccagcaaggtggtggccacaggcctgtggctgagcaaggcctacgtaggccagaagagcagc

SEQ ID NO: 539710 - DNA, 415 bp, Homo sapiens
caccaggcgcacttcttacctgcctccaggcagccatgcgctactgaggacggggatcacgctgggcaggagctccaggccccagcacagctcatgcccccaagggcaaaggctccccgtgcagcgcgtgcccctggagggtccactgcccgatgcatcccgcctgcagttggggactagaaattactgcttcttactgtaggcgaaaccagagctgccagtgctacatccagccagctcggccccagagtttcccttaccaggtcagcactggccccccggagccctggagattgggcacggcccccctgccccagctctcttggacgatcgtccggctccagccgctctgatcagagtgcccgctacccccaaatagctgcctcagtcctttcacagcctattctagagagaa

SEQ ID NO: 539711 - DNA, 357 bp, Homo sapiens
gcggacgcctactactactactaaattagaggccggtcgacataagtaaccagagacctttgcggcagcgctcccatctcaggcccggagctaggagggaaaaatggtttcatgggctgggtccagggccccctgctgtgtgcagccttgggacttggtgctctgcatcccagacgctccagcagtggctacaaggggccaaagtacagcttaggccattgcttcgtaggatgcaagacccaagccgtggcagcttccagttgatgttggtcctgcaggcgtgcagaagacaagaattgaggtttgggaacctctgcctagatttcggaggctgtatagaaatgcctggatgcgcca

SEQ ID NO: 539712 - DNA, 257 bp, Homo sapiens
tcgcggcagtagcatcatcatgagtatagagtgtagtgtggcccagtcctggagcacgaagtccaacttcacttggcttctgctgcaggatcagcctcttgatggagatgaggctataggacttggtgtctccaatcaccagccaccagccctcttcacgtctctgcgggaagagaggcgccatgacagggcctgtgacttcctcctctcgctccagctgcaccagcaccatcgctggcccgcccatttgcggatgc

SEQ ID NO: 539713 - DNA, 101 bp, Homo sapiens
agtctgaaagtgtgtttgacccctgtgcagatttaattatgtccctgccttgaaggcccagagggtggctatcgaaggcatcagtgctagagcaggtggga

SEQ ID NO: 539714 - DNA, 819 bp, Homo sapiens
attgatttcacatataattattatatgtagtctttgttaaattttttaaataatttgaatgttaccttgaagttctttggagtctatgtatattcatatcatctgcaaatagtggcaatttacttcatttccaaattttataacttttacttcattttcttaccttactttctgcatagtgactttagcactatattgaataaaagtggtggtgctgggggcatggtggctcacacctgtaatcccagcacttgggagcctgaggcggtggatgcttcaacccgggagttcaagaccagcctgggcaacacagcacgacaccgtctcagattttcttctttttttttaaagtggtgatgttggtcattctaggcttgatagttatcttaaagggaaattttacaacatttcaccattaaatactgtattgtgtgttacaggtgtttgtagacatctattatcggttaaaggaagtttccttctattccccgtttgccaacagttaattaaaattatcaaaaacattttggggtctattgagaagattatatgattctttttcccttttattataatttggtatattctagtaatgtgtctaatgttaaaactaccttgcattccctgggaataaattcacttggatactatatatactctgtttatatcactggattttgtttgccaattatcgttacgattcgcttctagctcagcgaggagattatcctgagacaaacctactatctattctgacaggtgtccggaggaaaatgggaagccctttaaaaatttccactcaagtcccctaaagtgcct

SEQ ID NO: 539715 - DNA, 252 bp, Homo sapiens
  misc_feature (8)..(8): n is a, c, g, or t
tagaggtncccccgtcatcggcgtaatcgtgattgacgacacggccgcgtcgatctggccggactgcacggccgcgaaaagccccgcgaacggaatgttcgtgaacttgacctccgagccgaggcgcttgccgacctcggtcatgaggtcgacctcgaagccgacgatcttgccgctggcgtcctggaattcccacggcacgttgccgacattggcgccgacgttgagttccgcgccttacgccgatgcggg

SEQ ID NO: 539716 - DNA, 135 bp, Homo sapiens
ccgtcgactgtataggactaattgtgtggaactgtgcaggtttgttacataggtaaacgtgtgccatgatggtttgcttcacctgtctacccatcacctaggtattagcccccgaagctataagctatttatcct

SEQ ID NO: 539717 - DNA, 269 bp, Homo sapiens
  misc_feature (44)..(44): n is a, c, g, or t
  misc_feature (64)..(64): n is a, c, g, or t
  misc_feature (163)..(163): n is a, c, g, or t
  misc_feature (196)..(196): n is a, c, g, or t
  misc_feature (262)..(262): n is a, c, g, or t
gccgctgctgactcaggacattcgcgcggcctctcccgccagangctggaccacgtgtggaccnacacgcactacgtgggtgctgcaattcccggatccggctcaccccaacaccctgcactgggtcgatgaggccgggaaggtcggagagcagctgccgctngaggaccctgacgtctactgccccctacagcgncatcgcaacgtcacgggagagctggtgtacgcccactacgggcggcccgaagacctgcaggacctncgggcca

SEQ ID NO: 539718 - DNA, 270 bp, Homo sapiens
ttcgggtctgcagaaacaaatatagcgctatctcattagaaatactgtctgacctatattctttcattcaagaacaagtgccatacgtattaagatattaagatgattaacgtttgggaccaagagtcacaacactgacttagcttaattgagaccaaggactggacacaggccatcaagcaaattcaatctgtcatcccacaatccctagactttagttgtccatctttatctcacaggcctttaataagttattcccagcattatgta

SEQ ID NO: 539719 - DNA, 108 bp, Homo sapiens
taagtcctgtggaaaagtaccctgtggaaagtaccctgtggaaaagtaccctgtggaaaagtaccctgtggaaaagtaccctgtggaaaagtaccctgtggaaaagta

SEQ ID NO: 539720 - DNA, 327 bp, Homo sapiens
agggtccgtcatcgttggcagtaatctgtgcatcattgcgagctttcatcttagcaggttatgctagtgctgagtcacagatatcgtgagatgcgtagctgggtcggttcagttgttcgtgtgtagggtaatctacttctggagcttgtcgaaaatgttgtcacatttcaaggtcttcgcacttatctgagtcctcgctgaggcagaagttagctaaagcctccaatggctctatgtagcgattagctgtcctcacagcgctcctagaatgtcttgctgtcatggcctccgagtgctcacgtaacaggcggacaggcgaccgccact

SEQ ID NO: 539721 - DNA, 517 bp, Homo sapiens
  misc_feature (112)..(112): n is a, c, g, or t
aatggtttattattttatattggcatgtttcccatacctggttaagagttttaaatgtaggcagttcatttcagagttgatcatatttcgggggtatttttgttgtttttgntatgataaatacctgaggaaactacctaggacgaggattggggcagaggcctcacatgtctgaggtttcagtccccgtgtgctcagctctgtcactgtgggtctgtagtgaggcagagtgcatcatggtgaccatggagggccagggcacagcatagccaccaggacagctccatcacctaacgtttctagttcctctcaagtacagtcaagctcttggcacatgagcctgtggaaatttcatattcaaaccagaacagcaaagtatactgatttttttttctctctcccttttatctttacaggatctactacaagtgaccatctgcaacacaaatcacaaagttcataaaagaaacatgttcaacaatgcagttgttgtcaaatacaaaccttgttactataa

SEQ ID NO: 539722 - DNA, 249 bp, Homo sapiens
gtgtaatttatgttatttatgtcatctagttgatgttgaagaattgtgacgacagtcactggatagaggtgattctatggaggctatcccatcccagtgtaatgttaatgcttgatccaaaatgtgttagctgcagttagacagatgtttctgtcttgggggtttagggcactacatttctgaggaactctgtactcattctgtcccttctcctttcacagggcagcaaggtgaatcccatccctttct

SEQ ID NO: 539723 - DNA, 113 bp, Homo sapiens
cgtgggttccttgcagagcgcggttccttgcagaaagaaatcattttgttgatttccagagcacggggcccactggcaccgtcctgtggccagtctgcaaggaacccacgcgt

SEQ ID NO: 539724 - DNA, 229 bp, Homo sapiens
agcctatgacgtttgcacccagtataactgcacgaacaacttggagccctggtgtggtgcattcagtcatggagttcacactcttctaacatttacagtaatggccctgtggcctccctgatacctactgcctcctgacctgcacctagtgactatttaccggcacttgcatggcccggaaaggagaataggcggagatgagtcagctccttaccgtttaccgtgcgca

SEQ ID NO: 539725 - DNA, 190 bp, Homo sapiens
gctcaggttgaccgatcctagattggaatccctggccatacgctgtataaaaccagctaataatccacttcagcaaaaccatcttatgggcacgtgattagagcatttttagatttagaaagctggttctgggtaaccgggtataataagcgggtttcatatatcggatggctggaatgccaagatgtag

SEQ ID NO: 539726 - DNA, 388 bp, Homo sapiens
ccagaggtctgcgtgctgtgcaggccatgccagctccacacaaagccagctctccccgaggtattagcgcggcccggaaaccaccagcatctgccctggtttcaatgcctggccggtgcgcgggttccaacgcttgagatgttgcatctcgacgttgaagcgtttggccaccatgtacagcgagtcacctttcttgaccttgtactgcaccggttttttcgccgcgactttacgcgtgtcctgcatcaccaaggtctggccgaccttgagggcctggccgttgagcttgttccagcgctgcaggtcatgcacatcgaccttgttggccttggcgatcagcgtgaggttgtcgccactgcgtaccttgtagctgcgggtacgccctgcg

SEQ ID NO: 539727 - DNA, 187 bp, Homo sapiens
caggtaggtaagcgtgcatgagaacccactctaaccacgagctgtgctcagtgtaggcaaactctggagtcactgactggttttgactttcatacggtgaattattccatttggtctggtactggatcattgggaataaaacaaattttcttcttttttttttcttattttattttatttatttttg

SEQ ID NO: 539728 - DNA, 657 bp, Homo sapiens
cctgaatcatccatatgtgtaattcattaagcatctgcgacatgaagcatcaaaacggatgatgaacctgaatgcgggtagaactttgctgctataatactttgccccactggctgaacaacaggcagggcgaacgaacgttcgtccatcattggaccaccgctgctacaatcaagaacctggtgaaaactcacccccaagggaattggcctgacgacgaaaacaacatattctcaaataaaccctttagcgcgacaataaggccaaggtttctcaccgtaaacacgccacatcttgcgaactaatatctgtagaaacctgccaggaaacatccgctcgtcgcgcatattcaactccacgagcgactcgacaaacccgtttcaacggcaaccgctcaatggaacaaaccgtgtaacccaacggagtgcaacacatatcccatattaccagactcaccgtctcttcattggccatacgaaacattccggactgacgccatttccatcagcgcgcggccaaccacatgctgcacatacccggccggcatcaacactctgtgctataatctgctctcttaccgagtctcttacacacaggcccgtcaaaatcccgctgaacgcgacctgcgtcatacgccaccctccgagcaccatgaac

SEQ ID NO: 539729 - DNA, 202 bp, Homo sapiens
  misc_feature (5)..(5): n is a, c, g, or t
cgtanacacagcagtcatcagtccagcctctcgctctccagcctatctgtgtactctgcagagtggagcccatcgttccttcatcctgtctgtcacccgccaggctacgtctggtaagccggcacctagcttggactcgaatctataagcacgtggtcctcatcactgccgaggcgtcttttgctgccacgactcggtggac

SEQ ID NO: 539730 - DNA, 224 bp, Homo sapiens
gcctttggggcccgggcctttggggcccttaaagtggggggggcccggttggttggtcaattggttaattgggtcggaacccggaacaaggaaggggccggttggggcaagaaggccaatccgggccctggaacggaaaccccaaaagaagttcaaacgggcccgggttcggggccaaaccggccttgactttgtccgctttccgaccgctgcgtcgcagcaag

SEQ ID NO: 539731 - DNA, 478 bp, Homo sapiens
  misc_feature (118)..(118): n is a, c, g, or t
  misc_feature (364)..(364): n is a, c, g, or t
tcagtgcccaagtctggaaccagatacatggttcccacagagggcccattggatctgtggatgagcatcttcggggattgccatggaaggaattcttcttttaagagggagggcaggncccagggggaaagtctgtgcccaggccgaaacctcatgagtttaaagtcatcaactccagctcccactgccattgtgttccttattaaaggagggactccctgccctttaaaagcatttacatgcgacagattgacccaatggttggtttgatttgatttgctctctgtgaggcctcctctttaaccaggcctttacggcccaaccccggccctgccaaagtcccgttttaaattaaagggggcanaagtctttctgtccatgggggggtaggaatttttgtgcaacccccccccccgtttggtttatccttgcccccttcagtgtttttttcctgttccataaaatgccctgttaagga

SEQ ID NO: 539732 - DNA, 268 bp, Homo sapiens
gttgtggtcactgtctggtgctggggataaccaggcagctgaatgaccagagtctggtaatgcttctgagcatcggtgaactgacattgtatattccgcttgtgatcatctccaaacatctatgagccttgggtatagccgatgaactctcggtcatgtaactcaaggtcgggtatcagcttcatgtgatcttcctgccgcattgttttcagcttggcgattgtcatggccctgatcttctctatgtcaatcatgcagtagtgccagg

SEQ ID NO: 539733 - DNA, 1676 bp, Homo sapiens
gcttcccttcactttatgccccggactctctttcatccatctcatgtcctgctgtcgcctcctctcctcactccagcctccttccctggcttattctgcccaggaaagtttcgaaccccgcgacccacacacatccccaagtcaggtcaaactgactagagagataggagggagatgtagagaaggaactgagagtacaggagagggagagggcaggaaggaaacacggaaaagccaaggcacacagacagaccctcgacgccaacggacagcacaatagaaggagagcggctgcgcgcagcaggaggcacagaaaaaacaagaacaaaaagaccgacgacagaggaaaacgaagcacaggcacacacgagacccacaccaaaacagagaaaagacaccacaaccacacacgagcagagacgcgacaaacacacgacactcacaagagagacaccagacacacaagagagaggagacgccaaagacaacaacaagcaaagacgacacaacaacgcacagccatgcccggcacacaagagagaacgccagacgaaccggacaccaagcgagaggacgcaaagaaacagaacgagaaaaaacaacacaaacacgacaacgagacaaaccagacaacacaccacacacaacaaaaacaaaaggaaaaaacagagcgagggaacacacgcacacaacgcaacaccacaccaagaagcaacagacagagccccaaagacagccacacacccagagcggaaacagacaacacagcagccgaaccacgaagacctacagacacgataaacaacacagggtaacagaaaagagacaaacccgccaccgaggaggacagccgacacacgaccagccacaatcaaagcacgacccaacaccaaaccaccacgcacaaacctggaacacacgaagagaaaccaccgcgaaaacgagcgctgacacaagccacacccacacagacggagagcacgaacgcaaaccaccaaacagccaagacaagcagacacgcacacgacacacggcagagacggggcaagagcaacaacagcgaaccaccgagcatgaaacggacacgggacggaggcagcgcagccagcagcgcatggacacgagcaagaagcacaaacagtagagagaaaaccggcaaccagaagacacgagcaacacagccccagcgccaccaaaaacgaagagacagcacacgagcagagcgcgcagagagaaaacgacagagcagagatgactgacagaggagccagacgcagacacgcagtgcgaggcgaacacccacacaagcagccaacacaccacagagaaagcgacaacgacaaaaccagagcgagcatcgcacaggcacaacagagccaccccgaagacgacagaacaacaagacaacaaacacaacagccacgagccaccagaagcaacacacaacaccagcaacaaaagcagaacgacgaacagaaaaacacgaacaacgaaccgaaagaggaaagaatacacacagccagcaacgaagacagcaccaacgcacagcaagacagaaacacacaacaaacatagaacgacaagcgaagcagaccacagagaagaagcaacacacgagaccacacacgcaacagcaacacacacgaacgacaaaactcacagacgaacagacaact

SEQ ID NO: 539734 - DNA, 385 bp, Homo sapiens
cctctgggtgccccacctctttgtttagttgaacccccccgtcccccctatgtgtctcccgcgcgcgtttgtaccacatttgtcggggtggtgttttgtatcccccccttcccacggccgcccgacgtggttgtgagttgtcgcgcctcaactcattttttgcgggcgagttgttccggcgtcgacaacattttggtgtagccaccacggtgtgccccgcgtttaccctgctatgtttgggggcactcgtcccccccagtttggcttgttccgcccccctcaatgtgttgcttacccaaaaacccttgtttaacccccccctttgcctttttttaaagtggtttttattttttttttttttcccttttttttgggggggttttta

SEQ ID NO: 539735 - DNA, 459 bp, Homo sapiens
cgcgattaagtgtcatcatgacgtgcagtgaggccagcaccaggcagaagtggaagaaggagatacatgtaagtgacgccagtcctagctcgtatgtcaacaggcccgagccctcacagagctgccacctgctgctgctgctgcatgtgatggcgtctagacataagtgggcactcctcgagcactgcatcaagctgttcacctgaccggtggtctgaggagcgcagactgatgaagagggtgcacaggaggacgatgatgaggcccacaatgctcggggcatcccaccactgggtctcatagccctcgagggcctgacacaactgtctcgttgcccagctgagttggcaaatgggggttgaatttctgttcagggatactggataaggctgaccaggtgacaaacatgatgtagagggtgaagaccgaggactgaagaaaacccgagaagggctgagc

SEQ ID NO: 539736 - DNA, 113 bp, Homo sapiens
acactccccatcctgatgtcactcctgaatcccatggttcaatttccacagatttgtaccaacagacggcacaggaaaaggtttagttgtgctatacgcaggttctgatttaa

SEQ ID NO: 539737 - DNA, 1330 bp, Homo sapiens
ggctactcctcattgtacccattctaatcggcaatggcattcctaactgcttaccagacacgaaaaacttctatgactatatacaattacgcaaaggccccaagcttgttgtatgcccctacgggcttactacaaaaccttcgcttgattagctcaataataatctctatcaccaaatgagccccataaaagcctggcacaatttatcatcaccctctacatcacccgtccctgaccttagctctcatcatcgttcttctactatgaaaccacctccccatacccaaccctctcatgatcaaacttcaaacgtagcgcctcctgtgattcatttcatagtcacgacactcatagcgctaatcacggttgtacatctaaatccttcctgaatccatggctgaggcatccaacaatcataaccttaagcacacctggagtcgggcgcgacgtgacggcaccctggacagtccggcaaaactacagtctctagtattgtacacgctcactctcataggccccactcaattcgtacataatctaaactaatttacttacataaagactgtgtctcgcctattacacacttagtcccgactcctctttattcaacgaaagccactataggcaaacacactatcttgaaattaacctcgcgtgacgcatttattgaacgacccttgggacccttatcaaactcagttggaatacatagtactccgcgagcgagctaatgccatgaaggagcccaaaaatcggatactcgccacactttcgtgaggctatggcacagaacacggggagaagttccagaaacctcaaggttcgtcacgtggacttatccattaacaatttcgcacatttaacggacccgtccagtgtcgccccatttacggggcccttagttaccttttcaactctacgttaacctgaagaattaacccaccaaaattacctaatttcaactctcattcataatgaaagatccaacacaccattcaaaccgacattaaacaaaattcttttcacccttaggtgaaaaaccaaaccattaattggaaccggcaaccttctttcccccacttggaaatcgttcttaacacacaacacaactatttgtgtgcttccaccacaaaggaacccccttaactcttcactaaaaccacttcccccgtggttatctttcactgcacatttccggaaaaccaagcaattaagcccgcacagaaatttcgcgcgttatcagtacaccaaattttcaattaaccaacggcttgcccttaatgtacaaacaacaacttttccttaaccaagtttcaagcccttaataatt

SEQ ID NO: 539738 - DNA, 216 bp, Homo sapiens
ctatctgtcgtatctcgaaacggtccttcggagagatcaaagaacatccggggtcacttgaagaggtccgctgagacaggggagtaattgggaataggagtctcggaactttacccgggttaacagggtatcttgactacaaataccaaaaagaacttatttggatctttaactgggagagtcagaactttgggttcctctttaaatgtaaataca

SEQ ID NO: 539739 - DNA, 559 bp, Homo sapiens
ccgccgccacactgcttttgcctcagtcatgccgaagcacgagttctctgtggacatgacctgtgaaggctgtgctgaagctgtctctcgactcctcaataagcttgaaggcgttaagtatgacattgacctggccaacaagaaggcctgcatcgaatcagaccacagcatgaacactctgctagcacccctgaagaaaacagcaaagaccgcttcctaccttgacctagtgcagcaggcgcctgatacccacagtctacagtacggaccaacgcctgcagtacgctgatcctcccgctgaccttccagacagacctgttcttggccacgcccccctgacgacgccgaccctaatccgccctcacattggccaaactccctcatagtacccctcgataaatctcacgtcccattcttacacctcaccactcgtccctcctaccaccaccttcatccccttgtcaacattccactcctcccactctccctaacatcatcaagaccacacccccccctttcccaacaataccaacctacccctcttctccacctcgcttcc

SEQ ID NO: 539740 - DNA, 154 bp, Homo sapiens
  misc_feature (14)..(14): n is a, c, g, or t
cctaaaactttttncagaacgcttgccaaaactgcttcttggaagaaacatggattccttgatgaacacggaaccagaaagaaggatataccagcaggtcccaatatcatcagggtagtataaaacttcatttgcttcgtgtctctcatatctc

SEQ ID NO: 539741 - DNA, 408 bp, Homo sapiens
catcatggggcttcctggtagggatgcttttcaaggtatgtgggtggtactgacagcagcctcaccctctcaaggacattcttctgtctgtactcatacatggatacctagcagttaccaagtttccatttcccttacatgtgtattaagtatttaaaccatgtgagtgcattgaaaatacgtctgaccatcatgtgcaggatctgctaatgaaactcacacagtattcgaatcattcagtgaactgctacctcaggtgcttgaaataacgatgaccctgcgcgtgtgtaaacactcaaagtgacttactgatcaactctgtcttttctgaaaaccaacttcaacaaactcatttttgaccacttgacccagggttactttgtaaacttatcaatcactaaatagtct

SEQ ID NO: 539742 - DNA, 747 bp, Homo sapiens
gatagttggtggatgattaacaaaaagcatgtgaaagtgtcctctagataaagtttttagtaacattacttacttattgcctagattgtaattatgacatatcccgaggtctccccttcgatgttggcatcatgctctgttgtaatcatgcccgatttatactcgaggtcccgtgatcagtgtggtcaatcactaatgatacccagatgtgctactgtgccttgtgttacttatatcatacagtaagctgacctggaaatgagtgaaagctattatctccgtacgaagtatagatggtatgagccccgagcagactttaagagttgtacagtgtacgttaaatgtcagaacactgttgaaacgtgtaccttctcactggtacgtagtgcgagaaaagtacaagctaggctgttacatgttactgagttgtccagcaccagtaagtgtagtttcccctttgcctagtcgtgctgtgtatgtgactgtggttaagtttcttttattgccttatacaggtagaaggataatgtatttttgaactaaggtgagacattgatatatccttattgctacgagctgtagctaattgtgctgagcttgtgccttgagtgacttgactccgctatgattgactgagtcggttttactcttgacttactgtagatcaccctgatgatttgccggttccgaacattgggcacggaaacatatgcggctttcaaaatcaattgcgggggacgaaaccgg

SEQ ID NO: 539743 - DNA, 696 bp, Homo sapiens
gggaatgtggggtgcctctttcatgaaaagcatgcccatacgattaaacctgcctttagtgggatggtttggccatggactcagcccccgttttaagatggataaccaactgcagttaatccctggggtctgtgggattccgaatttcaaatctcccccttttgttggtctgttccctgcatgctagtttagagatcttaagcacaacgcacatgaaggccttgcggaaaaaatttgttttgctaaccgggtatttgggaaacctggtccagcataactttggcaaagattaagccgccacccagaaacccgttgtggacataatttctccgttttatgtaaaggagggggggggcccgctaacaataaccttttttgtttccaacaaaaatgttttcccaaaactaaaaaaaaaaggggtggtttgtggccaacgggatcccaatggcctttgggggggccccggtcctctttataattttttccctgatgtttataaattttcccatttggccccttttaaacttggctttgcagaaaccaaaaattagccgggtttttttgaaccactttagccaattatactgaaaaccgctgggggtttttcaggatttttcggttttttattattgaaaggatgtccccctttgccccctggtacttaccattaataatattccctcccgaaaattttta

SEQ ID NO: 539744 - DNA, 1717 bp, Homo sapiens
  misc_feature (1010)..(1010): n is a, c, g, or t
gcgcacatgcagaacatcaaggacatcaccagacagcgatccacttcgaggcgtaccgttgtgaagcgcctcaagcgaggggcagcagcgccattggccaacggcgtggtaggagaaggatgccagaagccccggagtatgtagacgccgcccgggtaggtgagccgcgagacaccgtccagcggtcgaactcagagtgacgagcgcggacacccggggccgaacaagcacggaagacacgaagaaagaacaggaacaccggagaagagaaagcaaaaaggagcagtacagataacacgaaacgaaatacatcgagcggaataacagaaagaatgagacatagaaacagaacaaggaaggcgcgcaagaagatagaaagacataaaaaagagacaaccgaccacacgaaacggtcatcagaaaaaatgaagaacgcaatcaaactaacctactgacaaggacagaaagcaaaaacaagacacggagagaccaaggacgaaaaataaaacgagagaaaaaccgaaaaagacaagacaaaacaagaacaaggagcaggacataagacacacgggggaccgaggaacacaacaagaaaaggacctaggggacaccagagaacgagcaaacggcgcagaagaatgaaggagcacgcgtactaggcaaaccgagagaaaaggcaattggacgaaaaggcttgaaacgccacggacaagaacgactaaacacgacggcaacaaccagacccaatgggcgagataaacgaaaggaataaaacaacaaatacaccatgaggacccatcaccgcgacttaaagggaggaccacaaaaacacacaacataagaggagggcaccacgatggagcaccacacaaaggaggaaaggccacgcacacaggagaacacagaacacagaaagggaacagaataaccacacgaaataaagacgatcgcgacgagcaagaaaagggacattatggcacacacaacgacaagggagaacaggcaaacanatacagagataagggagaagcagcaacacggatagacacagaagaccgatacgaaaaacgaccacaactaagacaataagaagagagacggacaaggggggcaaagcgatacgaacataccaggacaggagcatcagcaagaagcgccgaagggatatacccagaaagaggatgagagacacaggcagagcacggaaagagagctcaccccgacagaaaataggagacaccatacaacagcaaacgaaagcgacgcagacgaatcagagaagaacacagacgagaaaagcaaccaaggagaaaagaaagagaggaaacaacgagaagaaagacaaagagaagatgacacacgaggaaagacagaacgagagcacgatagaacgagaaggagagaaaaaagaacagacaaagaacaaagaagacggagaagagaaaaagcgaggggggggggcagcgagagagggaggagggagcgcgagacgacgcgggagagggacacgaagagcaaggacgaaaggaaggcggcgccaggagcggaaggagcggggggggcggccggaggggagcgaggagagaagggaagagaggagcacgaagagcgcgaggagagagggaggaggggaggagagagaaggcgacagaaagagaagaagaaagcaacagagagcgagacagagcacgggaggacggagagagaggagacggga

SEQ ID NO: 539745 - DNA, 207 bp, Homo sapiens
cgaccacagtggtcagttcaaagaacaaacgtggaattaaaaaactgtagtcagccaggcacggtggttcacacctgtaatcccagcactttgaaaggccaaggcgggcagattgcttgagctaaggagttcgagaccagcctgagcaacatgatgaaaccccgtctctacaaaaagtacaaaaattagccaggcgtggtggtatgc

SEQ ID NO: 539746 - DNA, 733 bp, Homo sapiens
cgcctccgtgggacctcggcgattgcccctcacagcatggctgtcgtgtctacggcaactccacagacccagctgcagctccagcaggtggcgctgcagcagcagcagcaaacagcagcagttccagcagcagcagcaggcggcgctacagcagcagcagcagcagcagcaacagcagcagttccaggctcagcagagtgccatgcagcagcagttccaagcagtagtgcagcagcagcagcagctccagcagcagcagcagcagcagcagcatctaattaagttgcatcatcaaaatcagcaacagatacatgcagcagcaaacagcagctgcagcgaatagcacagctgcagctccaacaacagcaacagcagcagcagcagcagcagcagcagcagccagcgaggctttgcaggcccagccaccaattcagcagccaccggatgcagcagccacagcctccggccctcccaggttctgccccaaggcaagctgcagcatgatgcatcacacaacagcaccaccagccgccaccacagccccagcagcctccagtttgctcagaaccaaccatacacaactcccgccacagtcgcagacccagcctttggtgtcacgaggcgcaagtctcctggacaattgttgtatacacgaacacattgtattttgtcgacctctgtggtggtcatcacccccattgagccctggttcgcagcagaaaaggtagacgcc

SEQ ID NO: 539747 - DNA, 393 bp, Homo sapiens
taggtcctcagctttcttgcagcagaagcttctcccagttcctcttcagcatttatgatatatttgtggactttggatcttgttagaatcaataacaaaaagagattatgatatagataccatcaccttcattttccagatgtactatcattccatttggaaatcaaagttagtgttccctaagtgacttcctgctgcaataaatttgaggacatcatgggctctggactttgtgaaagtttccctttaagtttccaacaggattccagaccaccactgtatggacccctctctgggttgcacagaaagctacctttttttccttttcctttcctttttttttggggatgaagtctcgctctttcaccaggctgtagttgcgtgccttgatgt

SEQ ID NO: 539748 - DNA, 265 bp, Homo sapiens
gacattttttaaaaagacaaaagccagcttacaaagctttggacaataaaacccaaaggcctcctctgattaagaatatattttaaatactagtacgcaaaaatgtatttaggccaaaatgtaatagtacaatctgttgcacaccatacctgtaggtgttgcctgtttaagggaagtccacatggagtatgtaccttcagtgcttacaggatcaacaaaacttcatttagagagttacaagttcgtcgctgggctacagcacatg

SEQ ID NO: 539749 - DNA, 131 bp, Homo sapiens
tttagcattcacttcaagttttattttgcctcttgcatggtcttttacagttcgttttctacaggaactgagctctgatccaaacaatcaatcgagtggaaggaaatttgcggggtaccgagctcgaattc

SEQ ID NO: 539750 - DNA, 192 bp, Homo sapiens
aggagtatatgcgcgcacggatggtgactctgacagagcgcgaggtcacgggggacacgggtaatatcttgagactcccggtgctatagcgcgggccttctcaccgcgaaccaggctcttagaatacacctaccctaagtcggcacggacccgtttttattacctgcggggcccaccacagaggattttcag

SEQ ID NO: 539751 - DNA, 138 bp, Homo sapiens
tactgttggtctgctctagagttatccccggcctgccatggctggtacgggtcggagtagtggctgcggctcgccgtcgaagttgagccatacgggcagcacgacgcgcggactgcgattggtgggtcagaacataag

SEQ ID NO: 539752 - DNA, 914 bp, Homo sapiens
  misc_feature (265)..(265): n is a, c, g, or t
  misc_feature (699)..(699): n is a, c, g, or t
ttttttccaattttatttccattatgtccccttttatttctgaatttacccttattatcaaaatgtgcccttgaaaagatacaaaaaaaaataaggggccccttcaaaaaaatgctcccgcgtggacaggtgcgggagggaggacatgatttataggagcccgttgtggtggggaaaagagaaagagtgtttacttccgaggctcccgtgggtagtgccattttgtgtggtcaaatgcattctcagaacaacgtgagagggttgngacaaattctcaggataatatgaaagggcgttatcacggtggagagcctctctctctcacagaaatatattttcccatagaggggagtttcacaaatgtggccccttctatcagcgtattgaaaaatagtctcgggggtgtgtggttaatatatctcgggcgctcacgagagagatataactagtgagagaccgtctcaagagagaagggagcgcccccccatattgagcccggggtggagtctgtcgccaaaaggggggggacgcccctgttgttccgcccacaaaagaaggggctttttgcaacgaggggaattaggtcctgccactgttgtagtaaataatcaacagcgcccggcctggtgggcccccctttcttaagtagttggtcctaccatattactaaatgagccccacgagccccgaggagcgagngagaggtttacacacaaatgtgatactgatgtggggggtctcccccaaacctcgcgaaagagaaaagtgtctcttaggcccgagggttttctcgcgggggagtgtttataaaaaagtctatacagcttcgtgcactctggaccgcggggtgggggacaaaaaccaaaatgtaccaatatctacacacattctgtggggcgtcttctttatatatc

SEQ ID NO: 539753 - DNA, 328 bp, Homo sapiens
tgacagaagctacgaaggatacacatatgtccagtgactacaggaaaatgtacgatgatagaagctaggacaggtgacttatgtcctcccagaaagacatggagattcagacaggaccccgagaagacaaacttcagctaatcctcccacttcccagcacccagaggagatggagggcaggcaggaaaatgaggaacccacgaggtgaggacctctagaggagaggggaagaagggaggcaaggaacgacgaggtgtggtaacaactcaccttgccgaaatcaactaagccctgaacaatgtgatggcgcttgtcgaggctaagtggt

SEQ ID NO: 539754 - DNA, 160 bp, Homo sapiens
gcaacctaagtctttataagtcaagtggaaataggctctcctgaaatttctattgatggagccatgactgctcacgtggagccaagagagcactgcactttcctgcctttaaatatttgttgttagccgggcacagtggctcacacctgtaatcccagca

SEQ ID NO: 539755 - DNA, 1676 bp, Homo sapiens
  misc_feature (572)..(572): n is a, c, g, or t
  misc_feature (1118)..(1118): n is a, c, g, or t
  misc_feature (1406)..(1406): n is a, c, g, or t
gctgcgtgagggtgcgtgcggtgccgcgtgagccgacagcaaaggagcaggggcgccgccgcaagggagctcgtcagccatcctcccgtggagcctcgcagctggcctctcgtctatctggccagcatgacactgactcaatcggcatcagtcgaaggcaggtgcagatccaagttcggcctcattcaatctgcgcgcaacaaaagtgattttggacggggcgctgaggcggttccgggagttccaaggtgtagacacgcgctgtcctgcaccatgcgagtccttgcatagcaatgcatagctagcatcatgtgacggcttggcacgcaatgcctcctcgtggcaacgagagcggtgggccagctggcgcgtcgctgtttgatgtcacttgtcgccatgacgcaacacttgtgtggcctgctctagcgctgagtgcgtgcccgggaccagatgagaagcggtgccataacagttgtacctcgttgaccgcaatgcgggccgcacgggattgtcccgcggggcatcctcccgggaacctttgcgcctgttgttctcccccgtcctacttcggntggagttcggacaaagcaggtaccgcggacgcgggggtacctgacgtggggggttacctgggcttggacacggtttccctgtaacggggcccgtccattccgcaggtgggcggcccttaatccttttccaggtggcctggtgacgtaagcgccgggatggcgggaacccccgggtcgctttggttgccctgtggaacacttttgctgggcagaccgaaggaaagcaggtgtttaggtttccccccacaacaggtcacctggaacgcacagtggttggccgcaaggccggattggtctacgccactttctggccacctagtgttggcagagcacaccattatcacgacggggttaccaagaagcaagctatcctttaccacaagaggccgggttacaacccaccaggggtaaaaaggactgtgccttaagcgggctctgaccaaatctctctgtgaagaccgggccgggccggaggtgccggggggcccctgggagccgggcaaggcaattccggccggctggttaggcggacacaccaggcgcggnaagcaggttttggtcccccctttgtgggtgggcccggcttcctggcacgttccgggccttccctctttccacacgccgccttccggcctctcttccctccagggtggaacgccccatgggcggtctttacccaggttggttgagcgacagtgcaaacgccttggctctgggagacacccagcccggggtttttccctttggtcgccgccacacctggagaacgcgggtaggtcggcgcctttggttttgggtggtggcagggcggccccccggtacggtcccgtggcncccaacttggtgtcgttaccaaccgccctggggaaaggcttccccgcgcgctccggagcgcaacagcgttgtgccgccctttccccgcgcgaaaccttgtcttgaagtggtgccccgtgtacacccctgttgtggtgcgcccaggtacagtgggagccccacagctgaggcacgcgcctcacacagccgcgcggcaacagggccgccccaacagggtgtcgtccagcggagcaggacagcacctcattgtgtgctcttgtgagtgcagaa

SEQ ID NO: 539756 - DNA, 451 bp, Homo sapiens
ttggaggcacacgcacaattcacacacatacacacacttgatacaccccaattcacagacatgcacacacttgatacacacactttcacacatccccacacacatgcacacacttgatacacacacattcacacattctcacagacatgcacacacatgcacacacttgatacacacacactcacattctcacagacatgcacacacatgcacgcacttgatacacacattcacacgtccccacacacatgcacacacttgatacacattcacacacacatgcacacacttgatacatacattcatacattctcacacacgcacacactggatacatacccatgcacattcatacacatgtacacatgcacacacttgatgcacacacacctatgcatattcacacactcacacatatacatgcacacacaacacacacacatgcacacgc

SEQ ID NO: 539757 - DNA, 996 bp, Homo sapiens
ggggaaacggaagggccggaggcgcggcggcgggcggccgagaggggcggtcggtggcggcggcggtggtggttcccgcgtccgcggaggcccgtgccctgagagcctgcgtccatgttcctgccgtcctgttcccgccgtcctgtgggcgccgctcgatgacgcccagatctgcttcatcgttcacgacagggatggatggtcgagtcgttggaccgagccgtggagagcctcccatccctcctctgctctactcactcgaccgtctcacttcgcatggttgggaagaagagcattggcttttgtgcctgaacaggattcgaatgtctcgagaatagttacatgacgacgtccacctgctggacggacggcgatgcaatgaggctgggaactgtgtgacgagtcggacctagcagattacacctgcgaccgagattgtcgacttgaacgtaccgcgagatgcaggctgcaaagctagtgggtttcgcaggagttccacaatccaaaagggatgtctgtgcgtattaccatttgtcggagccatggacgcgtcaggtcatcgcggtcggaacttggatctgacggcttcttgacgaacatgaccggtacatgtccggaattgtcatgcccccatgatgtcgaccgaaatgctcgtcggacttctaacacaggagaaaggcgcttgcacagcgtacagcacccagaagggggccgcatgaacggcgagggggagctagcgggcgggctctgaggtcatcagccgggggtgggcctcggaaaggcggacgagcagcggtcaggccctggactacgtgggagactcttcggccgatgatccgagggcttcccccgcaaggagagcccgcaaccccaagagccggactcattgaacgagctgggccaagcaggaaggaagctggaagcgggacctagggcccaggagggtccgaggcagcggagcaagtgggtttgagggcacagacaggaagggaccca

SEQ ID NO: 539758 - DNA, 145 bp, Homo sapiens
ggggattctgagcagtgcctctgtctgagggacatatcagtgacctcgacgttgcctttaactacagttgtgttagcctcttgcgtatggctttttcagagtcatttatgagcagaaaaaaaaaaagtaaaacttggctaatatt

SEQ ID NO: 539759 - DNA, 132 bp, Homo sapiens
tcaagcttctaacgatgtacggggacatgccgggtggaccaggagctggagtctgttatcttagcacgaatgctcatgattttctaaaaaaaaaaataaatgttttgggggtgttctgttttctccaaaaaa

SEQ ID NO: 539760 - DNA, 250 bp, Homo sapiens
ttgtagccatgatggaagctctgagatgttagtatatatctacatatactttataaaaacttagtgaattaatacatctcaacatgataatgacatatgaaatggccatttcatatgagaatgaaatctggaatcttctcaaaagctgataggcttgaacatactatttctcaccacaggtggtaagttaatagtaagggccatttagttctttcaaaatagataaatgagtaaatactaaaaaaaaaaa

SEQ ID NO: 539761 - DNA, 1628 bp, Homo sapiens
aaacgcggaaagtctctaccgtgactgttacctcagacaaccccggagaacatcaacaatgaacctttgacgcagtacacgttggacccagggacccggtacccaaacctcaactcacactgtgtcaggccccatcaggtgaagcatttgtatatcactacggagctggagcacatacccgtctcgagcagacttggcgctcgcgtgcaggagatcttgtcaacctctccaggaaggagtcagcatatcctggtccacatgcaacgctccctgacctgtgctgcctagcatgcatgcacacgagcgcgctaccctaggcactgctcacaccgctccaccccgtacctgtacccgaccactccactgcgcggcaactagagagttagagcccacatgatgattgcccacactctactacccaccctgacactatcccggcgccctgcatgccctctactctaacgtataatgacctacatctctgaccactgacacgcactgcatcgcgtgatgcgcatgcaaccaaccccacgcctcgccactactctgactgctagcgcacgatgccgcagcagcctccggcgcaactccccatcccagctgcaccaccgcgagccacaacagccagattggccatttcatagccaccaagtgcaagacctcttgaatccatatctctctacacgcacattgcctccaactagctaacccgctcctttccaaaagcttccttacctgaacgcctacctatacgcagggcaggtcctaacaccacacaactttgcatggtagccccctgcttgacacattaccctatgccgccggctctaacacaacccgtcactgcagacggacgacatacattgccgctggaacccccacttcatggacgattgtgcagctccactagcatgttccacacttacgcaacgatattctcagtataatccgttatccaaccttaatttcataccaactagccctctactaccacgacttattaccccaaattcggtacaagcgaactcagaaacgtccaccaagccgagacgactggtcacctgtcgccacacaacctaacccgcgcacgacatcgaacgtcggcccaccatgtcaacctccacaagccagccgcgcgcatccagcgaccagggcgtgcatattcccaccaacagacgctaggagaacacagcaacaccactactacatacaacacttatgaactagaacaccgcgatatccttgaggtcgcctattacactactccatagaaaacaggtgtgtcggatacaccaacatacatgatcgcaacgatatggatcacctcgacaacaccaaggatcagagccaacagtgtgccaaatctgagctgtagctgagcacaacgatcgcgagaaaaatccatcctagataacctatacactctacgaacgacacgaactacaatacgcatggcatacatctcccaatccagctaagcaacaaaaaacgagtgcaccagtggacagtccagatgatacaactacatgataatgtacacgcgagtcacactctccccgccgatcagccatcagcaccaccacacacatactggtcgcatcactaacccgacattgcacccaaaagag

SEQ ID NO: 539762 - DNA, 121 bp, Homo sapiens
cacgagaccattcactaccatctgggaggctcagtatacgcagttccaacgtggctggcacagttgcacctagagtcctgcaggttcctcatggctggcctcaagattcgcgggatcccta

SEQ ID NO: 539763 - DNA, 239 bp, Homo sapiens
gtcatatgctggatgatgactgctacactcagcccgggtgactgcaccctgtgattcgccaggcacctttgatgccatttaagactacagtaccttgtccccgacctctgaaggagactgtatcaccacgtctccctatcaggatgtcactgaccacctcgttcagacccataccagagtctccgtgcagcggcctcaggctccagctgtggctacaacataggtgtaagggcccctgc

SEQ ID NO: 539764 - DNA, 215 bp, Homo sapiens
atgcgctctggtgcgctgttcacaaactaaaggctctaccatccatccagttgtccctgattggagtccttcaactgcagatcttttcccaagccacggctctgattctgtacctcaaagcactgagaatgctctggatcaagtagatgatggagaggttccgctgagggagacagagaagaacgtgcgtccgtactcaactgtatgatgcagta

SEQ ID NO: 539765 - DNA, 346 bp, Homo sapiens
  misc_feature (85)..(85): n is a, c, g, or t
  misc_feature (165)..(165): n is a, c, g, or t
cagcactctgggaggccgaggtgagtagatcacttcagcccagaagttcaagacaagcctgggcaacatgggaaaaccatatctntacaaatactcgcctgcttctgccactctgcaccatcaatataaataataactaattcacaataatcagtcatgaaagantaaaatggaaaacatgccaaatgcaggcccctgctttgttatcactgcatgccatacacataaagttctctgtcacgtgactacaggagcatctccattcctgtgcctcgtcctcaggtatcagtcgcaaagccacttgcgggcttgaagtcagcccacagtccttcttggaagtcaacag

SEQ ID NO: 539766 - DNA, 170 bp, Homo sapiens
tcgctttacttctccacgctttatacttctcaacgctttatacttcctcaacgctatatacttctacaacgctttatacttctcaacgctttatacttctcaacgcttatatactttcataccctgaaagtgaaatgagaaagcgtttgagaaagttataaaggcgtggg

SEQ ID NO: 539767 - DNA, 762 bp, Homo sapiens
  misc_feature (164)..(164): n is a, c, g, or t
agacaacgcgtgcgggccgaacccctccccccgccttgctcccaacaatataggactgccggggtctggccgcgtcctccctgtgtccccccgtccgattatgtctcggatcgaatccctcacagcgggtgcggatcgacggagccgagagctgggagcaaganccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaacctgcaatgtgactatccacaaccgctgtacaagacaccctcgccaactgtaccaaggtcaagcagaagcaacagaaagcggcctgctgaagaacaacaccgacttgcagtccgtttctcttcgaagtaagacaaccatccgggagcggccaagctcggccaatctacccctccgacagcttccggcagtacctcctgggctcccgccgtggcagtcctccttgtctttagccaagagtgttcctacacaccaacatttgctgggacatattcaattgatgagtctcccctgtgggctgcgccggatactctcaacagtccacagatcgctcaagatgccggaaccgaccctatcagggcactccctcattgacgaagcacagggtatctacagtgagctgctgagtgacttagacacggatgacaaggacttgccgctcattcttggactggtg

SEQ ID NO: 539768 - DNA, 136 bp, Homo sapiens
actgagaatcctgcactggtagatcgttccccacccagcacagcaactccatactaacaagaaactcagcccacaaggtggcagtctggagggtgtatggccatgcagcttgctgtaagaatgaggaggaaggaga

SEQ ID NO: 539769 - DNA, 778 bp, Homo sapiens
gtcctgagagaccagaactcacaccagaatcgattattcctcaggtgaagcatagactctttcatggtagacagatgtcacgactcagagatagaaatctccatggctatcatcaggtcacgggtcagctcctgttggagtcctgcccaacttatgtggcttccataaaatggtaacagtccaggctccttgcctaattgttagagcattaactccctatttgccagtaagcaaggaggtggatctctgcaaacctacactgtctatgacagctctagttgtacttggtgtgactaatactacctcggagaaggtcaacctgcttctgcgaaggtttggaacgtgtcagcttctataatgacactagaggttcagaatgtccgattctagaccataactgaagggcttaaatggcaacaggatatgacgggaaacaagttgcatcatggagctgacaaagtggtgcatcaccaatggctagcacaatcaaggtatcacactgtccattctctgtgtctgctgggattaagcattttctgtgcctcctttgttcatcttttcacaacagctggctacgagggatcagaaatgagctgtgccatggtgctcattcactgtaaagctcccagttggagctacttggatccccggagggggccgatctcttgttccgagaacagaggggttttagcttatgaccttgggtgggccgccgtcatgcgatctgcttgggggaaggcctggtttctttcgctagccggggggtgtctgcgcactc

SEQ ID NO: 539770 - DNA, 1569 bp, Homo sapiens
  misc_feature (1246)..(1246): n is a, c, g, or t
accccgccccttcgcgcgctctttgtttgtccgcggtctgctctggactctgtgtctgattcttgtgtcttatgtttcattgttatgtctcttagcgtctcatcagaaaaatgaagaaagcaaaggaaagaatgagcgtcgagtgggtgcgtgtgggggagcggggcggccagaagggtgctctcgtgtgagtgtttttgattgttcagatactcctcttgcttcgtgtggttgatgtactcacgacctgtgttggcgatcctccctatcctccctggcgtttgattgggtctcttcctcacgtggggtgagtttgctgcttcttcctaccggggttacgctgttgttgggcctgtggttagatacgtatcgtctctgctcggcgtggttgtgtagtatctgcctctgtggtgggtcgtcgtagtcatagacggtttctctttatagtatagggtcgtggttgtcgccccccccgcttgggtgtggggtggttacggtttgtgctcgcacacgtacacgcacccgggggggggggtggtgtgtgtctgcgcttcccctccttgatgcggggctgggtggttgtcgtgtgttgagagcggcgcccccgcgtgggggggtgtgttttgggtcacggtgacagccgcgagctgctgtcttgctttaaagcgacgcggtgggcgttgagcactcgccctccctgggcgctctggcgggttaatatagatccctgggtgccgagatagtggtctgtgccccgtgtgtttgtcggcccgcccagcactgttggtgcatcctcccgctggtggggggccggcgctgtgtctaagtttgcgctcgtcggcccgccctttcccttgctgtagggccgggtgacatgtgtattccgtttttttaatatggccggggtcctgcttgacttcctatttcgtcgccgcggttctgttcgtacacccctcccttggtatattgtgtccatggctcttcccccggcacctcggttgccaacattcttgttttccggcccctgccgcgtgtttcgactcgtgcgctggtatggtccttgcttggcggtagcggtctgcgcccttcaggagtttcatcgcggggggcgcgtgtgtattctggtattcgctcgtgtcttttcggggcagccacccacctctctccctcacagattgtgttatttctgtcttctttgcgcggggcggtgctgtgttccgatggactcaactctgtgtgttggcgnggagggcgtgctcccccactcactgctcccgacctctcactcgaggcatctcctcggcctcgctactatgccagagtccgcagtgtcttgcgtggtgcagcgcgcacacactctctcggtgtggtatctctatgtgtcccctgcgtggcaatccgcattctttctataagaaggagggcgccctcccacacgagggtatgataaaagcatttccgagacgatctttttatgggtcccagtctacatacgtggtctgtgtctgcaccgaacttatcccacataagaccgtctttttactgtcccatcaatgatacaagaaatct

SEQ ID NO: 539771 - DNA, 465 bp, Homo sapiens
  misc_feature (36)..(36): n is a, c, g, or t
  misc_feature (46)..(46): n is a, c, g, or t
  misc_feature (178)..(178): n is a, c, g, or t
tcgtactctacactcgggacaagtcttgctcctccntgcactctgnttctcctccgaactccctctcaccatcctgcacccttgggtcctaccctgttcaacattgccctctcctgctcacaccctaacccctttcagggccttcccaagcccctgaactgtgcagagagggccaggncgtccacttatcacagggacgagctgcaggagggcagcatcacttataccggtagctgcagttgctccccaggcacaagatggatctcataacctcaaagtcacaaatgcacgcccctcgcgacgctctgcctccttcagggctacacccagtctcccagcatgatcagcccttgtgtgccctcacagggtgggctgcacactgatgtgccgaactcaccacctcctcactcacgcagggtcacacatgcagtcaccccggacacactctcaagtcacatggtgcac

SEQ ID NO: 539772 - DNA, 136 bp, Homo sapiens
ccgagtacacatggcaggaacagatgaggggctgcgaagcccctcaccctgaagaggggagcatcttcccagtccaccatccccatcgtgggcattgttgctggccgggctgtcctagcagttgtggtcatcggag

SEQ ID NO: 539773 - DNA, 101 bp, Homo sapiens
gcggtgttctgaggatccccactgttgtcatcccgagtgttcagcccccccgatcagcgagcaagtatgaacaacagtgcaggtatgaacaacagtggggt

SEQ ID NO: 539774 - DNA, 251 bp, Homo sapiens
gaccagatgtagccaaattacatgtctttgaagaagatgtgaaaatcgccagattattaatcttgaggcatgcaatgaatactttaaacctttgaggttaggggtatggaagagagttaatttgaacaattaatttaaaaatttgtgtgaacaaaggagagatgagagttgaaactctaaaccctcacataaaaaattaaatctctagaaaataaaactctcccttaaacgcgactcacaatagaggtgta

SEQ ID NO: 539775 - DNA, 818 bp, Homo sapiens
  misc_feature (433)..(433): n is a, c, g, or t
ggggtaagactgaggaaccgggctttgctgtagatagaatgctgttagaaggtggggcaattctgactgagtaaagaaggaacagccattctgtttagcacgagaaggggatgtttggtgttttgtgcgttgcaggtgcccttgtaatgtctgttcttagagaaaatcttcaagtggcattgctttgtcttggtgtgtcatgtctcagaataatcttatcccgacgtagggtatctggtggggatttgttcatgtccaggaggaaacagagttactggctgtgagtgtcagatcggttgtaatatattgaagtagtgtgggatcagagcagtttcaggtgttggaggcgttttttcttctttctcaatagtttattattctagcaaaagtattttgatagtattttcagaagaagcttaacaactctcaagtnatatcaatagttcttatctagaacagcgatatcaaagtctagtctgggcactggtgtcactttgggaagctgttttcacaggttttccaatgaaaatggaaaaataagaatgcaaaactaaaattattattagaatgttaatctttactctgatgttatggacttcaagttttcattgtgcaacgtgttcttaaaactaacggcagaggtacgatgtcatgtgcctggaattcggttgtttaaacatctccatttggcagaataaaatttggaccttctgtgcaaggcttcataaatttttttactggccggaaactctggattccatgcctgaggactttgaactaaagaattaggactctctggagaaaacgttcaggggatt

SEQ ID NO: 539776 - DNA, 331 bp, Homo sapiens
tgagtctaaggaaacatcatgccagataatgagtcattttaaggcattttgactcaagttgaggactgtagatagtcactaaagaaggcatatgatcagactttccttttaaatatgtcattttaagtggtatctggatgagttaagcgttgaaaaaactaagttttgatggtggtaccacgacatttaagtgaaaaattgtgttgatgtaaaaaagcgaacgttgcagggtaaatgttgctattgtttgattgggattgtgtatggcacaatacaaattgtaagtaatctgcgaggttattggcatgcgtaacccagctcacaatcgtaa

SEQ ID NO: 539777 - DNA, 598 bp, Homo sapiens
  misc_feature (556)..(556): n is a, c, g, or t
gtatagtctagtgctaggccaactgcagtgctttatatccgaatcaagatatcgttaaggaacaaagcacgtgagtctgcttttaagagaatataacctacaacaacaacagtctatttttttaaagaatcattaagggctaaagtaaatgtcttataaataggtatcttcccagattatggtataatctcctctacctgggagaatctagttggttgagccccagtcgttatgagacggcagcaaaaaccacattaagtcacctgcctcgttgagtcataagggaacacgtggatttgagcccgagccactctgacttagacaagtcacttcatctctcagggtcgcgctttcctcccgtataaaactagggcctgctaaggtccctttcagctcaaaaattctctgaatttcaggcaacagagagcacaggctctgagaaactgagcaaggactaggttttcttgaactctaaccagataatccttggataaggaagaactgggagcataaaaacacgtgaattctgaagaggaacactccacagaatgcccgnattagtgagacatcgtgggtacgagtcgacagagagggacac

SEQ ID NO: 539778 - DNA, 896 bp, Homo sapiens
  misc_feature (3)..(3): n is a, c, g, or t
  misc_feature (5)..(5): n is a, c, g, or t
ctngnatcgaagagtaaagagatgagaaagaggacgagaagacggagtgtgtcatcaagactggtccgctcttacgccccctgctgctggtctcctgtcgtcacccccaattccttggtccttaacctctctgtctcacgtatttacgtcggcccttgtcaatattggcttctgcaacatatagcgctcttagccaacttacattggctggagacactcttattcgcatcttgggtgactagcgactctcaacctgtgggacgtcaccaaccaaggctggtgaagttttctattcagagggtcctctgtatacttgtctcgttaagaaacttttccttacatcgccgcgtaaaaagactcttgcaagctatgttcctccccccaagccttcccgtttcaatattttccggggacgaactcccgcgcccttgtaaactgtggcggccacccttcccaaccgccttttttctggggcgtcactctccttctgagggctccattaaaccaggttaacaagatcacagaggaacaccccccgcgtcatacagccttaacacttagctccaacacccatcaaacccttgattaacccgcccctttgatcccacctggataattgataatataccttccaatattcacccagcactctatctattacattgcagcacgccgagttcatactgggttctacaaataggcacccacttcaactcaatatcttgcgcccctttccccgtgttttttaagaagcaaagacccgtcctacaggtattttattgttttcaccgcaccacaagaaagatgaacataacgtgatacctttgggggaagaaaaaccccggatggaattttctaacctaagagaccaaaaaagggggccgaaccccaaagcg

SEQ ID NO: 539779 - DNA, 305 bp, Homo sapiens
tccttttaaaaattttttcccaaaaccattagggattttaatccggaatccggttcccttaccaaccaccagtttttggatgccagcccccttttatttcctgtaggatggccaataccttaggtggacccagggtttgccttggttccttgcttcgtatggtaattaagtttaaaaccgtttaaattaggggtattttggtagggttttttccttcctcactgcccgtggaattgccttcctatgggatatctcctttcccggaaaatcttttaattaaaaaaggttttaaggaaaaaaaaaaa

SEQ ID NO: 539780 - DNA, 375 bp, Homo sapiens
attttttaaagaaattttattccctgggcccaaagggttgggtaaccccccccctcttctctgctttccccttttgagtgtccacaggaaacagaaaggaatgagtgtgtgacgttctgcgccgccttcctctgggcgagcctccttccggggagaaaatttgggttattttttttccggggaaatttttaatcccggcagaacctcatgtgagatttctttaaaatgggtttaacggttttttccgcctgaaaaaaaagggtttgaaaatgttttcttggagttttggttgggtttaaaccaccaatagggttttatccccccaaaaggaattatattggggattccttgaataaattttttttgaaagttagc

SEQ ID NO: 539781 - DNA, 764 bp, Homo sapiens
  misc_feature (559)..(559): n is a, c, g, or t
  misc_feature (571)..(571): n is a, c, g, or t
  misc_feature (586)..(587): n is a, c, g, or t
  misc_feature (595)..(595): n is a, c, g, or t
  misc_feature (610)..(610): n is a, c, g, or t
  misc_feature (612)..(612): n is a, c, g, or t
  misc_feature (614)..(616): n is a, c, g, or t
  misc_feature (620)..(620): n is a, c, g, or t
  misc_feature (627)..(627): n is a, c, g, or t
  misc_feature (629)..(631): n is a, c, g, or t
ttggacctttgacttggacctggatctggacccagggataagatttggacctcacttgcaaattttggtaatgaaattttcctttgctcctgtagtccttggacctaggcttcagtcatggatttagaccttagacgtgaccatcagaccttagagttgaacctaaattcctggtccccagtcctataactcagaatgattatgcataaccttggacttagaacttagatctggatcttagagctgatacttgacctggtactggatatttaaccttggacttcagacatggatttaatctgggccttgggatgatttaagatctagaagtggacctagaattagaccttggacttatgtgcctgagcctggactttggaagtggactttgggccttgtaactcaaccttgaatatgagcctcaaatgtagactgtgggccaggcacagtggctcacatctgtaatcccagcactttgggtggaaagctgaggcaggtggatcacttgagctcaggaattcaagaccagcctggggaacatggtgaaaacctggctctnccaaaaataaanaaatagccaggcttnntggcacanacctgtagttccagntncnnnggangctgagncnnnaggttcacttgggcccaggaggcagaggttgcagtgagctgagcttgtacagctgcactccagcctggaggacagagtgagactctgtctcaagaaaaaaaaataaaaaataaataaataaataagagaaaat

SEQ ID NO: 539782 - DNA, 955 bp, Homo sapiens
catctctgtaatcccagcgactcaggaggctgaggcaggagaatcacttgaacccgggaggccgatgttgcagtgagtcaagatcataccactccactccagcctgggtgatagaatgagactcagtctcaaaaaaaaaaaaaaaggaaaaaaacaaagactacagcatggggtacagactgggagggataaaaaagactaccctggggtgaggggtgcaccaaaatctcagaaatcaccactgaagaacttttccatgcaaccaaagcagctattggttccccaaacactatgaattaacggtttagagaaaaataggtaagaacagacttagggacacaggacaaaattccactggaaacaggtctggacgtatgcgaatacttacaggaaacttccaataagcttacctttggatttattgaccacacacacacacaggcgttttcttatacccagggtggaccctctcatttccacgaaatttcggggaggggtaaatccagcggggtcctaaccgcccagggttgcgggatccccttcaagggcctccttaggggaaatattacccggcggaattcccggcgtggtcactagctctccggagggacacaaccccttttcttaaacaaccagtgggcctcagaacacaaagtggccttctcaaaatggcggagatacgggcagggtgccacacacgaagcaacggcaccccgcgaataatggggcttaaaatgcagccaaggcggcgggggacacgcaacagaccaggggcaatatgcccggaggcgaaaggtttcggaccatgccccgggtccacagcaagccgggattgggggcgaaaacaccaaggggggggacggacacttggatgagatagcccccaaacgcacgaggcgggtggacacccgcccatggatcacatttgcgcagcccaccacctggatgtgatcaa

SEQ ID NO: 539783 - DNA, 263 bp, Homo sapiens
gtcccagcaactcgggaggctgaggcaggagaatggcgtgaacctgggaggtggagcttgcagtgagccgagatcgcaccactgcactccagcctgggcaacagagcaagactccatctcaaaaaaaaaaaaaaaaattcttattttgggccaggcgcggtggctctcgcctgtaatcccagcactttgggaggctgaaggcgggtggttcacaaggtcaggcgattttaggacccatcctgggctaacacggttgaaacccc

SEQ ID NO: 539784 - DNA, 989 bp, Homo sapiens
gccttctcagaaagacgaaatgtgaatgcagaacgacgcagtacattgtgtatcatgtcaattatatggtgcgtcgaactcttactgcactttttaatacacaatgtgagttaaccaccactgtgtgcgctgcccctaactggggaatacgcccgcttcactatatcgctgttttcgctccctccgccgtcttttttagttgtccgccggccagcctttggattaaacgcttagcaacgtgtgttgcggttatgcgcagcagacttttgtaagcgtgccaaacaactaggatctgttcgccatgagtgctggtagaattttacacaaaaggttccactttgggagtagggtgttaaaacctccaactctgggtcactgcgcaaaagggtggttctttctgaaattcgaaaaaaggggggcaccttttacttcaactgcgcagtgatgcatagtcctttgtaggaagccggtcgtgtcaccctggccccctgggcagagccacgatgtctgtgccgacgcccccgaaggtggttctgaacccggggataccccgtcataagtaccggcagagccaatactggttgcaggtgcgatccaggggcccactacccccggttgcggcgcttcttggaccaacaacctcattttttggaaggggtgttcgctcccgcggggttaaacacatttctaacaggatcagggtcctgtgacaccaccccgctgcgacacggcacctgtcggtacattcaggttgcgcaccatcatcagtcctggagcactcttgtggaaccaccacatagcacaaccccctttgtttgtgcagagagtaatattgtgcttggagaacataaaataagtgaataccctcttgcttggcccccccactgtaggagacaaacaccaggtggtcgttggttattttttttttttttcgcgccccaaaaaaaaaacaccttgtcccacaaaacaaaaaaaaccgaacataaaaa

SEQ ID NO: 539785 - DNA, 171 bp, Homo sapiens
cagacctggcgtctgggatagtgtgctgctttccccttactgtgctacatttctatagttaagctggttttacttgcaatgattcatgtttacgggggaaaatgaaaatctcccttaaaatttgtttcagctcctccggcaaataaaataaatgaagtggcagatgtacac

SEQ ID NO: 539786 - DNA, 222 bp, Homo sapiens
  misc_feature (4)..(4): n is a, c, g, or t
  misc_feature (6)..(7): n is a, c, g, or t
  misc_feature (30)..(30): n is a, c, g, or t
  misc_feature (40)..(40): n is a, c, g, or t
  misc_feature (48)..(48): n is a, c, g, or t
  misc_feature (55)..(55): n is a, c, g, or t
  misc_feature (64)..(67): n is a, c, g, or t
  misc_feature (79)..(79): n is a, c, g, or t
  misc_feature (97)..(97): n is a, c, g, or t
  misc_feature (103)..(103): n is a, c, g, or t
  misc_feature (105)..(105): n is a, c, g, or t
  misc_feature (122)..(122): n is a, c, g, or t
  misc_feature (134)..(134): n is a, c, g, or t
  misc_feature (151)..(151): n is a, c, g, or t
  misc_feature (167)..(167): n is a, c, g, or t
  misc_feature (176)..(176): n is a, c, g, or t
  misc_feature (200)..(200): n is a, c, g, or t
  misc_feature (215)..(215): n is a, c, g, or t
aaancnnatgctgctatacgagagaatccngtctatgaanagaagccngagaaanaagttaaannnnagaggtggaacngtcccgaaatgtcccttnctcagnanaaggatcgggtagctcnaaagaaggcaancttccgcagagctcagnaacgggctgctgaganctaaacccngcgattttctatgattttttcggntatagataataaacntatgaac

SEQ ID NO: 539787 - DNA, 123 bp, Homo sapiens
  misc_feature (71)..(71): n is a, c, g, or t
ggataaaagatttatttttttttctcaggaaaaacagaaagttagggatacacactacattagacaacctnccctgcgttggagtttttcctaacccttcctggcacagctatcaaatgtaca

SEQ ID NO: 539788 - DNA, 525 bp, Homo sapiens
accctccgagccaggtgtgggatatagtctcgtggtgcgccgttttttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacccactggcctgcgcccactgtctggcactccctagtgagatgaacccggtacctcagatggaaattgcagaaatcaccccttcttctgcgtcgctcacgctgggagctgtagaaccagaagctgttcctattcggccatcttggctcctccagaataaacctattttttggaggaaatataaccttttgaaaacaatgatggacaatttcttcggaaggatttaaacccaaagtgggcattaatatggcagggagaattcctgacactgcaagcatgtttctattttacctcaagactccagcttccttgcattca

SEQ ID NO: 539789 - DNA, 506 bp, Homo sapiens
gcatcaacatcagcaaaaaggtcatctacaccaaaaccacatctacaggtcaccaacatcaaagaccaaagatagataaaaccacaaagatggggagaaaccagagcagaaaagctgaaaattctaaaaatgagagcacctcttctcctccaaagggtcacagctcctcaccagcaacggaacaaagtgggacggagaatgactttgacgagttgacagaagtaggcttcagaaggtcggtaacaacaaacttctacgagctgaaggaggatgttcaaactcatcgcaaggaagctaaaaaccttgaaaaaagattagacaaatggctaactagaataaacagtgtagagaagaccttaagtgacatgatggagctgaaaaccatggcacgagaacttcgtgacacatgctcaagcttcaagagccgattcaatcaagtggaagaaagggtatcagtgattgaagatccaatttattgagttaagccgggaagacaaggttagaga

SEQ ID NO: 539790 - DNA, 156 bp, Homo sapiens
gcatttactccatggcatcggcatcggactacatgcaggtgggtggatgggcgtatgaatgccaaatgctgggacttcatgcctgcttccactctcccccgatcccagcttgggccatcatttgagatattctcatcacctcactttttctggctt

SEQ ID NO: 539791 - DNA, 228 bp, Homo sapiens
  misc_feature (39)..(39): n is a, c, g, or t
gcttattcagggaaggggaaaaaaaaggaatggggaggnaatatttaatgggggcatagttttagtttggaatgatgaaaagtttctaaaaaaggagggggggggcttttgccaaaccccgtgaatggtcttaatgcccctgaactggccccttaaaaatgggggggggggcaagtttttcgttatgtattttttcccctaataaaaaaattttggagggcccgttta

SEQ ID NO: 539792 - DNA, 301 bp, Homo sapiens
gatcccttcggcacgtatatcaaaagtgttatggaaatccccagaagaggacaatggaaaggtccggtggatttgctgacgtggggacgagggtatgcttgtgtttttacaggagatggacaaaccgtgtgggtgccctccaggtgtgtgtgaccatggaacgggagaccggagggatccatggtattcaaccgtgggcctgttacctccagtacgagccatgagccagcggaatctgaatgcaaagacagaacaagggccgaccggagtcacaatgacatccaaccccataacatgggga

SEQ ID NO: 539793 - DNA, 688 bp, Homo sapiens
aaactcactgaaagcatgtaccatgtccaggttggataatggcaaaaaggctatgttaaataaactctgagtgagtccctaaaatactatcatgggctaatctaagaaggagacgaatatatatttcccgctaaaattatagcttagaatggtcaaatgcttatagaagacaagttgatgggagtatatagattataacatataagaggattagtagaaactttaataataaaaatgtgaaccatcattttgttaacatgaaagatacatagaataattacaaatgcatcccagtggttaagaataagaaatgttaggatataatgtacaaatgtgtgtgaactgaaagtgtgtgtagataggacagtaagagaacaatgaactatatgagtagaaaaagcaaggaagagagaagaagcaaagcaaagaaaaagaacagagacaacaacagaacaaaagaaagaaaacagcgagagaaaaggacagacgaagaggaggggaaagagaccaaacaaagacgggggacgagacgcagacgagatcacggacgagaacgcaaggcggagcggcaacaaagggatcgaagacgcaagggcggaaacagcgagaagagaagacagagcgggcgagactctcggaggagggagagaggagacggcgaacaggcaaacagaaggtggaggcacgc

SEQ ID NO: 539794 - DNA, 126 bp, Homo sapiens
tgagagtctgtggcctgctgtgctggatgaccgaggcgcgcatggcacagctgcagtcctttggttcctatgcaggcagattgtccaggggaggagtgacacaacgtcaaccgtgaggcagctgta

SEQ ID NO: 539795 - DNA, 350 bp, Homo sapiens
agtggtacggggtaacctgtggcgggcgccggtcgagctcgccgggtttgcctttgaactggtactcgcgccaggtggcggcctcgttgggaaccggggcgtcggtgccttcgatcatgagctcgtcgcgttcgcgggtcacggatccgaaagcgccgtacgtgttcacgaggtggaggggatcgaagctcgcgttcatcatctgcgagccgctcagaagattgagcgtgggcttgatgctgagtatcgccaccacggcggccagaccgaagaagatcacggagggccaggccaagctcgcggccgccgcggggaggatcgcgccggcggtgccgaggaacatggcgagg

SEQ ID NO: 539796 - DNA, 418 bp, Homo sapiens
atttcattttatattaccagtacaagtggcatttgttagtaccacattctttttgctgcttttattttatttttctatttgcttacatgtttcaactagagtgagcataccttttcactgaacttgttgcagtttctgcttgatctcttcttaaatatttatataaagccttagggtaattccaagttctgaagattcaagttgtcaatacatagtttcacattgttaattagcatttctccagtttctgtcatacttgaagcattaagcaagtaaataataatggtgaataagatttttttctaaaagaagctttccagttgggcctggtgactcatgcctgtaatccaagcactttgggaggctgaggcaggcggatcacttgaggtcaggagttcaagaccagcctagccaacat

SEQ ID NO: 539797 - DNA, 297 bp, Homo sapiens
atattatatatgcatggcatcctcgggggttcgcagtatgacgctgaagtgatgaaatgatgtcctctggccgactgctaatacaaagtgctagaaaatacgaatcaggagctgaagactctgattagtcagtgtcagacaagacagatgcagaatattaatcccctgactatgtgcctgaatggagttatagatgctgcagttactggtggcgtttccaggtatcaagaggcattctttgtcaaaggaatatattcttaatttcttcccctgaaggattggggaagaaaactttga

SEQ ID NO: 539798 - DNA, 410 bp, Homo sapiens
  misc_feature (45)..(45): n is a, c, g, or t
cctgtattacttatgaactatttccagttcttctatatctggctngttctccagcgaaagatactaaagttgctcttggtcttcttttcagaggtgcggtttgatgattacgcacaaagagacaaagataatgagtgggggtagacctgctagctaaactttttcttttagagaagcacctaaggtgatctgtcacatggatgactctacccttcttgtgacggtctgatatgaaagcagattggactacatactgcacaaaggcattttaaacattgcaggtgtgaatgccccaaataacaatactttgaacttttacagaacctttcatccagtgataccaaaacaattcagttaataaaaggcctaggaagctggggacaaaacatccaattgatctatatatggaa

SEQ ID NO: 539799 - DNA, 634 bp, Homo sapiens
gtgatgcaggtctttctgagctcaaggcgtgaaagatgaatacaataacaaccatgaacccacctcacggtaagcttttttctgcactttgaacagaatgtcattgcagttggaggtgttttgtccatggtaaacagtttattaatatagaaggatgtattgggagaaggaactggatatctctcctgcagcccagcacagagatacccatggatcgggcctgagtgggcgagtaaatgcccccattgctcatgggcctgcggagttgtgtgacctgtagatatggcagccatcgcgagtttaaggatactgggcatgagcattgcttcattgggagttcattctgattttacacgtcagctattagtctttaccagttctctgtcgtgtaaagtcgctagccatctatatataaaaacgagtttcgctacgcagcgcgattgtatgtcttagctctcgaggctacgcttctatttccacagtaagtgtcgtgtgctacagacgtagtacttttcccaagataaccagcgaagcgattcagtcggtcagcatgagcgatgtgtgcagcaccttggcggaattagacagttcttgacgcttagccaccaagcactcaagacatggcgtactaaac

SEQ ID NO: 539800 - DNA, 138 bp, Homo sapiens
tctggtctagccgttgtgcgtcaaaaccaacaccaagcgagagcgtatagtgcagcgcagtttccacccagctccatcctctcgccagctctgcggatggtgttacatcacgatgagtgccgcacgtgtggtctgggg

SEQ ID NO: 539801 - DNA, 582 bp, Homo sapiens
  misc_feature (439)..(439): n is a, c, g, or t
  misc_feature (480)..(480): n is a, c, g, or t
  misc_feature (498)..(498): n is a, c, g, or t
  misc_feature (509)..(509): n is a, c, g, or t
  misc_feature (521)..(521): n is a, c, g, or t
  misc_feature (567)..(567): n is a, c, g, or t
atgtgataagatgcttgaacagctcgacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagggcctgcgcgggtgccagggaaactccggaagacttggtcgggttaatgtgaaaagcgggtagtggtcgacttttttcataaaatcacaacatttttgaaccctcttcttcctttgggggangggcagggatttttttgcctaacaaccacccaatccatcgncttttaaatggccccttnaagccacgccnccttcaaggggnattcgagcggaccaggtggagcccttttggttacccaaacttctantttcccgggggcggg

SEQ ID NO: 539802 - DNA, 258 bp, Homo sapiens
tgagtccatataaataaagtcagatatggaccagaggtaaggcatatatgttagagagatacatatatatttaatagctggtaaacttatcaagaaaaacaagaaagtgagtaatatataatacaggaaccatagttaactttgagaggaaaggtaaaggatatcatctgagatagacatgtggaacttgaaaggtactaagaatgatctatttcttaagctgggtggtggatacatggtcttttaattgctttatgc

SEQ ID NO: 539803 - DNA, 777 bp, Homo sapiens
  misc_feature (725)..(725): n is a, c, g, or t
ctaacaggcgccctctcagccctcctaatgacctccgggctagccatgtgatttcacttccactccataacgctcctcatactaggcctactaaccaacacactaaccatataccaatgatggcgcgatgtaacacgagaaagcacataccaagggccaccacgagaccacctgtccaaaaaggccttcgatacgggataatcctattatagttacctcagaagtatctttcttcgcagggatgttgttctgagccttttaccagtccgagccttagtccctctgacccgcccgaattaggagggcacaggggcccaacaggcggtcatcggccgctagatcccctagaagtcccctaacatcctaaatgacgatctcgtattactcgcactcaaggagatatcagaatcaccatgagcgcaccaagtaggctaatagaaaatcgaacccgaaaccaaataattgcaggcacgggtcattacaattttggactgggtctctattgtaccctcctatcaagccgtcagagtacttcgagtactcccttcagccatttccgacggcatcgtacggctcagacattgatatgtagccacaggctgccacgagacttacacgtcattagtggtcaagtttcctcactatctgcttcatccgcaactaatatttcactttacatccaaacatcagtttggcttcgaagccgccgcctgatactgacatgngcagatgtggaagactatttctgtatgtctccatctatgatgagggtcttaa

SEQ ID NO: 539804 - DNA, 122 bp, Homo sapiens
tctttctttactctgttgagctaggtaaatttgggcaaaggtatatctctccatgactgtttactcatctataaaataaaaatgttagccgggcgcggtggctcacgcctgtaatcccagca

SEQ ID NO: 539805 - DNA, 511 bp, Homo sapiens
tgtttattgatgcacaggccggcacaaagtcgctcctggtggcaggtttagaggtgccgagtgtaaacttcccaaggtgctgagtgcttcgtcttcatccgccgccccagcgcccagacccatgcctggttcaggatgtgctcagtaatattaccaatgccctttaagccagctgagcctgtttattcatctgtgatggggtggagaggggtcaaaagccttccctgggaagccacaaggagtagcgacaacgcatgtcaagcttgtgtgcacccgagctgtagatgcaaaggaaatggtgcctgctttcgccagccatgtggcctcacttcagtgtgcctcagttttcccatctgtagacagggttctcaaaagacggccagtgaggtgcgtagcatagttgctggcccctcgtgagtgctggacacttggtagccgttgcttttgttgcagctccttgtaaatgcctcttgtcaattacgattatttgggtggcatcgataaacagcgg

SEQ ID NO: 539806 - DNA, 822 bp, Homo sapiens
gcttgctagtaaggatcatattactggttggcatgtatatcttggttttggcttggtttggacgacggtgagagaaccaagtatacagtactttgtagaaccttggtaattaactcatattagtaggcaatgcaatcgtgggtgtatggcaggagactgcaagatgctgaatagactggcagtcgaggccctatactggaatatgagccgtgaaaatgtggcaaacgtgtatcgacagcgtacagagacagagtgtgcggcggcttaaagctaaagacatagtttcctggtgatacttcgtaggaaactgctagttggtgacaaagcttcctgctgatatcaggttaagttccagtcgaagcctcgtaccagcactgaaggcgttgagcagtcagattcgtcacagcggtgaatcatgctcctcgtgtcatcgaaagcagcactgatcccgttgccctgtacccgacgatgctgttcaagccaaggagtaaaaagaacactgcttgtgctgctcggtagcaaaaggattgcgtgcttgggacaaacgcttacttggggaacgtggctgggtatgactaacgtgggaagtttgatacagcgaaacatcgtgcaacaggcattcctggcgcagtggacaatttgggtgtgccgacagctggacacaagggcagaagagacaatcccgctttcaggctaacccacgcgtaggcatgcaacgtcctgcgctgacacaggctgtttccaccacggttcatcatcccttaattttgcgatgcaggccttgggattcatccactactggggcactccaaatgcccccgc

SEQ ID NO: 539807 - DNA, 367 bp, Homo sapiens
  misc_feature (49)..(49): n is a, c, g, or t
  misc_feature (119)..(119): n is a, c, g, or t
  misc_feature (159)..(160): n is a, c, g, or t
  misc_feature (198)..(199): n is a, c, g, or t
  misc_feature (211)..(211): n is a, c, g, or t
  misc_feature (242)..(242): n is a, c, g, or t
  misc_feature (262)..(262): n is a, c, g, or t
  misc_feature (305)..(306): n is a, c, g, or t
  misc_feature (334)..(334): n is a, c, g, or t
  misc_feature (338)..(338): n is a, c, g, or t
  misc_feature (361)..(361): n is a, c, g, or t
  misc_feature (367)..(367): n is a, c, g, or t
cggcacgagagccttaattagggacctgtgtgaatgggtccacgagggntcagatgtgtcttacttttaaccagtgaaattgacctgtccgtgaagaggcgggcatgacacagcaagangagaagaccctatggagctttaatttattaatgcaaacanngcctaacaaacccacaggtcctaaactaccaaacctgnnttactaagactntaccaggcgcgaactactatactcaattganccaataacttgagcaacggnacaaggtaccctatggataacagcgcaatcctatatctagagnncatatcaacaataggggttacgaactcnatgntggatcaggacattcctggtgcngcgctn

SEQ ID NO: 539808 - DNA, 692 bp, Homo sapiens
agtctgtctgtgtatgtgcagaacacagaccctcctttctccgtttgtggggaatacttccctcgggtgaaactgaagttaattttttttttttccaaacacaagcagagtctccttggaggtgacatggatatgggcaacccaggaaccctttcgcccaccaaacctggttcccagtactatcagtattctagcattaatcccggaagaaggctctttacagaaagggcattggggtgccacacagagaaggttagaaaggtccctcaagtttggccatttagagtataggctctttgagcatgcactgccgtctacaatgggcactcgccgggatacctttcctccaaaccggcacccagcactttccatagctccttcttcatgcaagaggcccatcacagcagtgcccttaggagctcctccagtgggatgaatcaccctggttatgcagaaatgttgggcaactcttctaatattcacagtccagcagctactgtagcctgcatccacatgaacgtttgagctatccatcacacttctgagcagacatcaattcaggctttctccgatggccactttccatcgaagggtaccaaccattacagcacctttgctggaccgctcttgcaatgggccagcatattatgcaaatagaggaagcgacaacccggaattcccgggtctttggg

SEQ ID NO: 539809 - DNA, 570 bp, Homo sapiens
tctagaggatctcgtaagtcaccgcgtcacctaccgtcctacagctgcagcgcgaagttgcgcagttggatgccagctctggttctggggaccatgaaccgccctgtcattcccatgcggcggatatagggatctacacgtgaacgatgttgggcctcatacagtgccagggctgtagtgggggcgccgcgatttctatccagtgcgtcggccagcgtctccgcgcccagcatcgccaggctagacccgttgccgaatagcgaagcgcatgacgcggcatcgcccaggagtgcgactcttcggtctcgccaacggggcaggctcacgcgacatactgcgtcgaagtagacatcctcggtatctgcataagctttgagcagctcctcggttctccaccgtccaccggcatagcagtcctgcagcagcatgcgctgcgcatcgacatcggtgtgtcctacccttgctccactgcggaacaggaacatcgctaatgcagaccctagggcagggtgtacgacgagtgcacgatctggctcgttatagatgagtacgcgggtgaccttcgggtac

SEQ ID NO: 539810 - DNA, 214 bp, Homo sapiens
gaggatcccaagctccaacaagatatcacagttgtatgtctaccaacatagatacatttttgtctatatgcaacctttttcatgtctgctttctttcactcagcttcatgtctgagagattatgcatgttctgcatcataagtagtttgttaactgtggaaccagtttccattgtacgagtataccagtttatgcatctcttgttggggagctt

SEQ ID NO: 539811 - DNA, 275 bp, Homo sapiens
ttactttcccctgaaagtaactatgtccaggaatccaagacaaagcagaaacaacagtggtagcaatcagtgctatagttacatttactgtacagcaggggtcaaggaaagctttccagaggagtgaaggtgcagcagctgagcctgagacacatggtttgaacacagcaaccagttaatgccaggggtggtaggcagtagttataaacagaaacaaaccacggaatttgctcgggaacaagtagatcctaatagtaacctatttaactagcatt

SEQ ID NO: 539812 - DNA, 761 bp, Homo sapiens
catacggaactgtaaggtccattaaacctctttcttttgtaaattgcccagtcttgggtatgtctttatcagcagcatgaaaatggactaatacagtaaattggtaccaggagtggggcgttgctgaaaagatacccgaaaatgtggaagctactttggaactgggtaacaggcagaggttggaacagtttggagggctcagaagaagacaggaaaatgtgggaaatttagaacttcctagagacttgttgaatggctttgactaaaatgctgatagtgatatgaacaataaggtccaggctgatgtgttctcaaatggagatgaggaacttgttgagaactgaagtaaaggtgactcttgttatgttaaagagactggcggcattttgcccctgccttagagatttgtgaaactttgaacttgagagagatgatttagggtatctggtggaagaaatttctaagcagcaaagcattcaacaggtgacttgggtgctgttaaaggcattcagtttcaaaagggaaacactataacaaaatttgaggggtgcatttaaagtttggaaaattttgcagcctgacaatgcaatagaaaagaaaatcccattttctgaggtgacttgggtgctgttaaaggcattcagtttccaaaagggaaatactgtaaaccaaatttgaggagtgcatttaaagtttggcaaattgcacccggcatgccatgaaaagaaattcagggccagccgggaaccccactgttatcc

SEQ ID NO: 539813 - DNA, 1062 bp, Homo sapiens
ggttccgtggcgctgcgggctgcgggagggtcctggcctgggctgtctctgcgagcctggagtttgcatgaaactttacacctgcgctccggggagactttcggtccggctcccaccgtgcgcctcgccgcctcgctgacctgtgggctccgtccaacccggccgacatggactgtgctccccatgtgcagcatcttccagtgagctccagatactgtgcacgaggacctggctacttctcgtgcgctgccgtctctggatggatgtacttggcaacagacctgcctagagctggaacgttacctccagagcgagcctgctatgttcagcctcagaaatcaaatttgacagccagtgaagatcttgtgggaccaaaatcattcttggctcgggagaaaaagtgaggaatccgaactgaatgatatcttccagtcctccagaggacactctcattcagtccgagctttttgttacaacttagatgaccaacagcctgaactacagatgtcagcagctgaatcctctgaccatgcctccgaggaactttctcctcactggcaagtttacctccgacccattgtgtgaagttttggtacagcatcgtgtgaacatttggagctcctctgtacctcccaatgcctccatacttctcctggaacttgagcattggaaccttctcaattgtgtgtgtttgctgtgccgattgagccttgcctcgccaggaacggtgcgccgcgtgccttctttcggaactccatgttgatatgtgacatgggtgattccatcccccgactgagtgatgatgtcttccctgtgtgcactttacgtgctgcgggaacgttaccccagagccccactttaatgcaatcatcgtgactaccaggggaaaggccttaccggtctcttgaggtttagtgcgttgcagagggtgactacctgagaccaatagacgtgccgctaattacccgtgagtttttcggttacacagggcctagataatggatgggcatgctgtacaagtcgagaaggcggagtgtccccacactccccacgaaactcgaa

SEQ ID NO: 539814 - DNA, 126 bp, Homo sapiens
cgtaccagtccttcgatcacctcagtcgctctaagtgagcgctgggctccgagaacggggctgttgcctgctcccggacgaggggcatgcccagtgaagtgaaagctggggctcagggcccgagag

SEQ ID NO: 539815 - DNA, 345 bp, Homo sapiens
gctatccatgtaaccgagtgataactgattctgtggacctgatatccccgtttggtaagtccttctgctgagctgtgtctctcggctctcatggcctaaccattattcaggagcatcagaaagccagaccaggagtgacttcctgctggatccaagcaggagttatagttaccctagacaaaagacgcaggcacaccaaagagaacttcccagcaccttttgattttgatggctgtagctctggcagcccactgccagtactcagattcagtagcgcgtctttgttgtccaagtagcagcatcttttgggagacagatgtaatctttcagctggttacaagcagg

SEQ ID NO: 539816 - DNA, 177 bp, Homo sapiens
ggatcactgttccaggagagtgctgcaggcaggtccaggctgggaggtgggcagtgccctggcccaaaagtgccagggaggtttgtatggttggcggcagcaggtgagaaatctcctctggtgagatccagatctgcctgtttccggtgcctccagaaggtgaccgatgagcgcgag

SEQ ID NO: 539817 - DNA, 308 bp, Homo sapiens
cgggggtcccatgatgatgttccagtctcaggtctcaactaggacctcatacctaacagtgtttaaaagagtattccgggcccggcacggttggctcacaccacttggggaggcagaggagggcggatcactcgaggccaggagttcaagaccagccgggtcaacacggtgaaacctcgtctctactaaaaatcaaaaaattagccaagcatgggggggggcgccggtaatcccagcggctggggaggctgaggcagcagaatcacttgaactggggaggaggaagttgcagtgagccaaggtcgagc

SEQ ID NO: 539818 - DNA, 105 bp, Homo sapiens
agcaggacccgagggctctcggtctgaatctctccattttgttgggagaagactaaccatctctttactaagttctagctcaacttctatttcctgcgcgacact

SEQ ID NO: 539819 - DNA, 130 bp, Homo sapiens
tggctggaagatcctgcgggtggggcttggggctcacacactgtagcacttactggtaggacccagcatcttgggggggtgccgtgagtggcaggggacaggagtccactttgtttcgtgggaggtctaa

SEQ ID NO: 539820 - DNA, 756 bp, Homo sapiens
  misc_feature (105)..(105): n is a, c, g, or t
ggtgaccaccatttccgacccgggcaagatggcagcggcgctgcgcgtgcgtgtagagtgtcgggacgcgggcctgcaggcgccatggtcttcctcaccggcagntctggctgggaatcgggtcaccggaccgtacttgcggatccaggaggtgctgaagcacggccaggcactttccggggggaaagggaaaaatcggctgctacgaggtgggcgggtcagaccccgtgatgcgagccttgtgtggaatgcaacccaaagccggatacctgaaagaaaaaaaggacctatggaggaccccttcctgattacttcgaataacacgtgctacgccgagggaacgtggccctgaagtatccacgcgctcatgggggaatttgaggtcaggtgccagggtgaggctcaaacaggaaacgtccctaaggggggatctgcgccaatctacgagccaaaaagactttccaaaatcttgtgcgctgccttgtgcccagttggaggcgacacgaagggatttgcttgctgcctgtgggggggatgggaaggaacctgaaggccattttttccagaggtggtggcagtacccactgaggactggtggttgtatggattaggaccagagaccagggtaattgggagttggtggataatactttgtgttttatctacaacccaataacagacttgagggatggcctgtctcccgtgggacgaggcttaaagatgatggccatgttgggtgttgatgaactcaacctc

SEQ ID NO: 539821 - DNA, 751 bp, Homo sapiens
tggaaaaagtcatggaggccagtggggtggggttgaaaccagcttgggggggttcgatcccttcctttttggtctaaattttatgtatacgggtttcttcgaatgtgtggtggtaggggtggggggcactccgatatagtctccacctccgagggtttagtgggagggttcttctacttatataggatttttcgctatcgaaagcgagaggcttctcaaactcagtaaaaattattaatatacacgtgcgtgctagagaaaactgaatgagcctacagatgagtaggatgttacagtggtgggtgtatgcatcggggtagctccgagtaacgtcggggcataccggataggccgagaaaagtgtggtgggaagaaagttagattaacgccgagtgaaatatgatagtgaacgggcatttgggcgataggttgggtctagggtgtagcctgagaactaggggaaatcagctgaatgaagcctcctatgagggcaaatacagctcctatggataggacataggggaagggggctacaacgtagctacgtgctcgtgtaagaacgaggtcatagagatgagttggataaatacaagtgccagcaaggcccctcttacggtgcacacgacagagaaacctagggccagagacatggagcagaatcattcaatatggctcccgggaggtgtggaacacagcaaaatactcggacgcggggggaaagagagaataagacgggagggaaaaaccccga

SEQ ID NO: 539822 - DNA, 429 bp, Homo sapiens
  misc_feature (20)..(20): n is a, c, g, or t
  misc_feature (89)..(89): n is a, c, g, or t
  misc_feature (121)..(121): n is a, c, g, or t
  misc_feature (150)..(150): n is a, c, g, or t
acttctgaagccagtttgcnttaaaacttttgttcaaccattcagaagaatttatattgggagagaaaatccctaacaaaatgttaatnaaatgtggaaaaacctctgttcagaaactgcnaggttaagaaaccagaggccaggcgcggntgctcacgcctgtaatcccaacactttgggaggccaaggagggtggatcacctgaggtcgggagttcaaggacagcctgaccaatatggagaaacctcgtctgtactaaaaatacaaaaattagcaggacatggtggtgcatggctgtaatcccagctactcaggaggctgagacaggagaatggcttgaacccaggaggtggaggttgcggtgagctgagatcgtgccattgcactccagcctgggtaacaagagtgaaactctgtctcaaaacaaga

SEQ ID NO: 539823 - DNA, 313 bp, Homo sapiens
ctacttataataattaatattcttgatttatattgtaaatacatcttaaacaaatatgggttactcgaattaaacaaaatggtcacatgataactagcattttagtacagataattaaaatgtatttatattatatagaaatctacacaatggaagatactactaaaatgttgctctacagcacatcaccctagacaaaatagaattctataattctctttaaaaaaaaaaatcactgagaattagatgatgactgtgaactaggttctcccattacaatactacttctgtcattcaaagttctgaccacggg

SEQ ID NO: 539824 - DNA, 1354 bp, Homo sapiens
gaccctgaactttttgaaatctgtagatctctagcaatagttcgagtatggtgccatggtctaagcccactagctgtagtcagaggatgctatcatctaggacataatctctacgctgtccgcgcgctctgtcttttgtgtcgtttccgttcgtatatagacgatcaaatatgtatgctgggagagcggttgtcatgccacaaccctacgatgtgcagccaaggacatgtgcatgtcttggactcctcgcgttaaggattcatccatagtacttgccccttgaaaaatctatatcaccagtcattaattcgaaaacttaattgaatacacgcataaagttatcgctggactcgatgccactgactacgttaagatcagacagtgagagtgagagcacagcgtggtgctacagcaagctgcgtttcgttccaaaccaattatcgagtcccactctaaagaatgctcatagtcaatgttataacgaatgctgggctattaattcgtgcttaaatccaaatggccccttgcgttcaaacattctgagtccagtatagaaggttatagcggtatagatcttgttttaaggttgagactctaaaggtgtctgtggtgttcgccgtatttgtggatgtccagactggatggtggatgaattcgtctacaagctaaattttaggaggtgtagtggacaatgattgacgcgtgacttggtttctaacctgtgtaaatggtacaacggtagaatctcttgaaagaaaattattgggatcagcgagcaaaagttattttgggaagtgaacaccgcactcctagttcctccttgtcttaatcgacaaattaagcaagaacaaatatcagatagaggcgggccatttggactcgctgtctagttggttggcccccctcgataacaacttcgccttggctctataaccaattcaaagcgaatgggccttgaaagaggacagaatgcaagaaaatttggtcgtttggaaagggccaagagggaaggtggccattgaaagtggattagcgccacgcgtgtggacgcccccagatggtaggtcctggatgccccaaaccaggaagcaaacgtcctctaggtgtgcctatgagtgattgaccacgagacgtttgaaacactttttggcccgtccaacgaaaaaactccattctagccttctagctgacaggcctcagagtagacagtttatactgaatacgagtgacacacacattattttgagaagctaccggacacgctccattaaagaagggtgatactttatacaaatacagggggagtgtagcacacctttgtggtagcgcaacatagttaaagaaaagaagcctg

SEQ ID NO: 539825 - DNA, 1215 bp, Homo sapiens
tgtgcggcaccaggcgtcccttcagggtgctcgtgtggtgtccttgtcatgtgtcgtcgttctttctccgtgttggtgtcacctggtgcatcgcgcagcgtccctctagtgtggggcgttccctgtccctcctcgcagcatttatatcggtcgcaccactctggtcatgtgctgtcgcgtgtgtggcatctgttgcttcgttaccccgaccggggggtttgtctgcggggcacgttccatgtctcagtgctttttccaacgcgtgttcccacgggtgccctgggccccctacggggatcctgttttggggaggatcggtcccgtggctcgccccattggcgtcgcgtgttgagtgttggttggtgacgggtgccgaatatggtggttggacacagggggcgctcctgggtggtgaagacacgttgttggaaaccccttggttgtaccggtggtgttgccgttgatctgccggtcatacacaacttcccaggagtaccgcttgcgtcactctggggccctggtgctgtccaacgccgctcccccacgtgtgctctgcctgctgggctcttaactgttgctcgaagactgtgacatcagaacggtgactcccactcctgaatcaagagttctctccagcctcacagagtgctgcctgattggcacctgcctagctcttgggcctgacctgccagtcctgctggcctgctcgttacttgcccccagccctggcgtttggcccctggaacctttgccttgcgtgtaccacaccctgcctgctttggacgccccttgtggacgacggctggcgtggggacgaagtgcctcccccgtgaggatcccctgtcaccctggggctgtgtggattggccagaatcctgggcccccagagacctttgcccacacacactccttccccttgtccctggggcactccccctggattgtgccattatgtccacgagctgtcccttttctgcacggcggactgggccactgggtcctcggcccatctgatccatccctcctctccatgacacagtgctgatttgggcaggacgtcaccatgcaatgggtgacatcgaccaccaccgtatccaaggccacccccacgctgctgcccctctgcctgcctgtacagaagcaactgaatctttttcatattgtaatacatccatgggagttctttaatgaatacataataacaatgaaagcgac

SEQ ID NO: 539826 - DNA, 129 bp, Homo sapiens
taattgttcaaatttttattttaatggacagtatgagaaatggacttttttaaatcaactgatttgtatgggaaatggcacgggaaataaattagggccatggtaaagcggagggtcagctaaatatcc

SEQ ID NO: 539827 - DNA, 198 bp, Homo sapiens
cctaccagcggtgatggtctcgatctcctgacctcgtgatctgcctcttggctcccgggtgctgcgattacagacgtgagccatcacgcctggtaaagcagagaatttctataaacctgggaggtggagtgttgcagtgagccgagatcgtgccactgctctccaagcctgggcaacattgcaacaacggtctcctca

SEQ ID NO: 539828 - DNA, 641 bp, Homo sapiens
atcgagtcggtaccgattacgctcctaatggacatctggcccaatgccctagcgtattgtaaatgctcagttgagccaacctctcagggatgagttccccacccacccatgatagtcagaaccaggtagcccctgtcaaggctccacccagtgccctacagaaacagaacatgagctttaatttcagcgagaggctgagaaggcaggcctctggggctggcagggagggtgtcagccagaggctccgtgtctagcgggcagcagaggaggtgctggcaaggacagcaagctggctggaagccctgactgcaggaaacagacctcaagcagcactccctgggggcaggaccctgccattctgtgctgtttgggggcagtttctaaagccttaagaaaatagcttcctgtctcaggctttctaggaagtcacaaactaggtgtctgggaggcagttttaggtaagtgcacagcccaagggagagctgacccctgtaccagacagagaccctgacagaagggacagcccagggccaggcacaaagggctccagctcaatcgaagttggtcaaacagggaccaaggagacagttttcttcaaggacaggaagaaatctgttgctatcctgtgtaccccgaattca

SEQ ID NO: 539829 - DNA, 616 bp, Homo sapiens
atacccaaaagccgagaagaactgtaatagtaaagttataaaaataaagaattttttcaaggttaaaaagctgaaaaagaaataattttatataagaaagaattttatatggtaaatttagtcctaaaataaaataactggttgtttaacaaggagggatgttcaggacaaaccagaaagtccaagcatgtcatgaacattggtgtaagtcatgataagatttatatatatatatatacacagcagcacacacacaccccaaaagcttttatataatcaagttgtcatattattattaagtcgggtttgcttagggaagaaagagctaatttttaaaaaatcaaggttattacatccatgtatcttcctgtgtatgctttaaagtccttgtaaacattgagttacagggctttaactcctgtgtctgaaaaatcacaaacactgtatgacaatcaaagcctcatcttaaggccccgtagaagatgccaatcaaaataaagtgcattcctgaggcactaggcaagaaattaaagctattcagatcctcaaggcccagggactattgcggaagaggtgggcgcgtaagattgtaagggccgattttgaaggaatccag

SEQ ID NO: 539830 - DNA, 163 bp, Homo sapiens
aagtaaatagaggtaccctgaaaatagtgaagccaggtacttctcttataacagtagagaattaaagcggcgtggagagagacagctcacatatgactttctattggctgtgtgataggacccaggtcacatgaggtaggggcttgtcaacgataggcccact

SEQ ID NO: 539831 - DNA, 212 bp, Homo sapiens
gtttccccgggacccatgtaccgatatgatatagtatactgatggtgaaatacacggatgtcacaaatactggtcgactgcgacaaatagctgtttattagctttttaataaagcaaaactttatagtgaaataaactcagaaatagctttttattttttcatatatatttatttatttttgagatggggtcttactctgtatgggggatct

SEQ ID NO: 539832 - DNA, 364 bp, Homo sapiens
gagaggttgctgacttttagacagaatggactctggcctcctcagcctttgacgtctcgcctggaagagtgtctcactctgggagcggtgctggttggttggaaggtgttctttctgccctgtccccctcccaaattcttctctcgtgtctgtctgctctcctaatcaggctcgctcagctggccttcagaaggtagcaagtgtctcaggggccgctgggcgtcttcctgctggccctgccctgggactggagctcagggggttggcctgtaagcaagagcacctttctgggtcattccaagtactgaggtccctgggccctctcctcccgtcccattttgggggcaaggagcctgtgggcagc

SEQ ID NO: 539833 - DNA, 978 bp, Homo sapiens
gcggtcaacatgcccggctgcgtggaccacgttgcccgtcgtgcaatgctgccgcccaagtgtcatgagaccgctgatatcatcgacgaggaaggttcttatgtccttggtgatagaaatgggatttggaccgcatcacggacggctgcgccgaagctctggtctggggcacataagcgagtttgattagtagtgcacggacattcgctgtgcaaacagcatgcccagcaagcagtgagctgttgactcgatcgaagaggcaccggcgacagaaatcaataccctcccaagctgcttcgggcgtgaattaaaagaaacattcccttagacacagtatctcacttttcagatcgttgaaaggtttgagaacttggaaacaaagtaaacgtataaagcttggtacaaatgggactttaaaacaaaaattgcttgccacgtttcccggtttccctgattagtaggtttgacgatcggtgcggtagccctgtgaccagtttcgagcccaacccttcgccgtatagctgctacgccttgacaccagtaagtcgtaacgccttacacctaggggtccgtgctggatccgcgggtatgctacggatacacaagaacgtcccgttgtggcgcactcagcgtattcattcgcaagatggccttcaaagaccttgggatgtcagcgaattcattttgagagttccctagtgaggcccaaacacctttggcgcctctcaaaagtgcgctctggccggcggactcgtcaggcgggttaggcaattcgggctctctctcccagacacctggcaccccctggaccaccgtgggccaattttcgaagcaaatttgtacccgcaaggggttggaccaacgggggatcatccgagacctttggggcgacatttacgagcttcgggggacatgggggcctggtgggccacgcccgtcaccgacaccatatggactctcgctgcacatatacctcta

SEQ ID NO: 539834 - DNA, 142 bp, Homo sapiens
gcacaccaaactacgttgtgctgctaaagacgtgtgatttatagcatctgggcattcacatccatgaagtaggaatggggctctgcaccaggcggttcttcttggtgttcctcttctcctcttctgaagagggaggcagcag

SEQ ID NO: 539835 - DNA, 129 bp, Homo sapiens
  misc_feature (3)..(3): n is a, c, g, or t
  misc_feature (13)..(13): n is a, c, g, or t
  misc_feature (64)..(64): n is a, c, g, or t
  misc_feature (108)..(108): n is a, c, g, or t
aanaatatatcanaaaggccaggcacggtggcttatgcttgtaatcccagcacattggttggcnaaggcgaaaggattgcttaagcccaggagttggagagcctgggnaacatagtgggctctgtctct

SEQ ID NO: 539836 - DNA, 720 bp, Homo sapiens
tccggctattacattttatgcttaaggctattattttcaggaatttgtaaaagatatcgtttcaaaaagtacacgccgatggcaatgacattttcaagctctatttaacccttcatttatggaagcaaagcctgatgttcttctggagcgacgaccgctctagaaaagggattctcccggcctaagggcctccagccaccagcagctgagaatcagtgatgttcggcagtcacgcctctcagacattataatgcaatgatgcttacgtcgggatagagtcaagtgatacaggattcgcttgaagttcagatctatgcaactcttctacaattgatctccaaatcaaaaggcatcatgatcgtgttcagctgttctaacacaagaaaagttcgccaaaagagcacctgtcagttgtcaaggaatatattccagccttagtaatggagcatacataggttgaatataacaaaaccttgtttatcatggagtgtatacaggtggattcagcaattcaagatctccttagtctttatcacatgttcttttaaaagctatgtctcaaaccattaggaatactttaataggtaatttgttcaaaagttttaattatgtttttctatttggatggtgtaaagccaacatcctgtctttcaaacaccaaatacataaatctttcggcctctgtatttagtgtaacatttaataaataatgaaaaaatt

SEQ ID NO: 539837 - DNA, 200 bp, Homo sapiens
  misc_feature (2)..(2): n is a, c, g, or t
tncaaaaaataaatttaaaaaaaccagcccggggtggtgatatgcgcccggttttttcaacaactttgggggcttaggggggaggattgctttagccccggagttaaaaactgcagtgagctttgatgggacccctgccctaaagcctgggccccaaagcagggccctgtttcaaaaaataaaataaaaaaggggaagga

SEQ ID NO: 539838 - DNA, 111 bp, Homo sapiens
tatcgagctggaccttctcccacctcctgctcactgtctttttcctatttttttttaatgagatgggctctcagtatgttgcccaggtggtcttgaactcctggcctcaag

SEQ ID NO: 539839 - DNA, 83 bp, Homo sapiens
  misc_feature (2)..(2): n is a, c, g, or t
antagcgggccggccctaactaactaactaatgactgcgaagaaagacgacaagcaaggggtcgaacgtgtcgtacgtgtatc

SEQ ID NO: 539840 - DNA, 908 bp, Homo sapiens
gctcggtttttttttattatcttttaacctcgggatctgtgttaacagttatgtaaaaaagctctaaggatcaggtaagggtttcgatggtgcttctctgtgagcagtctggaagaaaagaatagaaacagaaacccctatggggcctcagtacaacgctaggttggagctcgtgcacatgcgcatggaggcatcgggagtcaagtggcatgagaatgcatggttccacagccatcagcctcgaggtggggatagacaggaaatagacctgatgcgttccgtttgacgacgcacaccttggtggatacgtactggtatcccagggcggcaccaggttcgacttacaagccagatgggcggaattcgtggggccagggtaccatagcaaggctgttactagaaccaattgggataacacctaaatccccagtttagaccttatgtcctccaagggatgtcccgttgctatgtgagcgccctttttatgagagactcgctggatagaatggagttacatacgcggggccccaagccctgatgagaacagattcattggcccccgttggtaacagaaaaggcattctcgaaatggcgccgatgtcctagcatttgtattggacatctggggccaacagatttcaaatatgaagccctgtggaatatccactaaaattgatggagggttccttggaagactcggggtttagctacccaatcggggggtaccctgtggtaagaacagttcggagcaagggcatcggcacattgcaatgcaccacaagggacctaactgaaaggatcgaaggaaagagggtgaagtcacccgggaacttgaaaagaagggcggggtggaacgacgcctcggcggaggtggagccaacgcacgggagctggatcccaaaaaccca

SEQ ID NO: 539841 - DNA, 106 bp, Homo sapiens
  misc_feature (99)..(99): n is a, c, g, or t
caacacaatagttgcagatcaacaatcatcacctgccttttgtagaaaagaaaaccaaaaaaagtaaataaaaattttaaccagtaaaataaaagtttncctgcta

SEQ ID NO: 539842 - DNA, 441 bp, Homo sapiens
acagatccccgctcttgaccacgtgtacacatagcgattcgcttctgcaagtgtgtgggtagctctggcagctggcgcccataggctgggagagaagcaaagtcctccccgttgctgagaacagtgagggtgggaagcatacgacaatgaggttgacgcgtacgtgtctcctaagggagcaagctcttacagaggagttagggataccattagcagtacagacctggtacaacatcgaaataacaatcacctatatatgtccctatagtgacccttgtcttgaccattaagggccctatccctgtctgactctgccttcttccccacgtgagctgggacgcaaattgtggcatgcggatcccatttcttgtgtcccttttggaggatccggctccgtcgcgggcaggaggcccgatttggtgagggtgctccgggtgtttc

SEQ ID NO: 539843 - DNA, 243 bp, Homo sapiens
gtcgactgatttcaagaccattatgtggcacacagcaagaccctgtcatgtatcaacaggcagaaagtgtatatgggttgtacaatattggacctatttctcccattaccagattagagagagaccatgggatgacagctgacaaatttcaattcctcatatttttgaattccaattgattaggatatgttggcaatattaatcttcatattaagagatattaaggaaaagtggttgttactt

SEQ ID NO: 539844 - DNA, 190 bp, Homo sapiens
gacagtatagcgtacattctgtgcaatcaagaaatttagcagctgggcacagtggctcagacctgtaattccagcactttgggaggccaaggcgggtggatcacctgaggtcaggcattcgagaacagcctggcccacatggcgaaaccccatctctactaaaaatacaaaaattagcccggtatggagg

SEQ ID NO: 539845 - DNA, 437 bp, Homo sapiens
gcaacgagcggcgcaaaaaagatcaccatctttacggacgccaaggagtcgagcaccgtgttcgaactgaagcgcatcgtcgagggcatcctcaagcggccgccagaggagcagcggctttacaaggatgaccagctccttgatgatggcaaaactctgggcgagtgtggcttcactagccagacagcacggccacaggcccagccacagtgggcctggcttccgagcagatgacaccttcgaagctctccgcatcgagcccttttccagccctccagagcttccagatgtgatgaagccacaggattctggaggcagtgccaatgaacaagctgtgcagtgaggcctaggcctaccccctagagacccatttccccaataaaaaaaatttggctgtctacctgattgacttttctgttccctcttgttcacagaac

SEQ ID NO: 539846 - DNA, 330 bp, Homo sapiens
gcttattttccttctttttgctgccacgcaccttctgccagctgtatcctggacccctatcttcaaggctctttgatgctgatcatgaatttcaatgaaagaggagacagcaaaactgatagagaaactggacatcaaactgccagtatcattttttcacagaactagaacaaactatcctataattcatagtagaaccataacaaagagtccatatagcccaaggaatccttagcatatagaatcaaggctggaggcatcacattttgcaatcttcaaacttataggctatagttaccatcacatcatgctactggtacaaaaacaggc

SEQ ID NO: 539847 - DNA, 548 bp, Homo sapiens
  misc_feature (20)..(20): n is a, c, g, or t
  misc_feature (491)..(491): n is a, c, g, or t
cgggaacgccgccgcggganaacatgccttcatgggcacgaacacgccgtggtcccagccgcgccgatcgttcgccgcactcttcaccccggcggtaccgaggagttcgcggacacgggcggcaagctccggtgcgccggacgcgggccaggtcagccggtacgtgtagccgggaaaaccgccgtagtcgaaaagcagcggcggagcggcacccacgttgcggtcggcagcgcttcctcccagtgtcccgagacgataggatggtcgatggggttccgcagcgtgccggcgaaattccgcagataggtttccagctcgctccaggtgaggctcggtccgggctcaagaaagaacaagggccccgccgtgattgatgaagtaagttggctgcatacggcccatagtgggggcagccgcccttctgcagaagagatataattccgctctttctatcggtttatatgatgtatggcgctcggcaaccttagccnggaccaactgcgtgtgttggtgacgattgcggacgtgggcagcttctcggcggccgc

SEQ ID NO: 539848 - DNA, 656 bp, Homo sapiens
tgtttatttgtttatttattgtgtgtgtgtgtgtgagtgtgtgagtgtgtgtgtgtgtgtgtgtgtgtgtgtgtgtgtttctctctctacaaaaaaaaaaaaaaaaaaaagcgcacacacaaaaaacaaaaaaaacacaaacaagaagagagagggcggggcgccgccaaaaagaataaccgcccggggaggcgcggcacacctagacaagcagcacccacaatattatctagtgaagaaagagaggaggggcaccacacagagggggaggaggagaaaaaaaaaaagaaaagaaggagagcggggcggcggacacaacaaaaaaaaagggaggagaggggagaaaagaagaccgagaagaaaaggaagaaaggagggaagagagcgcccacacagaagaggaggggagagagaaaaaagaggagagggaaaaaaaaagagaaaaaagacacaacacagaaagaagggacgaaaaaacaaaaagaaaaaagaaacagcagacggggggagagaaagaacaccaggagaaatgagaaaggagagggacggagagcaaaacaggagagcagagaggaagcgggatgaaagaaaacaaaaaagacaaataacacaaggagcaagaaaagaacgaaaacacaaaggagggaaggggaagc

SEQ ID NO: 539849 - DNA, 294 bp, Homo sapiens
cggacctctagacaggcagcctcttcagctgtggagtccagcagtcacgctgtgttctcctggcgctcctcccctaagttattgctgttcgcccgctgtgtgtgctcatcctcaccctcattgactacagcctggggccaggggtagtggaggctggcacagcaatcatgttctcttcaccctactttgatttctgctttttctgtctcccttccaacctgtccccttccccccaccaaaaaaagaaaaagacaaacacaaataaaatatctgagcggaactgtgaaaaaaaaa

SEQ ID NO: 539850 - DNA, 82 bp, Homo sapiens
gggcagtgttcagaaagacattaagaagtggattgatgttgttccttttttgaagttgtcattaaagtagtgtgcaacaacc

SEQ ID NO: 539851 - DNA, 159 bp, Homo sapiens
gctgacttggtaagtacaaatccttaagcaaagtatgaactgactcagcactcctagtaagtgaccagattcagaggtaccctgaaggacacagagggcaatatcaggtgtattttcgtggctacaatcggtaagggtggcccagagagcctggaattc

SEQ ID NO: 539852 - DNA, 297 bp, Homo sapiens
  misc_feature (9)..(9): n is a, c, g, or t
gcagttctnctggtcctcatggcacctcgtggtacctgctggcaaacatggaaaccgtggtgataactggttctttctgtgtcctgttggtcctgctggtgcggtttggcccaagaggtacctagttggcccacaagggattcgtggcgataagggagagcccggtgaaaaggggcccagaggttttcctggcttatagggacacaatggattgcaaggtctgcctggtatcgcgtgtcaccatggtatcaaggtgctcctgatccgtgggccctgctggtcctagggccctgctgg

SEQ ID NO: 539853 - DNA, 130 bp, Homo sapiens
cgtatgccgtgcagcctgtagagatcagtgactaatcagcagcatcgaggcccagctgagcgagctcgcagctgagatggagtgccagcaaccaagcagtacaacaatgctgctggcacatcaagcacac

SEQ ID NO: 539854 - DNA, 302 bp, Homo sapiens
tgtgatgggtgcctagatcactatccgtctatgctggggaagcctcacaatcatgacagaaggcaaggaggagcaaatcatgtcttatacagatggcagcaagcaaagagcgcttgtgcaggaaaactccctcttataatagccatcagatctcatgagacttattcactatcacaagaacggcatgggagagacctgcccccaggattcagttacttcccacagggtccctcgcacaacacttgggaattcaagatgagatttgggtgagaacacaaccaaaccatattattctgcccctt

SEQ ID NO: 539855 - DNA, 270 bp, Homo sapiens
  misc_feature (15)..(15): n is a, c, g, or t
  misc_feature (24)..(24): n is a, c, g, or t
  misc_feature (53)..(54): n is a, c, g, or t
  misc_feature (126)..(127): n is a, c, g, or t
  misc_feature (185)..(185): n is a, c, g, or t
  misc_feature (188)..(188): n is a, c, g, or t
  misc_feature (196)..(196): n is a, c, g, or t
  misc_feature (237)..(237): n is a, c, g, or t
  misc_feature (239)..(239): n is a, c, g, or t
  misc_feature (251)..(252): n is a, c, g, or t
  misc_feature (254)..(254): n is a, c, g, or t
  misc_feature (257)..(259): n is a, c, g, or t
  misc_feature (263)..(263): n is a, c, g, or t
aaaaaaacgcccccnttaaacggnggaatgaaaatgaccttgatttataaagnnaagactgagggcggggatactgattcagaaaccctgtagcgtgtaataaaagaagaggaaatggcatggaannactgccccctgtgatttgaaggccattgtgaaggaaaacaatgcagtgaaagaaagtnctnccatattnggacagatatcattgcatcacatttatttatctttctgggnanttttatagcccnnanggnnnaatntttaaat

SEQ ID NO: 539856 - DNA, 434 bp, Homo sapiens
gctcgacattagaaatgaagttacacacgctagtcagtaattaaaacattttcctactgagctgaacagaaggtccctttgagactttaatattgctgtggctgaaggtcaatatccatggctacatctagctccttgaaatattaagtcaagatgtggtcaaaaaactttcagaacaacaaatcaggctacagtgttgatactgcactccagataaaccaatggggtaacaaccgacatccctaatttctccttaagcctcatctgttaagtgacaggctcagtgtgaaggaagatagagtgtgatgcgtactgtcacacaaagtaacattagtacttctgcagtttggcattattatttttttatttttgttttgagacggagctcactctattgcccaagctggagtgcagtgacacatctcgcctcactg

SEQ ID NO: 539857 - DNA, 437 bp, Homo sapiens
  misc_feature (49)..(49): n is a, c, g, or t
  misc_feature (101)..(101): n is a, c, g, or t
  misc_feature (118)..(118): n is a, c, g, or t
  misc_feature (158)..(159): n is a, c, g, or t
  misc_feature (301)..(301): n is a, c, g, or t
tacatgaattacaaatacaaatactctcctaaaaatacaaaaattatcncaggcgtggtggtgggctacctgtaatcccgaatcactgggactaccggctnaccatgcctggcttaanaaagtttttaaactttggttggtgatttaaaacaagtacnntgcagcatggccgtggtggcatcacacctgtaatcctagcactttgggaggcctaggagagtggattgcctgaggtcggaagttcaagaccagcctggccaacatggtgaaaccttgtctctactaaaaatacaaaaaattngccgagtgcagtggcgtgtgcctgtaatcccagctactctggagactgaggcaagaaccctggatgtggaggttgtggtgagccaagatcacgcctctgcactccagcctgggctacagagcgagacttggtctca

SEQ ID NO: 539858 - DNA, 243 bp, Homo sapiens
aaaaagaaaattttatttttttttttagggcgggccatagaaaagctattgagaggatttagtttatcagggccggaggtgggaaccctggtgggggatgggatggggttttggggttttgaaaggctttatcatttaggttttggttatttttcctttgatggtccagtcctagtttatagggttggccggtttaatgcttttctccccccttttaaataaatggtttaaatggggtttgga

SEQ ID NO: 539859 - DNA, 796 bp, Homo sapiens
ggaggtttcatcatgcagatgaagcctccaggcagcagactgcagagagaatggatgggagatgtttattatcagactgaaagactgttctgccagtcattccaaaagggaggggggataacaagcacggtggcttcaggtccctccgcattatcgcatgtgccagtgctttgctcctttttacacctgagtaatcgtccactgtggagtcatcctttcagctgctgagagatgcgtgggcagtttccacctgcagccatcaattcacaaatcctacaattctaagctctcagaacccttggatctgaaggttctcaaatgctaaggtttctagatgttagcagacgaaggtgtcaagacgcatgggatctacgatgcagagttctgagtggggatatgcgtcccccaccccgactcaccccacgacacatatcagtaacagcctctgcaaccccgccttggtgcccccgcacgttccaggggcagccacactgatggattgctcagaacgggctggagccgcatctccacttctgccccgacagttcctgctgcagcagatgcccttccagatgcaaactcctacgcatccttcaaaacccagctaaatgtcacttcctccggaaagccttccccacctctctagcaggcagttgagcccagcttacatttccgacaggccctcactgcccgggattgcagctgcgggctccttgagggcagggattgtccctcattcatcctgattccatgccaaggcttatagtaggtgctcaataaatgcttgctgaatgat

SEQ ID NO: 539860 - DNA, 590 bp, Homo sapiens
agactgtgttacgctccttaatttgtccctgcacaagaaataagcatatggatccgtgaatgtacccttcctcctctgctgcattctgaaaggaaagtcagaagctcgtcaaacttagaacttgaagctaagctattacaccctcggcagtgcaggggaaaagtaggaatgagaacaaaatgaaaaatcctgaagaaccactctgggagaagaagtcaacaaagattttataccactatgaggctcatgaagcccgtgcaggcctcccctgcgttcctaaaagctccccatgtgtggctgctaatgcacgggagccgcgattagctgcctgagaaaggcctaaaaataaaaaacattctgactagattactggataattagattggtagcgctcttccctgactgtggctgtcagattaaatctggctggctctctttagataactgtcatgccccaaaataccaaacagacactgacacatctaggagccttttaaaaaggggtccaagaatcaaagtgcctattttttctttaaaatataacatgaacaatgtttcacaaaatacaacaaaggcctcgttggcctcat

SEQ ID NO: 539861 - DNA, 855 bp, Homo sapiens
gatgtcagctcactgcaacctctgtcagcctccaggtgcaggtgattctcccacctcagcctcatgagtagctggggttacaggcgcatgtcacaatgcctggctaattttgtattttgggggtagagatggtttcgccatgtggccaggctcgtctggaactcctgacctcaagtgatctgcctgcctcggcctcccaaaatgctgggattacaggcgcgagccactgcacccagcctgacttgagcactttttcatgtatctgttggccatttgtatgtctttgagaaatacctattcaggtgcttgtcaactttttaagtgggttgttttcttgctattgagcagtttgagtttcttatatatcttgaatattaaccccttatcagatgttgtttggagcattttctctgatgctgtaggttgtctcctaactttgtggtttcctttgctgtgcagaagcttttcagtttgatgtaatcttgtctacatttttgttgcctagctttagtttcgggttttaacagctaagtctttaattcattgtaagttgattttttaatatggtatgaaataaaagtctaattccgttcttcaacatgtggctatccagttttcccagcaccatttattaaaaagacattccttctcccattgttgtgctaattgttgagaatataaatatgaaaccccgagcttgtcttcttcctctgaaagctgtggaccgcacttcctttttcctgcccttatgctggtgacaccctgtcctgatatatgagaattagagtaaagcatttttttttgtttttttgagacagaggtctcttgcctaggctggagtgtagcctcgtgccg

SEQ ID NO: 539862 - DNA, 157 bp, Homo sapiens
agagcacctgtgggcccccaccttcaatgtcactgtcaccaagactgacaagacgctagtccatgctgataggcataccaaggtgtccaacggatgatatgatacaacaacgaaatgttctgcaaatggcctcccaaccttcggacgtacgcagata

SEQ ID NO: 539863 - DNA, 163 bp, Homo sapiens
ctcgataataaagggcctgtgagatttacagcgtagtgcgtctaaagcagaggttaagaacatcatgccccataggaaaataaggtaaagaaggaagctgccatataagctcttaaaaatggtatgttagaaggttctaaaatctcttcagcactggttggtc

SEQ ID NO: 539864 - DNA, 201 bp, Homo sapiens
atcggtctgggtacaagcgatgctcttgcttcagccttctgagtagctgggattatgaaggggtggctgcccctccacatctgtgggatatctcatcaggtgggacaagagactgagaaaagaaataagacacagagacaaagtatagagaaacaacagtgggcccaggagactggcacttagcatacccaggacccgggg

SEQ ID NO: 539865 - DNA, 818 bp, Homo sapiens
gacggcagactgtccccctcatgcctttggtcggaatgactggagatgatgatgagatcctagacttcggtgactggcagtgtcccaacaggaatacctagacagtatgaagaaaaacaaagtgcacagagaaccgaccccagacaagagcttgagtggagaccacagggaacttggacaccagacgtcccagaccccagatacatccatgctctccggatgaccacactcaactatctataggcattcatgtccactcatagccatcacctatacatgattcatatatacatgacgtcatcccacatctagatataccacgatacactcactcaactatccacatcatggacatagtcaccacacccatgacaaactccatcgtcatcattgcacgtcatgaccacgtagtcacacatgatcatcatcatgaccagactgagtggtgacccgtgataggacacacaccacacaacaatacccagcacaagaacccagtccgcgtgacaatatacaaagaggagggaacagtcgagagacaaagagagtgaacagacaaggagtaagaacacaaagacaagaaacaaaaagcagacaaagaaccgaaaatgggacaagacaagggacaggagaccacaaagaaagacagaagaaggacaaatgcccagaaacaggaagggaaaaagaatagaccaacaagacaaacaacaaatagacagaaccaagaaaatgaagaaaaacaacaaagcagacaaacacaaccggaaaaaatgcgaggcaaagggaaagatggaaaagacaagaagggggaaaagaga

SEQ ID NO: 539866 - DNA, 303 bp, Homo sapiens
ttaaaagcccccccctttttttttaagggggaggggccggttttttcccaagtccccccaggggggggggaagcctgggttttgggtaaatattggaaagcaaaaattttttttttctgcccccaaaaattttttaatttgtttttttttgaaaggggggggctttggggcccccctttcccctttttttttcccccactttggagggttggggggttttggttttcctgggggggggggggggggggcgggggtttcctggtccctgtttttgggccggttggataaaagggggccccttta

SEQ ID NO: 539867 - DNA, 864 bp, Homo sapiens
atcagaataaaaactgactagaaataccgtcaaaagcagcacttgaccaaactcagagcatctgagtagcagaatcctgtctgcttcatcaatctgaaggttatggcctgttgacaagagggattctgaacgactaaattagtcagtgtgctcgctgtttgtttacttaaatgtatggttagatggtgtttggatctggctagtcttcccgtagtcccccgaaataagtaataataacttccatgctgcctgctgtgttccagatcacagaggcagcaaggcatcaggaaaaactggggcgtttgcttagggtcgagacctatgttctgatagcacagtctttgacaatagtagcttacgtaaggacgtgctcagaatgagtaagctttaggaaactactaaggatgctgtgggagagtaacaaaatccgttgctgctctcttgcacttgacagaagcattactgaattgagtctttcatagacccacttgggccaagcctttctatattgcctgtaggatgatcgggctgctggtgtggtagtcactctgatcacagattgctttaaatcagcggtgtggaatggtcatgagtcaaacatggtggccgggtctttgacaaggacagatggcgtagtgtccgcatgtactgcctctcgctgcggtcacgttagggtgtgtcttcacgtccggagggtgtaacccaaggtccttttgggtcactcccggctgtggatgcgtcttctcacatgggggggccacgggtgttgggcggagttcccggggcggggttctccgggcgtcgccaccctgttggcttaacagggggggacgggaccagggctctccggctgggagcccgggg

SEQ ID NO: 539868 - DNA, 132 bp, Homo sapiens
gcggccgcgcgcccccgccttcaccttcggcgcgcgcttccccacgcagcaaacaacagacatacccgggccaggcgacctggtgcccgctcgcatgaccgtgcgcggcaccgacggcgcccccgcctactc

SEQ ID NO: 539869 - DNA, 367 bp, Homo sapiens
  misc_feature (36)..(36): n is a, c, g, or t
  misc_feature (39)..(39): n is a, c, g, or t
  misc_feature (41)..(41): n is a, c, g, or t
  misc_feature (88)..(88): n is a, c, g, or t
  misc_feature (174)..(176): n is a, c, g, or t
  misc_feature (365)..(366): n is a, c, g, or t
caccctcacaccaaccacacccaacaaaaaagaatnaanancctcaacctccgactcccacctccacagacgtaagcgcactgcctcnaaacccactcccctaccctagacacaaggtgccctctttcaatcctccaatgaagtgtgggttgcactatctaaaaatccaacttnnntcaagaacccgcccccaccttcacctcgagccacccaaaaacccgcgaattccccccttcacacaacagatatattctcaaaagatttcaccaaacccagacccatcctttacacactcctcttaataaacaaacattcacaacctcccccagggggggggtgatattctcccctcttctttcttctcnnc

SEQ ID NO: 539870 - DNA, 134 bp, Homo sapiens
ttccacgaataggagaatgagccataggcgccgttgtcgttcaccttcacctcaatgccggcgccggactgcatcgcgaaatcggggccgaacacctgaagatcatccacggtcagaccgcgcggcatgttgcc

SEQ ID NO: 539871 - DNA, 1675 bp, Homo sapiens
  misc_feature (367)..(367): n is a, c, g, or t
  misc_feature (395)..(395): n is a, c, g, or t
tgttgtctctgctaatagctagttcttcttagttcgcttatcttctattgtctttcttacttaggtttcatcttattctcgttctgctccatgttttatcatagtggtcttcttctctcctcatgtttttctctcgtgtattttatattctcactggtcactgttatcacttttgttttctggtctgctcataaatactttgttacataaaatagctcgtgtgttgccgcgcttctacttttctccgcggttttttttttcttccactccctttctcttcttactaatatgattccacaccagaacttatgtttgttccccctcatatttaactcttttttcctcctccgtggagtatgtatatacncaccaaaagcgtgttgtagctcccttcncctccgctataattgtagaatcgggtccgtacgagcctcctcattttgtgggtcaccctgtttcttcgcttctttcctcagtggacagggggggccctccgtcgccatgtgtattctttttatatttgggaggggtatatatggggtgtatcactttcacacgccctctttttcctcggctaccatactccctcctgcggttttttctttctctgtcgctttttataatagtgtggtacgcccccaacgtgggcacagacacttgttgttggaaaccctctggctcccccccttctgtttggggccccacaattttggaggaagacattttttttggcccaaatttgggggccgctgttgaaagaaaggccgttttttctccccggggaaaaatttgtagaagtagggaaattttgttgctgcgcgccccactttttggcggttgttataacctcgcggtttctctccctctctcagagagtgttgcatctccccaaatatgtgtctccccaatagctccaccgcagaaagtatggatttttaaaaccaagaatctttttcgcccagaaaattttgtgtgtaatagccccccccgagtgatcttcccacagagagcccccctctctgggggcgcccccacccgctccagttatagggatctcccttctcccagagagatctctcttagagagaagagcacccccccttgtgttagaacatttgtgagaaatctcatagtgtggagagacgcttaacacccgacaatacggccaaggaccccatagcgcgcccgggacacacccatattttctcgcgccacggcccacaggatctcaccacagagcttcccgggtggggatataagagcgcagacactggctcccacacacagcgcgtcgccctgccacacagcgccccacatctcagagataggagaatagagcgcgcgccgcggttctctcagcgcccacagaaaacgcctctgggtgtaggtgtaagaaaagagaaagaaagagcgcctcgctttttggtggtttaagaaaacccgaaagaaaacccctctgggggggaaaaagagcagcccggcttccccgagaacccgccccctcggaaagaaagacctcccacgagagagaagaaaatcctcactaccacgagagaggagaaagaaagacctcggctggcataaaaattctttaatattggaatatattccataaaagaggccaaacattttgggcagactttttttggaaaaagaacccggttaaaccggccca

SEQ ID NO: 539872 - DNA, 174 bp, Homo sapiens
gttctctctcgcactcccgcgaaatgctctataaattacaaaaaaaaaaaaaatcaacagatggaggaacattaggcacagagagtaatggtggtgggttctggagctggcggtgctgggaatttgcactggaaaagggtaacgagaacgggcagggacggtggggacggagga

SEQ ID NO: 539873 - DNA, 131 bp, Homo sapiens
tattgaaatgtgtgctgacgtatactatataaacccattttcttatttcatatttgtcatataccccagataaagcatccatattcataaatgagttatttaacaactattaaaaaacttaactcaggttt

SEQ ID NO: 539874 - DNA, 371 bp, Homo sapiens
  misc_feature (36)..(37): n is a, c, g, or t
  misc_feature (40)..(40): n is a, c, g, or t
  misc_feature (50)..(50): n is a, c, g, or t
  misc_feature (92)..(92): n is a, c, g, or t
  misc_feature (166)..(166): n is a, c, g, or t
  misc_feature (371)..(371): n is a, c, g, or t
cagctctacccggtgcggccaatatggggtctaatnnganctgcaggccngccggcctacaccagagccacagcaacgcgggatccgagctncatctgcaacctacaccacagctcacagcaacaccagatccttaacccactgagcaaggccagggatcgaaccngcaacctcatggttcctagtcggattcgttaaccactgtgccacaacgtgaactctgagtagtttatagtttggatattaagcccttgtcagttgtgtcatttgaaactattttctctcatttcctaggttgtctttttgtttctttttatggtttcctttgctgtgcaaaaccttgtcagtttgattaggtccatattggctgn

SEQ ID NO: 539875 - DNA, 962 bp, Homo sapiens
tccctgtcgccgcgaaggggcggaggcaggacgcgcaactccgggcgaagctgtcccggggtcgtgagccgtccccgatttggtggtgggccccctcggttcctcgagtgcaggacgcatcgggtgggctcgggtctccagcccggtgcggggaagtgagggaccggggacatgcgagaggaggaacgtcagggcctcggcggggagatgcgcacacgcatgggtggggcgggcccggtcgttgcggcgcaccacttgtggcggtgtacccagggcctcaacaaaagtcggtacaagaactgccaaggggccaagtccagtccaacggtcaaggaccacgggggggccacggtggcacttcctgagtgggccaataggtgttggagaccgcgcggggattgacagacgacccgggtagtactgcgaggtggtcacaaaagcccgggaatggtttgtgcctaaccgggaacagcttaatgggcccagagacacagggggggctagaccagtgaccgtggggagcgacttcggcaccgcgagaatctcaggactcaaccagaggacagggcggactaaaaaagggtgaactgaccgagcgcatttcgtgggcccagaatagaagggtgaaagagtgatgatcctagatatcggcaggctcgagctgaaggataagggtgaatgctgtatagagggtacatggaagggggggttgaccatttaccaatttcacgagttgtaataccccgtgtagagatgtgtttgtgatccaccgtggtattaagagtaagatgtcttgattgtaaagaattgggcaggcttgcgtgggtgggagggcttgggggggagtgtctggcgccaagagagatttaaacattgacatgagaggatttggggacggagacgttgcaagaaaggttaacagagggaacggtctgatgttaaaaaggggggggatacaatcc

SEQ ID NO: 539876 - DNA, 577 bp, Homo sapiens
  misc_feature (37)..(37): n is a, c, g, or t
  misc_feature (92)..(92): n is a, c, g, or t
  misc_feature (95)..(95): n is a, c, g, or t
  misc_feature (99)..(99): n is a, c, g, or t
  misc_feature (151)..(151): n is a, c, g, or t
  misc_feature (191)..(191): n is a, c, g, or t
  misc_feature (200)..(200): n is a, c, g, or t
  misc_feature (210)..(210): n is a, c, g, or t
  misc_feature (212)..(212): n is a, c, g, or t
  misc_feature (222)..(222): n is a, c, g, or t
  misc_feature (228)..(228): n is a, c, g, or t
  misc_feature (313)..(313): n is a, c, g, or t
  misc_feature (315)..(316): n is a, c, g, or t
  misc_feature (333)..(333): n is a, c, g, or t
  misc_feature (380)..(380): n is a, c, g, or t
  misc_feature (384)..(384): n is a, c, g, or t
  misc_feature (391)..(392): n is a, c, g, or t
  misc_feature (403)..(403): n is a, c, g, or t
  misc_feature (416)..(416): n is a, c, g, or t
  misc_feature (427)..(427): n is a, c, g, or t
  misc_feature (429)..(429): n is a, c, g, or t
  misc_feature (436)..(436): n is a, c, g, or t
  misc_feature (484)..(484): n is a, c, g, or t
  misc_feature (512)..(512): n is a, c, g, or t
  misc_feature (517)..(517): n is a, c, g, or t
  misc_feature (567)..(567): n is a, c, g, or t
taaagaaatagttataagtgtgtgtgcagatacaganagtctttaaattttttgtctataaaatatttaaagaaatattctaaggatcttanagnaacnttgggaggcacggggaaggacaaagggactgaatttttatgtcgatggaccnctgatcagtgctgtttagtccaatccagtgcaagtaagtnaaggttcanagaaaaaatngntttataaaancatagngatgaaaaaaactttccagcctagcgtcatcccatccaagaaaaatactgagaaaacagcttgtaaaaaagaaggtaactaaaancnnattatactcataaaacncgtacacgttaatagacaggaatacataatatatataatataaaaanaatnaccattnntgccatacctntcagttccaaggnactgtacactntnctatctncttttctatcacgctggagtctcactctgtcacgcccaggctggagtncaatggcaccatcttggctcactgcaanctctncttcccccgttcaagccattctcctgcctcagcctcccaagtaactaggnccacatccat

SEQ ID NO: 539877 - DNA, 311 bp, Homo sapiens
  misc_feature (36)..(37): n is a, c, g, or t
  misc_feature (40)..(40): n is a, c, g, or t
  misc_feature (50)..(50): n is a, c, g, or t
  misc_feature (92)..(92): n is a, c, g, or t
  misc_feature (166)..(166): n is a, c, g, or t
cagctctacccggtgcggccaatatggggtctaatnnganctgcaggccngccggcctacaccagagccacagcaacgcgggatccgagctncatctgcaacctacaccacagctcacagcaacaccagatccttaacccactgagcaaggccagggatcgaaccngcaacctcatggttcctagtcagattcgttaaccactgagccacgacaggaactcctgttagattttcttttttttttttttttttttttttatattatttccccactgtacagcaagggcgtaaaacattaaccgcgggggaac

SEQ ID NO: 539878 - DNA, 291 bp, Homo sapiens
  misc_feature (36)..(37): n is a, c, g, or t
  misc_feature (40)..(40): n is a, c, g, or t
  misc_feature (50)..(50): n is a, c, g, or t
  misc_feature (92)..(92): n is a, c, g, or t
  misc_feature (166)..(166): n is a, c, g, or t
  misc_feature (194)..(194): n is a, c, g, or t
cagctctacccggtgcggccaatatggggtctaatnnganctgcaggccngccggcctacaccagagccacagcaacgcgggatccgagctncatctgcaacctacaccacagctcacagcaacaccagatccttaacccactgagcaaggccagggatcgaaccngcaacctcatggttcctagtcagattcntttctgctgagccatgatgggaacttctggaagcagattttcttttttcttttataagaaaagaaagatgatacagagaggaatctactcaacgggc

SEQ ID NO: 539879 - DNA, 422 bp, Homo sapiens
  misc_feature (46)..(46): n is a, c, g, or t
caagacctatggttagaattgagatgtttcccccctcagaaatggntccagaagtcctagacattgaaagtcaagtttgcctaaaaagccaaggttatagatagaaaagaaaatgaaggcccaaatgcggtggctcatgccctgtaatccccaacaatttgggaggcctgaggtgggaggactgcttgagcccaaagagttcaagaccagccctggacagcatagaaagaccccatcttgacaaaataacaataataataatttagtcaggtatagtgatgtgcacctgtggttccagttactcaggagggtgagggaggaggatcacttgaggctgggagggaaaggctgcagtggtgagccatgattgtaccactgcactccagcttgggcaacagagtgagaccctgtctccaagaatt

SEQ ID NO: 539880 - DNA, 150 bp, Homo sapiens
tggtgagcatgaacccaacagcaggacttctcttctgcctcccggagccagccgagacgctcaactccacctccagagagccattggtgtagaaaccgaagctgttcagcttggatgtccgctctgcttctccccactctggggtgcctg

SEQ ID NO: 539881 - DNA, 103 bp, Homo sapiens
cccgggtagtcttacgaccctggtgccctgggctgccagccctgctcctcgctctggggtggaaagggctctaggcgctacccgaggtacagaagcaagtttg

SEQ ID NO: 539882 - DNA, 288 bp, Homo sapiens
  misc_feature (36)..(37): n is a, c, g, or t
  misc_feature (40)..(40): n is a, c, g, or t
  misc_feature (50)..(50): n is a, c, g, or t
  misc_feature (92)..(92): n is a, c, g, or t
  misc_feature (166)..(166): n is a, c, g, or t
cagctctacccggtgcggccaatatggggtctaatnnganctgcaggccngccggcctacaccagagccacagcaacgcgggatccgagctncatctgcaacctacaccacagctcacagcaacaccagatccttaacccactgagcaaggccagggatcgaaccngcaacctcatggttcctagtcagattcacttctgctgcgccacaatgggaactccaatctctgccattttttaattgcgttgttttttaatttttttgttttcgttgtgagttaagaccgct

SEQ ID NO: 539883 - DNA, 262 bp, Homo sapiens
  misc_feature (36)..(37): n is a, c, g, or t
  misc_feature (40)..(40): n is a, c, g, or t
  misc_feature (50)..(50): n is a, c, g, or t
  misc_feature (92)..(92): n is a, c, g, or t
  misc_feature (166)..(166): n is a, c, g, or t
cagctctacccggtgcggccaatatggggtctaatnnganctgcaggccngccggcctacaccagagccacagcaacgcgggatccgagctncatctgcaacctacaccacagctcacagcaacaccagatccttaacccactgagcaaggccagggatcgaaccngcaacctcatggttcctagtcggattcattaaccactaagccatccatgggaactccttaagaattaatcttagctagtgaaagtcatatagcaca

SEQ ID NO: 539884 - DNA, 138 bp, Homo sapiens
tgcagagacatggtcttgctatgtatccaggctggacgccataagtcctaggattaagggatcctctcatctcagcgtcccgaacaggcgagagtaaagccaagagccgaggctgagatgagagtctccggtcgaact

SEQ ID NO: 539885 - DNA, 643 bp, Homo sapiens
tggagtccagccaatgacacgggagccaaaaagaaaaaaaagaaacaaaaaaagaaaaaagaaaaaggcagtgagacagattcagcccaggatcagcctgtgaagatgaactcttggccagcagagaggtctccaggaaatacagaaggccattgagctgttctcaggtgggttcagggacctgccaaaacctgtggaggaggctagcaagcgaagctaccagttcggggatacgcagcccgtccccaagctgggcgaaggtggtgaacacccatgtggccccggtggagcctgacagaggacaattatccgccaggagccctacacccgtgccccagggcttcaccgtgggatgcttgggacctgggcgatcggtgggtgtgctaaaagacctgtacaccctcctgattgagacactatgtggaagatgatgacaacttgtcccgattggattattccccggagttcctttggggggctctccggccacccggtgggttcccccagtggtgccctggggggttcgaggggtctcaagtcggaaatgggtggggttcataagcgccatcccagaaagatccatatctatgacccagagaagaagatggtagagatcaattcctgtgttgtccccaaaggtggg

SEQ ID NO: 539886 - DNA, 969 bp, Homo sapiens
tgtatggggcccgtgatctcaacggtcctgccctcggtctccctcttcccccgcccgccctgggccaggtgtttcgaatcccgactccagaactggcggcgtccaggtcccgcgggcgtggagcgccggaggaccgcctcgggctcatggggcccggtccgctgggcggaagcgccgtgctgctgtccaaccgtcttcgttcgtggctgaccgagtggcgggacgaggcgacccgcagcaggcaccgcacgcgcttcgtatttcagaaggcgctgcgttccctccgacggtacccactgacgctgcgcagcgggacaggaagctaagatcctacagcaccttcggagacgggctctgccggatgctggacgagcggctgcaggcggcaccgaacatcggggcgggaccattgccccggatcaccatcgtggagagaacagtccagcccgacaggggccgactgcgggaagtcaaggactcttccatgccagtgcctgccagggccaaagcgggaggctctgggcagctatgggcagctcgggactcaggacccgagtgatactgtgggtgcttctaccgggagcactgaattcctaatggtcaccatgcttaacaaggaggagtgctggcgaggtgtgctcagcagtccccaggtagcccgggagtgcccacctgaacaggcagtcgggtccgtcgttcagaggaactggtctcggaaaagagccagcaggacccattgacccagaggcgagcggcacgagttggcagtcaagcctgagtgtgactgtggatgggcacgggcccgggggaagacgcccgacgacggaagctgcaggaggaggcagagcacctgagagatgcagacagcgtggtgatggaccggagagcgagagatagcgggacacaggccatcagggtgaacagcaaagacgagagaggagacaacaaagaccagactatcgtcgcagt

SEQ ID NO: 539887 - DNA, 1622 bp, Homo sapiens
  misc_feature (1238)..(1238): n is a, c, g, or t
  misc_feature (1254)..(1254): n is a, c, g, or t
  misc_feature (1352)..(1352): n is a, c, g, or t
  misc_feature (1427)..(1427): n is a, c, g, or t
  misc_feature (1518)..(1518): n is a, c, g, or t
gagcgaccgtatggtcaccaagtcggtacatgcacccctatcgcagctttgtgcattacaagagcgagtacttccttgtcgaaagctctatgctcgacagacagccggggccatgatcatgcggcctactcggttgaagagagatgatccgtcacgcgcgaactcggcgtagtagatagtgttgagcaaatcgaatgcgtcgtctagtgtccagaagttcaatctcacctaaccgtggtgggcgccaggcggtagaagtccatgacagtgcccaagtgaccatttgatagatgaaccgtggtgctgaattcacagcagcagacacgaatggactgtggggcgtgcagcatcggttgacaatcctatggcgactgaacagtgataatcggtctgaacccgtcgcaatatggatagctctgttgcaaatgtcgtcacattgttaccacccccgatgtgtaaacaaaaagctacaaacgtcggtctgtgcatacccgagggacgccacatcacctgcgatgagtcagtctccgtgtcgaccgtagcaaaagtcacccaagggaaaagcgtgtctaacaccttggtgagcccgcatgaacgtgagggactcgcatcaatacgctaatccacgtggcatgttattgtgtgccattccgtgagactatgcgaacgacctttgcgttgaggcacatcaccccgctacagccgaaagcgggatgcctacctgactgtccgagttgtttggaggccgacagcctggcccgatggagctgcgccgagcgtgcagcatggcctccacccctttcttgcgactctaggccccgggtgtgctgtgaccgtcacgccgagggaggttgataggtcccacaggagcgttcaccgctctgggactcgtgctccccggtgaacccgcacaactctttcattgcacccaatagctcagaccccggggtactattcctgggctcgtgacccaagaaaacctgatagtgcatttgcccccccacaagtgttatggatttagatgtcccttgggagcggttcgatttcgccgcgcttccactctggcgccgctgtcgtgcggagccgagaccacaccccctgtgagacgtgccgcgtgtggcattattgtcgggggagtgtggatattaaccgcagcacgcggctgtcttcgtgaagagaggccagcctgtggtggcgggccttcggagggtgctctcattgtgttgtgtctggcctcnccgcgcgaacaggcgngtgtgcggcgacctccgcccactattctcgcatttcgctcacgtctggcggcgttgcaccgctgtacgggaaagaaggttggtctcgttgtgcgacanctatcctgtgctatcccgtttttccgttgtgacggggacatggcggtagaggattcgttctccggatgttagacngctcctatcagtatcttggagcccgagagaagtggcaggctttccactcttgcgcaaggttacagccggaggggccccgcggaacccaccntcttttgcggtccctccggcggtacccccccttccccctaagggcgccgccgaaccgggatcgccagcgctgtttccgacaaaatagagaggttctcttcttca

SEQ ID NO: 539888 - DNA, 1220 bp, Homo sapiens
  misc_feature (1220)..(1220): n is a, c, g, or t
gctctgcacctgggacccatcggggtcgggatgtgaccacacggacggggaggctcctgtgaggtgctttgaagatggatgagatgaggggtgtgctctgggtgggaggagcagcagtacacccgtcaccagaacatctcttgtgtcatgacatggtgggtgcaacgggggcctcacagcacagagtgacctgctgcctggcgttccccagcactcggtgtggaaccggcccctacctgctgtaacgattatgggtccatgaaagcagtaagctggacacagaggtgtacgtgtgcgggacagagggccttgcagatgcctttctgtaggtgtacttacgtgttaaaatacggagacgtatggcactcattcacctccattgtctcagcggctgtgcaagcagctcctagcttcggaagtacaggacacatacagtcgcagtaattcaagcagtgtcatgtacatgcaggtaacagcataccaagctgcacgtgcgaagcactctcagcagggatcactagaaacccaggcattaacttatcccctctacccgcgtacttcataccaccgaaggtgacaactcataaagtgtaatacttagtacgcaggtgcaatgccatatactgagttaatagagacaatccaggatagcatcctacatagagacatacaagagcgacgtaaggactaaataataggaataggcagaactactagaagaaatgaacaaaccatagagactgaatggagtcgataatgagatgcagtaggatgaagaatgaaaggattggatagagtagaaagaagaagaaaaggagaagaagaaaaatcaaaggggagagaatgaaaaaagaaatgaagaaatgacgtagaggacagagtaaataaatggagatattgacaactagatcgatgtaattggaaagtaaaaagtcatagatagaggaaccagccggacaggcgcacaacaacgaagaagaggcaaacaccagaaggacaagagccctacgcgagcgagtcgcagtaagccagaagacccccggaagacggaggagaggcccaaaggaagagagagacacaacggagaacaagggaacacacagagcaagagacaggcggacgaagaagcccgcaacaccacaccgccccacaccgcaacagaaggaaggagaaaaaaaagcagaggaaagacggaagaacgcgctacgacaagaccaaan

SEQ ID NO: 539889 - DNA, 256 bp, Homo sapiens
ccacaaaggtacagtattacttagctatctgaattatgatagaaacaggtcctagtaaggtacctatataacgcatgtggaagatgacctatgttgccctatgaaactctgaaaatagggattccgagggtgcggatacaaagacattgtctatgcatatccataagcaggtcttagagcatatattccaaactctagctgtctcagcagttactatgaggattgcaagtcataggtgtgtgtggcctatcagtcc

SEQ ID NO: 539890 - DNA, 288 bp, Homo sapiens
caggggggggaacctttttcccaaaaggggtggttgggggcccctaaaaaaaaaagggccggggtgttcatcctttggttcctttgcctttacccaaaacccttttggggggccccccccctttttttggggggtccccccccggatgggggcccgggtgttgtagggggttaaaaccccttttagctgggcccgggacttgcctttttaaaaacaaaaaattagtccctggccccttttttttttttttggcccccggccccaaaaaaaaaaaaagggttgggttga

SEQ ID NO: 539891 - DNA, 694 bp, Homo sapiens
ccgtccggagccaggcaacgagcgtttcgctcttgttgcccaggctggagtgcaacggcactatctcggctcaccgcaacctctgcctacctggttcaagcgattctcctgcctcagcctcccgagtagctgggattacaggcatgcgccaccatgcccggctaattttgtatttttcgtggtggtggtgggggggggggggtccctccattgttgggtcaggcgtggtctcgaaacccccgaacctcagggtgacccgccgtgcctcggcctcctaaaggtgcgtgggatatataggcggtgggccacttgcgcccgtggcctacctcaagttttataaacatttcatactaggaaattgtgtgtttccataaaaggaaaagtggcagacaattttctcgctccatgatgcgtacatctgggcgtctgggaaacccaaaccctcaaggatggccgggcgcatgggggaaccacgcctgctgggggcagggggctacccaggggcttcctatcctgggggcctaccccggggcaggcacccccaggggcttatcctgggacaggcacctccaggcgcctcaccatgggagcacctggagcttatcccgggagcacttgcacctggagttacccaggcacccagcggccctgggggctacccatcttctggaccagcaatgtgccccgagcttac

SEQ ID NO: 539892 - DNA, 201 bp, Homo sapiens
  misc_feature (93)..(93): n is a, c, g, or t
  misc_feature (113)..(113): n is a, c, g, or t
  misc_feature (141)..(141): n is a, c, g, or t
caggcccttccatgcctactcagttcagcttagcaatagatgctttcagctcctatttcatttttattaactaccaggagggcatgtttcagntaaggtcctgctttatcttnttcaagtccctcatactatcatacacanatcaaagagaaactcctgaaaaaatcttaacacatgtgtgggaaaagaggaagaaaggct

SEQ ID NO: 539893 - DNA, 253 bp, Homo sapiens
gacgtccctttgacgagtgttatgcctaccatggtgtagaatattggattatttgtttcatctttccccaatgatttcctggatgaactgaatgtttgaatctgtaacatcgtaaactttttatactagaaaatgtatattgttcatccccttgctactgccccattgtaattcttattacaacttctgtaactcagtgaatattcattctatgtttctgaagtaaaataaatggttatctgcatgaaaaaaa

SEQ ID NO: 539894 - DNA, 339 bp, Homo sapiens
  misc_feature (75)..(75): n is a, c, g, or t
  misc_feature (77)..(77): n is a, c, g, or t
  misc_feature (121)..(121): n is a, c, g, or t
  misc_feature (204)..(204): n is a, c, g, or t
  misc_feature (242)..(242): n is a, c, g, or t
  misc_feature (293)..(293): n is a, c, g, or t
  misc_feature (324)..(324): n is a, c, g, or t
ttgccatgggtttgggagcaggtttgggttacttgcgtttgaaggcagcagtggtctcaggaggaagcgggggcngnagagagtggtgatctgtggtcagtgggtcagtgacctgcaccgngattcttccaccttcggtaagggtgggactggaggcgtcctaggtcaagcccgttagttcgactccatgggcacctttgatcnggactgaccgcccgtgtgtgcacaagttgtctttgacnaagactcgttaaggatcgaaggcttgggaccccgtgttagcaggatggggncctgccttcccgtggaagttgtgactttaanccggcttgccgtacc

SEQ ID NO: 539895 - DNA, 1058 bp, Homo sapiens
  misc_feature (313)..(313): n is a, c, g, or t
  misc_feature (320)..(320): n is a, c, g, or t
  misc_feature (965)..(965): n is a, c, g, or t
  misc_feature (1010)..(1010): n is a, c, g, or t
  misc_feature (1048)..(1048): n is a, c, g, or t
cgatctagaactagtgcctcgacctcctgggctcaggtgatcctcccacctcagcctcctgagtagctgggactacaggagtgagccaccacgcccagctaattttgtattttttgtagaggcagggtttcaccatgtttcccaggatggtctcaaactcctggccttaagtgatgcacccgtctagtcctctcaaaatgctaggattacaggcatgagccactgcacttggcctgctatgtcttgatagtcattttttctttgaggactgtttacgttctgcaacgattaagtcccatttctgctgtttttngtgtttngcatttatacaacacttttacaataataagtagatgctgaaattacatgtgatttaaaactattgtttaaatctgatttatgaggctttcatttctaacttaagaagcattttaaatgtgttacaaggtgctcctctgtgggctagactaacctgggagtttaatcctgtgctctagaacagtgctatagtgatgggagtaatggagggttctgcatctgtgctgtctgatacactcgtcatcagccacatgtcactaacgaatatgtggaatgtggcaagtgtggctgttgaactgagttttaaattgtttttaattttaattaatttaaattaaaatagtcacatgtagctcgtggccactgtattggacagcccaactctagaatgttctggtttattatatgagtcacttagtaaaagccagctgcagcatagcctactacttggcaattagccttcctctaataaagattcattgtcaattgttagtctttcttccattttgaaattttagcagtctggaagtagtacctgacagtagttaaatacagtagaaatgtctggaaataaaatttgtttgaacagaattctatgtcccgatttatttctaagaaaaaagactattaagtaactaagaaaaatnaaaagaataatttaagccacttaaaatgtaattagctcttaccanactaatagaatggatgttttacatatattccattcgtnggtaagagtg

SEQ ID NO: 539896 - DNA, 230 bp, Homo sapiens
  misc_feature (85)..(85): n is a, c, g, or t
tcgagctcggtaccggcacgagcgcccaagtgggagcgcccaagtatgaatcgcaactgggccgggcgcggtggctcacacctgntaatcccagcactttgagaggccaaggcaggtggatcacctgaggtcaggggtttgagaccagcttggccaacatggtgaaatcccgtctctactaaaaatacaaaaaaattagctggtattggcgggcgcctgtagtcccagct

SEQ ID NO: 539897 - DNA, 249 bp, Homo sapiens
  misc_feature (229)..(229): n is a, c, g, or t
  misc_feature (241)..(241): n is a, c, g, or t
ctcctgttgtagttcactatttttgctggtgttctgttgttctcctctcatgctttgggcaaatcacttgggaatattatctttcatgtgaccatgaaactgtttcttattgagtgaaaatgatatctttaacaaaatcttatgcactttgcttattcaggaacacaattactggatgtgtctttatatatattgaacttatatagtacttcgattttttaaataaagnttaagaaagganaaaaaaaa

SEQ ID NO: 539898 - DNA, 130 bp, Homo sapiens
gtgataatatagcggggaaaaaatctatcttcccaagctgaggctgtcatagcagcttttgccaggagaagagattttatgcctctatgaaccttgaaactaagggcttattctagaaacattgaaagac

SEQ ID NO: 539899 - DNA, 157 bp, Homo sapiens
gatcacacaccggcggcaggtgcgcagcctgagcgcgatctgaagccaagaccgttgcgctgtgggtggcggacaaccagttgacgcgtgctgcagctcgacccgcatccgccgacgctggcctggcattcgggcactgcggcgatggccggtgaaa

SEQ ID NO: 539900 - DNA, 127 bp, Homo sapiens
gtagagtcgaagatccgcatggtactcatgagtacatcacttaatcatctccttcaacgtctccactgatcgggaagctgggccaatggtacagatgatgccagtgttccggggagtgatgctttga

SEQ ID NO: 539901 - DNA, 175 bp, Homo sapiens
tattgtcaatacggctagcagatgtctaacatgtacgattcagcatgatcagaattctctgatcattgatttgttatagatgattaaacttcaatttaagcttgattttaaaactcccctctgcttctgatgaacagcataattcctaaaattacactaaacaagtctgtcttga

SEQ ID NO: 539902 - DNA, 574 bp, Homo sapiens
  misc_feature (22)..(22): n is a, c, g, or t
  misc_feature (286)..(286): n is a, c, g, or t
  misc_feature (290)..(290): n is a, c, g, or t
  misc_feature (363)..(364): n is a, c, g, or t
  misc_feature (370)..(370): n is a, c, g, or t
  misc_feature (397)..(397): n is a, c, g, or t
  misc_feature (400)..(400): n is a, c, g, or t
  misc_feature (405)..(405): n is a, c, g, or t
  misc_feature (430)..(430): n is a, c, g, or t
acagcccagggatttcggacgntcttggaattagtcataaactaccagcaactctgcatctactggacaaagtattatgactttaaaaaccccattattgaaaagtacctgagaaggcagctcacgaaaacccaggccctgtgattcctggacccggcggacccttaccagggaaaacttgggttggtgggaggaccaaaagggtttgggaggccagcttggccacaaagaagcttgaggccctggcttgaatctaccccaatggcctttaaggaaattggggatnggtncccccagtgaagctccctggattctgcctggtgagaccctcctgctttccttccctgcccattccatcccctnncccctntccatgaagccttgagacatattagcnggngaccnttctttccaaagaacttacctcttncaaaggccatttatattcatatagtgacaggctgtgctccatattttacagtcattttggtcacaatcgagggtttctggaattttcacatcccttgtccagaattcattcccctaagagtaataataaataatctctaacacc

SEQ ID NO: 539903 - DNA, 285 bp, Homo sapiens
ccgccacagactttgtggatgattttcatttttacaaactgcttcctgatgataccaacgtctaagataatttggtacacacggtaaagttatctggaacataactttcagtttcctctgcagtttttaagtgctgtactactgatcatcctagagattacccactgaaaagtcttctctaatccagttttacaatatgacagtctttttaaccatttgtgttcgatataatgttttccgaagacatactttacttgcctgttttaatttctgtgcccctttcaa

SEQ ID NO: 539904 - DNA, 120 bp, Homo sapiens
tctggcggaacggcaatgtggggctgtctggcatggccatcgcagacgtcaccctcctgaatggattccacgccctggcgttgctgacctagagaagctaacctccctctctgaccgata

SEQ ID NO: 539905 - DNA, 131 bp, Homo sapiens
ataataggggcatgagccatagcagctgggcgagtaacaagtcttgatgagactccttcacagggctctctggcccaagcagtgtgaggactggggctcagtcatctgagtgtcagacatctcttatgctt

SEQ ID NO: 539906 - DNA, 435 bp, Homo sapiens
  misc_feature (16)..(16): n is a, c, g, or t
  misc_feature (31)..(31): n is a, c, g, or t
  misc_feature (45)..(45): n is a, c, g, or t
  misc_feature (412)..(412): n is a, c, g, or t
atctttattccactgnatccataatattaantctcctactatgtncccaggaactgtccctacatcgggaacagtatggtagtttaaaaaatatcccctgcccctcatagagcttacaatcctaatatgagaggacagacaacaaacagaatatatacatgttggcctgtaatcccagcacttcgggaggctgagatggcccaggagtttgagaccagcctgggcaacatggcaaaaccccatctctacaaaaaatgcaaaaaattcaccaggcatggggtcgggggggtggtgtgcctatggttccacctactccaggggctgaggtgggagaatcacttgaacctcgggaggcagaggctgcagtgagccgagattggccactgcactccagcctgggtaacagagaganagagaccctgtctccaaaaaaaa

SEQ ID NO: 539907 - DNA, 927 bp, Homo sapiens
tgaaggccgcgccccgtggaaacaggggccggggccccacaccgcttccccaaaatggcgcggggccacttgcgcaacgggggccgccgccgcccgccagtggtacccagaggaaccggccttcctacccacgaggctccgcagagccttagatagacacacgcggaccgggggtccaaccaaaccacgaagcaccggaacccaaggggtggaaaaccttcgacgcagtaggcacgaccggtccgcgaaatgtatgcaatgcggtccacccggaccagtggcagcccagagattaaacccagccccgacggaggggtgtccacaagcctcgcaggaaagatgggtatacagcccgcgtcaccaccgggctacacagcgccccaggacacgccgcgcgatgggatggagagcacaacagcgcgaccagggccctcaggtccgaacggcaccacagggggcacaggtacccgccccacgccagagcgcgctcaacaccaaaaatagttggggggaccgccgcacttttacgctcgtttagttggaagaaccaccgccgcaccccacttccatgcagagggggaaaacaacatcgggagacagagttgcgtgagcagggcaggaagtaaatgtccaccagagatgtccttgtcaagacaagcaggaagtgtgcaccgcgagggctcccctcgttatagggttagcaaacacgctggtgttgacatgacacgtcccgccaccctgttgaaggagggctgctcctccataccccacggtaactacggtggctaccaggggggctcccagcgcgggataaacatccggtgcgggaggccccggaaaagaagaagttcttgtcatcccgagccagaaacaattgtgacactgctcatagttgaaaaattggggaaaaaaaacctgcacaataac

SEQ ID NO: 539908 - DNA, 245 bp, Homo sapiens
  misc_feature (112)..(112): n is a, c, g, or t
  misc_feature (153)..(153): n is a, c, g, or t
  misc_feature (227)..(227): n is a, c, g, or t
  misc_feature (238)..(238): n is a, c, g, or t
atattctcatgtttaaatggaaataaagagaacctagaatggaaaaaatgattttaggctgagcgcagtggcacactcacacctgtaataccagtactttgggaggccgagnaggacggtttcgtgagttcaggaattcaagaccagcctggncaaaatagcaagaccaaatctctacttaaaaaaaaaaaatctctgggtgtgggtgcatgtgctggaagtccaantacttgggaangcccaag

SEQ ID NO: 539909 - DNA, 133 bp, Homo sapiens
  misc_feature (3)..(3): n is a, c, g, or t
  misc_feature (13)..(13): n is a, c, g, or t
  misc_feature (94)..(94): n is a, c, g, or t
ttnccgctttttnttttttccacaccggatggggcgattacagccctggaggactcccagcgaacgcgagcagccgggagccctctcatcgccncccctgctgacaggcagcgaccatacaagcttaacagtc

SEQ ID NO: 539910 - DNA, 195 bp, Homo sapiens
ctctacgaggatccccgggagtacagtccaatgatggtaaaagggtagcttactggttgtcctccgattcaggttagacactgtggacggtctagcgagctacggacgtcacctaccacgtgactttgcgcttacgttgcggcgacaatacttatcgctattgcttgtttaggactaatattggacggaattggg

SEQ ID NO: 539911 - DNA, 1258 bp, Homo sapiens
  misc_feature (663)..(663): n is a, c, g, or t
gattatttcgtgggtcaagacgccatctgctttgttagctgccctatgggcaccaaggggagtgaggatctgctgcctccggtgtgctaggccagtcaccaggctcgctcgcgatcccgcagtgaacatccagatgcctcaggtgggcgccggctgtgatggatcgatgcggcgaatcgagtgcactcgtggctgcgagtatacacgactcacgctggcgtagtatgcccaatcaagcctaggttatgagttgtgtggtcagtcgagagtctagagaacgagatggccgccgaagatgtggcgtgggcttactgaacgcggttgtacggctggcgccatccgaatgactcgactcgatgacgctctctttcgtacgccttggagagtcatgccctacttcgtaccccaagagtagtacacatgatggcgccagtacaatcatcgtccactcgatccttgagtagactgtatcgaagggccagtgcgatgttccagctggaattggtgaccagtcctgacaggtgacttaaggatagccggggtgcgcacagaggggcttgtcctcgggaaaacgagcccgtcacccgtcgatcatggagtgactggtgcaagtccctgagaaacgcgcagttacgttggattctcgcaacgccgcttccttcnactgggagcattagcatccttgcaccaaacattgcttgcagccctgcccgacatgctaactcagcccacgggagacgcattcaagcgaggttgcagcgcaattttggtccagagcccgttcatgttcagagctcagccagaagtggcaggctggaacactggtgcacgaggcacctcggcctaatttctggagcaaacgggcccttgcccactctggtgtccttccaccgactgccgttttcccaatgacatggcacaggcccacggtataggttttccttccggcacaggacaccgcgggcacccctcggaacgtctctcccccggctgggcctggccccccccgggtatttggccacaaagctgccacctgttggggctagcatggtccccggtgcccccttggccgaccgatcccttgtagcaccctcgcaatgacggagcccgagggacgcgctgtctccgaataaagcgactcgtgtttggggcctctctgcccggcaggcggactgaaccgcgccaccacactagcacctgcgcatcggctgactaaaagagtcaaatattcacgtcaaagcacgcatacctagcacct

SEQ ID NO: 539912 - DNA, 250 bp, Homo sapiens
cggttttttccccgtcacgaactcatgctttttcttcgtgtgaaaatgaacgcagtgtttttctgtatagaaacaatggacaatcttacctttcctgaactaaactctcctagtttttatcatttattattctcggttaagtgtgacatattcttgacattatcttcaacttaatttttgttcttgcttctactattttagtttaatttccaagtattttgatattgaactttcaagaagcaggaactgg

SEQ ID NO: 539913 - DNA, 146 bp, Homo sapiens
tataccatttaaaaaaaaagacagaaaggtagattttacgagccccattagagatcaggcagaaagttctagggatgtcagtgattgagtgagttggagcacgtgtctcagaagagtactgtagattaaatggctggagcctcgtt

SEQ ID NO: 539914 - DNA, 115 bp, Homo sapiens
cagttgtgcaattgtcgtgcacgtatcatgaatactacttagtgaaatgtcaatgatggaaaagctcaggacacttaaagaaaaatccccattgtgcacaacttgtccgatgatt

SEQ ID NO: 539915 - DNA, 137 bp, Homo sapiens
actgcagagaccctgaaaatttctgcacatcctgaacctacaggagttggagaattacttgggttgaacccctaaccaaggaatgccaaatttggatgctatcaaggtattctgtaatatggaacctggggacacat

SEQ ID NO: 539916 - DNA, 161 bp, Homo sapiens
cctctgcttccaggctgcgtcacactctcactaagggctctcatcttctggaaccatggccagcacatccaccaccatcaggagccacagcagcagccgccggggtttcagtgccagactcagccatggctccctgtgggtcagcctgctctggcttcagc

SEQ ID NO: 539917 - DNA, 205 bp, Homo sapiens
ccccgggggcgatggcccagggtggcccatggtatgtgctttctcgtgttacatcgcgccatcatagggtgatgggtagtgtgttggttaatacgcctagtatcatgagcgttatggattggaagtgaaatcacatggctaggccggatgtcattaggacggctgacagggcccctgttaggggtcctgggccatcgcgacgggg

SEQ ID NO: 539918 - DNA, 177 bp, Homo sapiens
  misc_feature (14)..(14): n is a, c, g, or t
gtcgtggaaaactnggtcttgttggggacaacctcactctggatggggtcaagtcctgtctgaagccacggttgggacaggaagccacagttgtcaaggccacaggcttcctcaagaactttctgatcgagcccttggtcccccacagttaggctgaggagctctatgtctggatcc

SEQ ID NO: 539919 - DNA, 320 bp, Homo sapiens
ttatatgtggatacacaatgcctaatagggagaccaccatgtgggcacgaaaataaagagataagctcaaaagcatcaattttacttttcatgcacatgttcttggaactctaaaccacgttctaatgactgaatataactatattacttacactattaaatatattagagccggacataattctactaaaatacctaatgcgggccgaggtgcggcggctgcgctcatgtatgtgctgtgcatgaacgtgtgcgctgcaccttcatgtgtgcgccgtgtgtttgcagtgtgctgtgttgatgtgtgatacgcatgcgtg

SEQ ID NO: 539920 - DNA, 265 bp, Homo sapiens
catgtgggaaccggggcaaggcagaacggggttttcctgacccaatgaaataaatcaagttaggggggctaaactccaaaagggattttccgaagactttgcgtaaaaactgttggtgctacagcttcttcctagagtggacacttcggggtccctggaagaaaatgggacagctgtgacagtgtttacctctcagaagttggagatactcagtggtggttttttaagcatgaaaaggaagatggcgccatttctaccatagtac

SEQ ID NO: 539921 - DNA, 400 bp, Homo sapiens
gtccacacagcagctaggctgactgagatgttcattaactgtttcttgaatgaataactgaaatagtagtgattaattctgctgaaagtagttagaaaaaactgcacaggaaaggtggcatttgttggaggtggatgaattggatttttgaatatagagctgtggttgggccactgcactccagctgaggtgacagtgagacaccatctaaaaaaaaagaaaagaaaaaaagaaagaaatgcaagcagaaaaacaacccaaggttcctcaggcatggaggaatgaaaatgcagggcttactggaagaatcatgaatagcgtagtatttagaaaccttagggagtatgttgagaagaagaaatagtgagatgtggagccagtttctgaaggatgttgaata

SEQ ID NO: 539922 - DNA, 776 bp, Homo sapiens
  misc_feature (98)..(98): n is a, c, g, or t
  misc_feature (163)..(164): n is a, c, g, or t
  misc_feature (169)..(170): n is a, c, g, or t
  misc_feature (182)..(182): n is a, c, g, or t
  misc_feature (188)..(189): n is a, c, g, or t
  misc_feature (191)..(191): n is a, c, g, or t
  misc_feature (208)..(208): n is a, c, g, or t
  misc_feature (212)..(212): n is a, c, g, or t
  misc_feature (222)..(222): n is a, c, g, or t
  misc_feature (229)..(229): n is a, c, g, or t
  misc_feature (239)..(239): n is a, c, g, or t
  misc_feature (314)..(314): n is a, c, g, or t
  misc_feature (322)..(322): n is a, c, g, or t
  misc_feature (340)..(340): n is a, c, g, or t
  misc_feature (362)..(362): n is a, c, g, or t
  misc_feature (401)..(401): n is a, c, g, or t
  misc_feature (416)..(416): n is a, c, g, or t
  misc_feature (422)..(422): n is a, c, g, or t
  misc_feature (441)..(441): n is a, c, g, or t
  misc_feature (445)..(445): n is a, c, g, or t
  misc_feature (462)..(462): n is a, c, g, or t
  misc_feature (536)..(536): n is a, c, g, or t
  misc_feature (638)..(638): n is a, c, g, or t
  misc_feature (645)..(645): n is a, c, g, or t
  misc_feature (647)..(647): n is a, c, g, or t
  misc_feature (657)..(657): n is a, c, g, or t
  misc_feature (704)..(704): n is a, c, g, or t
  misc_feature (762)..(762): n is a, c, g, or t
ggtgccgggagcagtcgccgctgccgcctccgcccgcggccgggacccccgtcctcgcccgggactccttacccggggaacctagaccaggtctccanaggcttgtagaagagaagcaggcgacccttcctgagttatcctggcttagcctcccaatctggcnnccctnncccttcccattnccctgnnanaactgtcccttccccanccanccaactgaantgggtanaggtcaaaanctcctctccttccttttccttcctaggcactcattggctagagacctgtttgctcttttttttgtgcccagaganactggaanacgcttcatctaagtaantgtggggaggggtctttttgantctacaagtccttgagcaaaaaaactgaaaaaaaaaaangaggtggaaaaaaancaaatnaaatgccccaaaaccccanacanggaaaagggcttccganaacacgggcaaactttcaaccgtggggccaaaaaaatatgctaaaggaaaatcaaaaagaaagcggccaaaaangtggtgaagggcctggacagagtccaggacgaatattcccgaagatcgtactcccgctttgaggaggaggatgatgatgatgacttccctgctcccagtganggttatnancgaggagaanggacccaggatgaggaggaaggtggtgcatccagtgatgctactganggccatgacgaggatgatgagatctatgaaggggaatatcagggcattccccgggcanagtctgggggcaaa

SEQ ID NO: 539923 - DNA, 217 bp, Homo sapiens
tcgagtcgtgcgtaatgttgacaccctacggtgtcaggcatagagcaagggattgcgtaccactgcctttcctggatggcgattagctactccaaaacaagctattttgctctgttcaagaacaagagtatttcagagctttccttcctgtagattaatttaaagctgctagtatgtccagttgctgaacctgtctggacagggtggtacctgagct

SEQ ID NO: 539924 - DNA, 140 bp, Homo sapiens
ggcttaggcaagatctggagagctgcaggacgttgcggaaagtcccgtacgcctacatgtaacgggatctgactacaagaccaccacatcctgctggacggcggcgcgtgaagctggagctctgggacacgtctgggcca

SEQ ID NO: 539925 - DNA, 129 bp, Homo sapiens
ctgttacaatggtttcgtctaacccgtgctagggtgctacaagggtccgctagatagagagataagtggatcccagaagaggaaagagtgtcatacatgatgaatccaaaggactgttcactcactgga

SEQ ID NO: 539926 - DNA, 821 bp, Homo sapiens
cgtagtggctcacacctgtaatcccagcactttgggtggtcgaggcaggtggatcacctgaggtcaggagatcgagaccatcctggccaacacagtgaaaccccgtctccactaaaaatacaaaaaattagcctggcgtggtggcgagcgcctgtagtctaacttttccaaccctccttacagccagctatcatcatgtgactaaactctgggtaaacgggttgcgagtagaagtaactaacactggaacctcaacctcttactgttgtgagcttccttcgttctgattttaccgcctgtgggaaaccaaaaaccataaagacccttctagatccacgagtggaagccacaagctgaggaaggccacctggcagaccagactgttagaggagaaagaaatgtgcttgcaccttgctcaaagccactgttcttgtgggacctccttgctgcagaagctcggttggtaccttactacaattggagcaaggttctttacttccctgagtctatggttgaatatataaccacttccaaaactcatgttaaaacttaaggccgggcgtaagtggttcacgtctgtatcccaagcactttgggaggctgaggcgggagaatcgctttgaaccgagcagggcagaggttgcagctgagcagagattggccattggactccagcctgggggacaagagcaagatccatctcaaaaacaaacaaaacaaaaaccttggttggggcgggtcacgtctgtgtccagaccgggggtgcccaatctgtactcgggggagttgggggcaaaacacctggtccctgggggaaaacc

SEQ ID NO: 539927 - DNA, 380 bp, Homo sapiens
aggttgagattcagttgttgtgagtattaatgtttgttcctttttatgctgaatgtattccatggtgcagacataccaccatgttgtttatctgttcaccagttgatggacatttgagttgcttccagttggggctattattagtaatgctgccaatacctttgggcatataatttgtgagtacgtgttttcttttctttttttatttttgagatggagtctcactcttttgcccaggctggagtgcaatggtgcaatctcagctcactgcaacccccgcctcccaggttcaagcgattcttctgctgcagcttcctgagtagctgggattacaggcacccaccaccatgcctggctaacatgggaaaaccccgtctgta

SEQ ID NO: 539928 - DNA, 524 bp, Homo sapiens
  misc_feature (493)..(493): n is a, c, g, or t
caaagtattgtaatgatggcttatggagtgtcagctggataaagagtgaaaatgaataaaaactaatggattgttcagtcgaatagcagatggtacaatggtacatggccagtagaataggggacccaataaaattgaagaccagtcagagtgggagtgatcaatccagcaaagtggaatggcaggggatcgtaggcacaaggtccagagtgtaacagtgacaatgtgtggctgatgtgggatcgaggaagtgattgtttttttttctaaaagttttccttgccatctcaggataccactccgttaaatattatggctagaaagaggaataagagatactaggaacataggaaatttttaaaattcttatctagcatgtatttcttaccttacatatgtcaggcagtaaaccccccaaaacataaaacgaatgggacagtatgttccttggtttaccgttgtgcttgagctcgtatgctgtacagtctccctnagcaggcagatgtagtcctgaattaaaaaaa

SEQ ID NO: 539929 - DNA, 764 bp, Homo sapiens
gcaccccatctctactaagcgaaaacccatctctactaaaattacaaaaattagctgggcatggttgcgcatgcctgtaatcccagctactttggaggctgaggtggggagaaatgcttgaaaccctggggaggtggagggttgcagtgacgccaaaaggtcgcgaccgttgcactcacaacgcaaggggggcacccacagcacagccaaataaacaaagagaaacaaaccacagaccaaaacaagatataagcaaagacgcagagaaacacacagaacaacagtgagacaacacccgcaacggaggggacaaatgcacaaaacaaacgcatcgggggagaaaaagaacactgaacgggcgcagaggccaagaaggagcgagaaagaccacggacgagaccagcgaaccacaaggagccacgcaccacgcgagcatgtccgggaaacacgagaacgccaccgaaggacaagcaccagtgctgaaacgcgagcgtggagagcaaaaaaagcaagaaagcaagcagaaccaagaaccacaagagacggagagcgggcgcgagacaaggcacgaggaggagatgacggcagggcgccatcccccagcaaaccaagtgagccgagagagcagagcgggcgggccgcctgagtgagctgaagcaagaagagcacgaccacaaacagagaagcgacaggggcataacggaacgaaaacagaacgaacgtggacgagacagacacagagggccggcctacgagaggaggaa

SEQ ID NO: 539930 - DNA, 392 bp, Homo sapiens
cctaagaagagatttggggagacaagatttttgtcccgaaacggctatttggttatgagtgggaggattaagagtcacatagcaaattaaaattcgccctacctcacccccttgctttttattagtgttactcctaaacattgcggctgcaaacatgcccacacacagatctgtcttgtgcatctctgattatttgctcatgtaaattcctagaatgaaatgtctcagttttaaaatgcaattataactttacccttttgaaatacaaaatacaattattttctgacagtttctaccaacttatgtaccaattagctacttattccatttcccttttctcaaaacacagattaaaactggatattttaatttttaaaatgtttcgacagtat

SEQ ID NO: 539931 - DNA, 132 bp, Homo sapiens
  misc_feature (102)..(102): n is a, c, g, or t
taaaaaaaaaaaataaaaaaaaggggggggggggggggggagagagagaggagagaaagaaaaaaatatatatatttataataataaataaaaaaaaatttnatagaaagaaaaggagggggggggggccgg

SEQ ID NO: 539932 - DNA, 269 bp, Homo sapiens
actgttgacccctatgctgattgaagagtatgtcaatgagtcgattttgggtctgtttgtcgtacgcggagtgagcttgtatataatcctgcctcatatggataagtgcaaggaaggggtacgtctatgtgttttgtcaggaggtttccaattagatgtgaggcgttttataccatcagactcgcctagttacaagacgatactgtcggctacgtactattggattccatgccctagggcagccattatgggttaccgatgctcgatct

SEQ ID NO: 539933 - DNA, 377 bp, Homo sapiens
  misc_feature (223)..(223): n is a, c, g, or t
  misc_feature (307)..(307): n is a, c, g, or t
  misc_feature (334)..(334): n is a, c, g, or t
ggcatgtgggttcgaccgtgcttcctcatccccaggcgggcggagggggacaccaaggtttagccaggccgtgctgaaggccaagattcagaaactggccgagagcctggagtcctgcaccgcgggctctggacgatactcagcgacgcagctggcagtctcgaggttcacgctctgccaccaagctccacgtcgctaggccacgacctcaagaatctgcccngcctgggccttcccaagagtgccgggcattacagggcatgagcccgcctgcgcctggtcacggttgcttaattttaaagccacnggtcaagggggatcctcctagaagtcngaacctgcaaggctatgccaagtcttgggccactggcccggtc

SEQ ID NO: 539934 - DNA, 226 bp, Homo sapiens
ggatccctctcacccctcagcagtcccaggccctggggatccctctcacccctgagcaggctcaggcactggggatccctctcacccctcagcaggcgcaggcactgggggtccctctcacccctcagcaggcccaggctctggggatccctctcacccctcagcaggcccaggcactgggggtctctctcacccctgagcaggcgcaggcatcaggggttccctc

SEQ ID NO: 539935 - DNA, 593 bp, Homo sapiens
  misc_feature (396)..(396): n is a, c, g, or t
ctcgtccgaatcctctcacatggtggcctttagaaaagatcttgcgccaggaggggtgatgccagcttatcttgcttctgaaatatctccctgggatggagtgatagtaccccctcagaaaaaggcttatgagaaccccccagagaagaaggaaggagaggaagaaggggggattcctgaagccccccctcaaggaaaggaagaagaaagcatggaaactcaggagtgacattcccttccctccttttcctacccaagggggaagactggagcctaaactgcctgctattgggctttacatggtgccaaccatttccgtgggatagggaagataccaggaaaaaaagtaacccccataaaagtgtcattcccctgggttttaatattggcttagcngccagtctcccatttgtgacctatgccacccatttataatggaggaacccaccatttcttcctaatattttataatccccaactcctgaaaacccctctctcaactaatactttgctgttgaaatgttgtgaaatgttaagggtctggaaatttttttttttaaaaaaacctattaaagtccttcctagtagggcta

SEQ ID NO: 539936 - DNA, 280 bp, Homo sapiens
  misc_feature (139)..(139): n is a, c, g, or t
ggggtttttttaaaaaaaagggggaagttttccggggttggggccgggagggggccccctttaatcccaggggggtttgggcccggggaaaggtttccccccctttttgccccctttttttttggggaaaaaggatttnggggggaaattcctttttttccccccccccccctttacattttgggggggggattttttttaaagtttttttttaggggggggggaaacgggggttttttttttttttttttttttaattcaattaaaccccttcccttta

SEQ ID NO: 539937 - DNA, 177 bp, Homo sapiens
  misc_feature (116)..(116): n is a, c, g, or t
ttgagatcgttgctttgttcagttacttatctgtaaggatgctctgggtctccttgtcagtattatcacgaagagcatgaaacgataaattctccacccgggaaagagcagagtanctgtgcagaggagacactcagagctgcttcagcctccagaaatcagagcagaaggtcgacg

SEQ ID NO: 539938 - DNA, 147 bp, Homo sapiens
  misc_feature (124)..(124): n is a, c, g, or t
acccacatcagcaagggtactctgggcaagttctctgtgcccatgctgaaagaggcctgggcgcttacgggctgaagagtggtctgaagaagcaggagctgctggaagccctcaccaagcactnccaggactgaccagaggccgcgc

SEQ ID NO: 539939 - DNA, 379 bp, Homo sapiens
ttaagatccactgatggtatgggggaaaggcactgacagtgagaaaggagcaggttcccttcattccccaaaagcagagcaagagtattataatgggtttcctgaacaactgtattagaaaaaggatcctaggccaggtgtggtggctcacgcctgtaatcccagcactttgggaagctaaggtaggcagatcatctgaggtcaggagtggaagaccagcctggccaacactagtgaaactccatctctactaaaaatgcaaaaattagctgggcgtggtagcgtatgcctgcagtcccagctactagggaggttaaggcatgaaaatcacttgaacccaggaggtggaggttgcagtgagcagagatcactccgcact

SEQ ID NO: 539940 - DNA, 254 bp, Homo sapiens
gttttgctttggcctccaggaagctcagggacactctgtagctcaacttcaaaaggaaaggaaatcattccttctttggctctctggtgctagttagcatcattcaacacagccaatttacaaattccctctgtgattcagatttgggagaatgagccaacttatggtatgtgcaggtcaccattacattacttgctgttgtagctgtgaataatcatcctgatttgggggtgttacttgcattgctctaaaag

SEQ ID NO: 539941 - DNA, 1047 bp, Homo sapiens
gttatgtctttccgtggagctgtcgccatgaagtaagcacgacccgtggttcccaatccgcttacatcctcgggcagaactcctctctgtcgtccctggacatggctgtagacaccctccctgatggactattcacatttatatgttgcagggctcgagctgatgcagatatttagcgaggtacaaagatctacccctggacacggagaggcgctacgcccaggaccgacggttttttgttttccagatttcttaatgcagaaatgcgcagtcgcgctttccatttccaagcaggaatcctcggcacgataaactggactgtacctctacagaaggaagcacaaaaagggacagacggaagaaattcaacagacaaagaacccgccgagcagtcaaataccagagggccattactggtgcatctcttgctgatataatggcccaagaggaatcagaaacctgaagttagaaaggctcaacgagaacaagctatcaggactgctacaggaacgcaaaaaaggctacgcaagcatctaacaaagactgcaatggcatgctgctacaggcacctacaaaggcagcacctaagcaaaagattgtgaagctgtgaaagttcagatccccgagtggtggcaaaccgctaaactggcagattagaatagtaaaactaacagactggactaataacatcatagcaaaaggacaaaagggacggacagcacaagacaatccacaaaggagcacaagaaacgcgataccagaaaaaagaaaaggagacacaaacaagaacgaacaaaaggcaaacaggaaaccagactaacaacacgactcgacacactgaacaggcaccacaggaaggacgcaaacagaagggagaaaaggaaaaaccaaaacataaaacacgtcagacacaaggtagggaaacaggaagagagacaaagccagcacataaatcgcaaaaggaaacgaagaaagaaagaaacagagaacagagaaggcaaacaaagacagagacgaaagagcgacaaaaccagagaagaaaacagc

SEQ ID NO: 539942 - DNA, 179 bp, Homo sapiens
tccgctgcgctctagaggacccgatgggcctgggtctcaataaagctctgcccatcctcgctgtttcccaaggcaggtggtgtgttgcgggccccttcagacccaaagctttaggcatgattccagctggctgcatataggagtcagttagaattgtttctttctctccccgattctct

SEQ ID NO: 539943 - DNA, 333 bp, Homo sapiens
agctgattcctgagtataaaatgccggcacgcggaaacagtcactctttcataaggttgcttccctactcaaacccacccttcttagcagatggcatgttgctctggcgcgagattttagcctaaacagacccctaggctacctgtgcaacatcaagcacagcaaaaggtcacccctttccggggggacggatactgaaccctgtcattccaattagaaacgtgtttcaaggacacagttactccggtctcagaactcttcaatgtgagtaggtaagtacaggcccgattacaagtgatgccacaaaaaaacagtattttgggcgtacgttca

SEQ ID NO: 539944 - DNA, 724 bp, Homo sapiens
  misc_feature (101)..(101): n is a, c, g, or t
  misc_feature (662)..(662): n is a, c, g, or t
cttctcataagattgatagaaacagctgatcgtttcgccgaaacaataattaggcacagagaacagacttcagctctctgaaggctgcatgaccacctgtnctctcatctacttctagtgtatgtcaaagctaaattacggtcaacacataggaaataagtcgaggaatccccgaattcgactagaacacttcaccaggtctctgtagatctagatctggccacattgtatcctgtgaattacttataggtcgatccctcacagaggttggcctccatcttcctgcttgaattcctctcgaggatcggggtgctcattgtgtgctttggctaagtcactctctgattgttagcaaacatctgtgaagagcttttattccatcagtcctgtttctgaagctgtacggtacaaattcattattatccccagttagaggctcaatctattggaattacatctaccatgtctcctagtgaaacttgcttctcctatggccaatcatccttacttaccttaatacctttttattttccctgaaaagttatcctttaaatcttcattaaaaagagcaacccattgcccattccacaaattacaagggtgacaatagttgaccaaacataaagttcaaacttacatcataattggggtgactcgatcanttaagtggtctatagtgttgtcctcccgagaatggttgcctgctttgattaattaacgcaag

SEQ ID NO: 539945 - DNA, 883 bp, Homo sapiens
gacagcgggcagcaggcagtcggggtggctcagacggattctcctcctcctcttgctcctccagctcctgctccttcgctcgtgaggacgcccggcgagtcctgcgccagggccgaggcagccatcgttgagtcgctagtcccgctgcagccggacatgcggagaggcatgtgcggccggaggtacaaaggatgccctcattaacgtgccccgatgtatcgcagcgtaactgcggggtggcaagagtccacagatagaaggtggtccacgggaaaattattgcgaaagggtgatgaagtcatgccccgtgtggggaaagtagtaatcagaaaaaaagcacgaggggccggagtctcatgggcaactgggacccaatgaactgcaggggccatgggggtgccccgagggctgagaatgctactaccctgacagtcgcgcgagacttcctgactgaagagccggacctcggaagcggggacagtgcaggcgcagcggtgggcaggaaaaggagcgccctgggacgcgcaggagaaacgaggacatgcattcacaaattggccagcgttcacgaatacgtcccggtgcagatttcagctgcgacagtggagaactacgtgacgaacggggaatccactggtaccagaactgcgcgagccggtgatagcgaggagccacggacgaggctgtccagaaagtcacagccactctgacagacagggcagactaggaacgcgggagacgaaaacaggcgtaaacggcggggggccagagactcggacgtgcccatcggcggaccgtgacagccggggaaggtttcaagtgaggccccaaaaagaagggagcacctacccccgcgaaacaaagaggcaaaagagacagggaa

SEQ ID NO: 539946 - DNA, 458 bp, Homo sapiens
  misc_feature (202)..(202): n is a, c, g, or t
  misc_feature (204)..(204): n is a, c, g, or t
tcggccagcaggatcgcgccgagatcgatgttcgaacgcagcaccttcagcagccggctgcgccgcacggtcaggccgaccaggttgtgctcgtcgcagaaacgcttgatcgcttcggcatgcatgcggctgtcgtcgaggacgagcaccttgctgacgggttggtcttcggtcatctcaagaattcctgatggtcggtcanancagttcgagctcgccgccggcatccaccgtcgccgtttccggcacatggaaatcgaccggcgcgttcgcgcacacgcacagcgtcgcaccgacccgcacgtcgccatcgagcgtcaggtcgtatgtcgccacgtaatcgggggcgagcgcgggcatgtagtcgatgctcgcaccgctcagcaggtacggcgtcgacatcccgagatcgggaaacggcgtggtcagcgcctggttgatcgcgccgcagcacaggt

SEQ ID NO: 539947 - DNA, 105 bp, Homo sapiens
actttatgtagtcatgcactttggtattaatatattagaaatctacagtctttggaggtgaatttacaaaaagcccagcctattatcatcctcctgagttatttg

SEQ ID NO: 539948 - DNA, 108 bp, Homo sapiens
atggtaaagagatcaacagcattgaattgtgtccagaaatggatattacctacatgacaactaaacagacaaagtgcaaaggcattcagctgagaaaaaacagtcttc

SEQ ID NO: 539949 - DNA, 865 bp, Homo sapiens
gggacgcctaaggtgggcggatcacttgaggtcaggcgttcgagaccagcctggccaacatggtgaaaccccatctctactaaaaatacaaaaattacccgggcgtggtgtcacccgcctctaatcccagctactcaggagactaaggcaggagaatcgcttgaacccaggaagcgaaggtgcggtcagccgagatcatgccactgcactccagcctaggcaacaagagtgaaactctgtcttaaaacaaaaaaaattaaacaattatatccgggccgggcttggggggtcaactcctataataccagcaccttaggaggccaaggcggaggatcacttgaaacccaggaggcagaggttgcagtgagccaagaccggcaacgtggcactccaaggcctgggcacacagaagtgagacctccatcctcagacgagaacacaaccaaccacacacacaacacaaacaaaaaaagtagcggaggaccacacggaacacagaaaagcagccgcacacacacccacgtagagggcccagggccacacaaaataaatgacaaaagggcacacgaggcccacagagaaactcggccacaatagggccagcgccacaccaacagaaaaaacgcaccgggggcacaaggaccgatcagaccaacaccgaaagaaacgggagcacaaggggccaaaccaagagcaccgcagcccaaaaacaaatcgccgccgcggagagaccgaccagccaagacaagcaccagacgacacacagaacgaaagagaaaccagaggaaagtagacagcacagcgaaccacgacccgcaccaaagacagacaaccaacacacaaagcaccaagccaaagacaaaac

SEQ ID NO: 539950 - DNA, 562 bp, Homo sapiens
  misc_feature (301)..(301): n is a, c, g, or t
gaaaaattttccttaaattacatctttttaacttaaaagctttttgggaatttgaggaaaattataatagaaggcattgaaaactttccgaaataaaaaacaaggcaattattaactccaagaaaaccaaaaagcataatcataggctgtaatcatagtgtataatgtagcttttagtgaggcccaacattacatagatcataataatgtaaacactgaacatcaatttaaccaaaagtaagagttcatatataaatctctgccaaaatattgctcttttaaaaagtaaaccattgaggcntgatgcagtggctcatgcctgtattcccggcactttgggaggccgaggcaggtggatcacccgaggtcaagagttcaagaccaacctgggtaacatggtgaaaccccggctctactaaaaatacaaaaattagccgggcatggttgtgcgtgcctgtaatctcagctacttgggaggctgaaacatgagaatcacttgaacctggaaggcgatcacatgttgcactatagcctgagcggcagagctagactccagctcttc

SEQ ID NO: 539951 - DNA, 244 bp, Homo sapiens
atgttggtgggtgtgtgtgtgtgtgaggctggagacttcactgtcctaatattaacagcccatttttctatcagtgaagtttcatagcaattttgattttgcgtagaaatacttaacctttcgtgtgtttagatacattttgtttctatactttaaattatctagatttttttatttgtacagtcaaatcaggttggaaccgttcatcacgtttttaaatgagcaaacaaaatacccaggcaat

SEQ ID NO: 539952 - DNA, 249 bp, Homo sapiens
gtgaggtgcagccgttggggcggctcagaggcaggtgactatgaaggcttatatttccaacagagttccacagatgaggaaataacatttgtatttcaggaaaggaggatcttcctgttacagaggataactttgtgaacttcaagttaaagcttgtgctctgagccagttaaatacaagcttctggcagaattgaagttgaaaaggatttatttctgttgggagagaatttgctggatttgtattaga

SEQ ID NO: 539953 - DNA, 945 bp, Homo sapiens
ggggagaagatggctgcccagaagtgcccgggctctcccggcagttgagagaaaggtggtcctgagagccagtgggaggctccctcctgggtatgaccggtaccaaactcgagcaccagggtggatgttcggtgtgggaagtctggcagtcgtttcagggttatgggacctgcagagtgtgtagcagacgtcaggacgagccagcagttgtgtctccccgggatgcctacagggggctagtatgcgctggggctgcggcgtgccgtaagctttgtgtgtctttccagagacgcagccgctggaagctgtgtagcctgagggtggcgcagagaggatggggggtctgcccttctgatgaaattccggggagtggggggcatggaacgatatgacgctccaagatgaagggttcccgttttgacgcatttggtggtgggaatgcttcaggtacctctgtggttcatgagcagtttgtgaaagcttgttgaggccgtgcctgtttcaggtatacgggtatagaaggtcgctatgcacaggaggtctttattcgttgttgagtcaaaacagaaatatgctgggggcaaggtagaaaagggagttggttgagaggtagagaaatcctgaatggagaccaagaggggtgtgtgtgtttggaatacctatgtgaagcggtccattaaggtgaaaggcctaaatgagatgacaggaaaagagaggtctttcggcatatgcaactgattagttgttgtgaaaatgtcggtaagaataccaaggagtgtttgctttttaccatgatgttgcctcgggaagggactgaagggcctgttctaaaaacaattttgagtaatgccgaaagctagaaggcgataaaggaagacgatggtggagggggaatgtttttcacaagggggaggaatggtggataagagagaaaaggaggggggg

SEQ ID NO: 539954 - DNA, 399 bp, Homo sapiens
ccgccctcatcatacctactagggggaattctactagacacatctgtgctttaatcatagatgttaatagaggaagcagatttcacgctgcagattcctgaatagaggtgctgaaagagggtacttctgaactcaggctaagttgaagaccagactgtgtagaaaggctgaatcaacaaggaaagacctgacagctaggtacatacgctctgacatagtactcccatgacggctttcagagacacatgtgctgatagaaatctaaacctatgaaacttcactgctggcgacttctatggccgaggactgaacagcgaaacactgacccagatgctatgtgccagaagagaactagagcattgcagcatggagatcgcctatgtatgatgaaggacggat

SEQ ID NO: 539955 - DNA, 343 bp, Homo sapiens
acatactgtaatcccaactctaggactttctgggaaggtcaaaaagatagacgtagtaaaaggatgagtggtggtcaggggtggaggagaggaggaggcacgaaagggtgaagtacagggaatttccagcagtgaaactatttggcatgatgctgtatgggggatataggacattacttattggccaaaacccatattctgtgaaactcaaagaatgaactctagtgtaaactatggacttgggaaacaaaagacattctatgacaagcattctgtctaaagtagcgggccgtccatttacaaaatatagtacttttcaataggtagagagccgggaaagggt

SEQ ID NO: 539956 - DNA, 147 bp, Homo sapiens
ccagtccccatgtgcaaaaaaggtcctgtacagatctctccgggctctcctttttcctttggaaaaacttgttcctatttcaggaaagggaaatggtgtccctcaggccctgggactccttttccagccaggctggggccccaggtc

SEQ ID NO: 539957 - DNA, 138 bp, Homo sapiens
ctaactcttacacagtcctgctgttgcactgcctacaagccttagcctgtctactcctcagccaacagcacaaataactgtatcatatacaacaccagaacgggtcatggctgctgtgaatggacacagcaacagctt

SEQ ID NO: 539958 - DNA, 797 bp, Homo sapiens
acagtgctccaaagaaatcagtttacaaatggataactcgttttaagaaggcataaggtaatgttgaagaagaagcccacagtggcagatcatccacatcagtttgtgagaaaaaagttagttcatggcgtaattgaagaaaaccaacaattaacagcagaaacaacagccaacaccatagacatctcagttggttcaccttacacaattttgactggaaaagttcagcaaactttatacctgataggtaccaaaaccattgcacccagatcagctacagacaagaatagagctttcaatggaaattttaaataaatgggatcaggatcttgaagcctttcattgaaaaattgtaacaggagatgaaacatggctttaccagcgcaatcctgaagacaaaacaaagcagtggttaccaagataagtagttcagttaaagcacaagaggactggttgagagcaaaggtcatggcaacagcttttgaatgctcaaggcattttgctttgactttctgtagggccaaagaatggtaacgtgcttatcatgggaggtgtttgagaaacttagccaaagcttcagcagaaaaatccccgagaaagaccagagagttcttcaacacaacaatggttctgctcatccctctcattaaacaagggcattttgcaagagttttgatgggaaatcactagggattcacccttcaggtcctgggtttgggacctttttgactttttggttccctaaccttaaaaaaaatttttagggggagtccatttttttcaaggtaatgtttaaa

SEQ ID NO: 539959 - DNA, 155 bp, Homo sapiens
  misc_feature (16)..(16): n is a, c, g, or t
atgagtagagtgatcnggcaaaaagaaaaggattgcacattttttaaaggtccgttagctcaattgttttgagaattggcaattatctttatctgtgtcgtgactacccacttagctgcaatgtgggagtgttccgttagcatggaaaaatttac

SEQ ID NO: 539960 - DNA, 124 bp, Homo sapiens
ctagaggatcccatggccggtgaagagggcaggctggtgcccagttgagtatgagttacagccagaaaatcactacgctacacacaaagctaggggtggtgggaaggatcatccctttcgctga

SEQ ID NO: 539961 - DNA, 274 bp, Homo sapiens
ctccagcctaagggacagagccaggccatgccacaaaagaaaaaagtggacaaattgtatgatttttagtagactcacagagttgtgcaactatcaccacaatcaattttggaagattttcatcactctaaaagaagccatatcccttagctgttactctcaattctcccttccccagctcctgacaaccctaaactttctgtctctgtgaatttgccttctctgcaaatctctttttttgagatggagtctcctcgctcttatttcccaggtt

SEQ ID NO: 539962 - DNA, 987 bp, Homo sapiens
  misc_feature (1)..(1): n is a, c, g, or t
nggttgagtgcccgccccgcgtgtttttctcgggagaacaaaagagttttgcttcgcccccttaattggtttgtatattgttgtaaagtagttggttgaacagcagtttgttcttcaacgacgggtcgtctctcatgggggatgatatttatgttgacacctcccgtgtgtgttggtgaacgttatgttctcctgttggtgcgccctgcgcgctgttctttttgctctcttattgttctgccgctcctctgttgcgccgcacctctcgctagagcgtctcctttccgccagtctccttgttatctcagattctccccgcacgcgaggggtctccccacaggagtctcctctctctcccctgtgtctctcgtctcacagatctcacaattgtgcgcccccccacagagtgtgttctgtgtgcacacctttctgtgggtgtcactcccgcggtgtttctgcggcgtggcatatatatttcttttcgcacactctctctgatcacagtatcatgtctctccccccttatgttttttctgggtggcacccagcgtgcggcacctgtggtgcactctcttctgtacacgttgcgccacactctgtagagtgagttatctcctcccgcggttgtgagaccccccactcttttggattaataaaaatatacacttcacccacaagctcttcttgcacactctcactctagagcttgtgctccccaccactctatgaggttttataaaacacacagatgccatttctcccaagactcgtgtttatacccacaacccctcttttcccccgtacacgacccggggtgatatatataccggtcacaagtgtcttgtaaatttgttgggcgcccaccccccatttctaatgcgccctctcgtctcctatgaaattaattctccccttaaaaatttttgtaaaatagggcgcccctattttatcccctttgccccccccttttcccccttttgggcccca

SEQ ID NO: 539963 - DNA, 565 bp, Homo sapiens
gggatcataaactatatgcgtcccgccgcgcgacgagaacaccgctatatagtagcagccagccgcgtcgcggccactacgagcggagacgatatagtagagaagcggagcggctagaggggcagcaccaccccaccgctcactgacgagagcgcagaccaccccttcgacggggggtggcgagagcgtgcgcccccacgccgcggtggtggcgcccccacaccactcgcgcgcgccgcccctcacactctctctcgctctctcctcgcggctgacaccggccacgcgctgtggctccccctcctctctcctcacacgtctctccccccccgctctctctgtggagcgccccctcgcgcaggcgcgcgctactacggtccacacagcagggccccctgctctctctataccgccactcgccgccgctagtgtgacgccggaagatacaggagaccccccaccaccccacccccccccccccctcacgcccccaccgcgcccgaatagagcgagccgccccacaaaacagcaatataatagggagaacaggcaaacaaaagacaga

SEQ ID NO: 539964 - DNA, 414 bp, Homo sapiens
acattctccgaccaagggccaaaaataggcaaagctctctccactaaatcggtttcctaaattggggatctcaaactagtaaaatttcagaaaactttcggaacttttgtcaagagcatactaaaaaagtttatcttttgtcgtttactatcattaaagccataaaacagcattttacaaggaaattttaaaaattaagaatatggcataactcccttccagagaggtagacccaaaaatattctgaaaagtttttgtaatgcattaaaatgacggcataacattttattaacactctgttacgtttcttttttcttttttttttgagacggttttgctcttgttgcccaggctggagtgcaacggtgcgatctcggctcaccgcaacctccgcctcccgggttcaagcgattc

SEQ ID NO: 539965 - DNA, 451 bp, Homo sapiens
gacagtgctgaaccttatatatattttttcctacacatacatacctatgataaagtttaatttataaattgggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaaaa

SEQ ID NO: 539966 - DNA, 129 bp, Homo sapiens
  misc_feature (25)..(25): n is a, c, g, or t
  misc_feature (58)..(58): n is a, c, g, or t
  misc_feature (98)..(98): n is a, c, g, or t
atttatgtgagatgtgtcaatactngtcttgcgttatttcggctacttgaaaataagntaaaaaagatagtgtttggttccaaaaaggaaaagtcagnctctcctgcatgagtgggagctgcaaccttt

SEQ ID NO: 539967 - DNA, 397 bp, Homo sapiens
  misc_feature (50)..(50): n is a, c, g, or t
tcccccggttcttacagttccccaatctcacgtcaatagtaattcaagtnctggagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagaggtacacactctcctgacagaggaaagctgtttgctgcactggtttactggatagattaactgggttgaggctgtgtaatttaatatgattttaaataaaccttttacagagtctgataaagaaaaaaaaaatggcctacttggcctcac

SEQ ID NO: 539968 - DNA, 276 bp, Homo sapiens
cattgcaggctgaacctgacccttgtggctccctgctctctgccagccctttctcaccccttggtcccacggcccctggtctctcccctctgctagaatctcgctgagggattggtggggagggggtggtcacgcacgtctgtggagatctgttgccccctgaaggccggacaggaagggccagggcggacaaggtctttgagaactcggtggcatcccgctcctgatggcctgggtcccaccgcccctcccccagccttcctgacagcagaggag

SEQ ID NO: 539969 - DNA, 196 bp, Homo sapiens
gacgctgttaattgtcagttcagtgttttaagttgttggtgattgtagatattgggctgttaattgtcagttcagtgttttaacttgttggtgattgtagatattgggctgttaattgtcagttcagtgttttaacttgttggtgattgtagatattgggctgttaattgtcagttcagtgttttaatcgtcgacg

SEQ ID NO: 539970 - DNA, 2359 bp, Homo sapiens
ggatgtgtgttgcccgaatgatgtgctctgtgaggcaccggctagttgctgtcccgagggtgggagtgcagcgtgtggcataggttgcggttgtgtagagtggtccgctggtggtccgcaggttctgtcgtatcttcgcctctgcgcgctccttgaatggaggaaacttttctttgccagtgcgagttgcaattgtggggaaaggatggatagactctccgcagggatgtccaggttctcggtaggttgatcccaaacattgcgtgggccgcgtgtatacgaggcgcctggatggcgttaggggtcgccagggcagttgtcgcgactcgctgcgcaaaagtagaatgttgctataaggccacagttctcctagaagtcaagtgtccctggagggaagaggccaggccgtggctcctgttctttcctcttcggagctgcttcgctcacgtgacatgagtctttagaaatcaatagtggctgcagtggtgaccttcactgaggcgatctgcttcctgctctgtattagttatctgtttccgagaaacagaagtgatcacagaacttcgtggcttaaggcaacaaacactgattatctcacaggcgctgtgggtcgggatttggaggcacattcagctgggtgttcctggctcagtgtctctctgggttgtagtcaagctgtgggtcatggctgcagtcatctcaaggcttgactggtgacaacctacttccaaggtcactcacatggctgttagcaggtctcagaaaatctgcttataaggtgactgacacagtggctggcacaccttcatgcctcctgcctgggctatccattggtggcctgagtatccttatgtcatggcagctggctttcctagagtgactgtgaggatcacctgccactcccctcgctccgccagacaacgcggagggcctccctgagctgtgactttgctccgccggtgataatttccaggttactgtgtaggagcgtctggcgcagcatcgtgtgcggaagaccgagagagggagtgtgcgtgtgagcctgtcaggccgggcgggtccatatccgggtggaccgggtgggtggggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggaggaacccgaagagggctcgcctagccggccacccgctccgaacttgcccgggaaactagtgcggagggaggggccgggccctggccgcggcgggaggagtcgctggcgcagctgcatccagccccgttggcttccttcccagctctccttcgcctcctcctcctcttcctcctgtatgagtcaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagca

SEQ ID NO: 539971 - DNA, 953 bp, Homo sapiens
gagagaaagcgacctcaagatacaactggcaactgaggaaaaggcctcaattcaacaagtagctaacaagcttgggagtttatttcggaatctttaaaagactcttctgcttacccacaatctgggatccactgcaggaaaacaaaaaaggacaacttcatttaaagagaagcaagaagtaaacatgggacaaattgggaatgtttaagtctctgaaactccgcactgacacaaggaaaataagattgataacttaagcttaacattctgaggcataaagaaaacattaactttggaagtattccatccttggattccggaattccaggtttgaaagagacagtgtggttcacatctcgtgggtcacagtatcacagcttctctttacaatttataatcctatgggttggactcgttgactgtattttttaaaaggttgctcgtcaagttaactgagccttggaattcatggattttctaaagactaacaaatgaaaatattttcctgttgaagaacccagcggaaattttacagcaaacaaatttcatgttcctattgggtatttctgagaacaacaggaaactatctataaaagcatccaaaagattccagattatttgcaaaatacattgggaaggtcatagaggttataacctgcattcccaaaaggaagactggcagctgatgaaagtggcttccaaactgcaaaatttggacggtgcctttaacgaagggttaaggacgtttacaggttcccacatgggttgctaataattgactccctttaaagtaacactttcgtattggggtggcatgttacacgcaatgggaggtatgagccactggggtatacatactgccacactaggtgttggcccatatatgaactgttacacatcatgggtcacatcaacaggacgcgaaatggaacataaacacttacactgaatta

SEQ ID NO: 539972 - DNA, 2482 bp, Homo sapiens
ggatgtgtgttgcccgaatgatgtgctctgtgaggcaccggctagttgctgtcccgagggtgggagtgcagcgtgtggcataggttgcggttgtgtagagtggtccgctggtggtccgcaggttctgtcgtatcttcgcctctgcgcgctccttgaatggaggaaacttttctttgccagtgcgagttgcaattgtggggaaaggatggatagactctccgcagggatgtccaggttctcggtaggttgatcccaaacattgcgtgggccgcgtgtatacgaggcgcctggatggcgttaggggtcgccagggcagttgtcgcgactcgctgcgcaaaagtagaatgttgctataaggccacagttctcctagaagtcaagtgtccctggagggaagaggccaggccgtggctcctgttctttcctcttcggagctgcttcgctcacgtgacatgagtctttagaaatcaatagtggctgcagtggtgaccttcactgaggcgatctgcttcctgctctgtattagttatctgtttccgagaaacagaagtgatcacagaacttcgtggcttaaggcaacaaacactgattatctcacaggcgctgtgggtcgggatttggaggcacattcagctgggtgttcctggctcagtgtctctctgggttgtagtcaagctgtgggtcatggctgcagtcatctcaaggcttgactggtgacaacctacttccaaggtcactcacatggctgttagcaggtctcagaaaatctgcttataaggtgactgacacagtggctggcacaccttcatgcctcctgcctgggctatccattggtggcctgagtatccttatgtcatggcagctggctttcctagagtgactgtgaggatcacctgccactcccctcgctccgccagacaacgcggagggcctccctgagctgtgactttgctccgccggtgataatttccaggttactgtgtaggagcgtctggcgcagcatcgtgtgcggaagaccgagagagggagtgtgcgtgtgagcctgtcaggccgggcgggtccatatccgggtggaccgggtgggtggggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggaggaacccgaagagggctcgcctagccggccacccgctccgaacttgcccgggaaactagtgcggagggaggggccgggccctggccgcggcgggaggagtcgctggcgcagctgcatccagccccgttggcttccttcccagctctccttcgcctcctcctcctcttcctcctgtatgagtcaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagaggtacacactctcctgacagaggaaagctgtttgctgcactggtttactggatagattaactgggttgaggctgtgtaatttaatatgattttaaataaaccttttacagagtctgataaagaaaaaaaaaatggcctacttggcctcac

SEQ ID NO: 539973 - DNA, 2173 bp, Homo sapiens
ggatgtgtgttgcccgaatgatgtgctctgtgaggcaccggctagttgctgtcccgagggtgggagtgcagcgtgtggcataggttgcggttgtgtagagtggtccgctggtggtccgcaggttctgtcgtatcttcgcctctgcgcgctccttgaatggaggaaacttttctttgccagtgcgagttgcaattgtggggaaaggatggatagactctccgcagggatgtccaggttctcggtaggttgatcccaaacattgcgtgggccgcgtgtatacgaggcgcctggatggcgttaggggtcgccagggcagttgtcgcgactcgctgcgcaaaagtagaatgttgctataaggccacagttctcctagaagtcaagtgtccctggagggaagaggccaggccgtggctcctgttctttcctcttcggagctgcttcgctcacgtgacatgagtctttagaaatcaatagtggctgcagtggtgaccttcactgaggcgatctgcttcctgctctgtattagttatctgtttccgagaaacagaagtgatcacagaacttcgtggcttaaggcaacaaacactgattatctcacaggcgctgtgggtcgggatttggaggcacattcagctgggtgttcctggctcagtgtctctctgggttgtagtcaagctgtgggtcatggctgcagtcatctcaaggcttgactggtgacaacctacttccaaggtcactcacatggctgttagcaggtctcagaaaatctgcttataaggtgactgacacagtggctggcacaccttcatgcctcctgcctgggctatccattggtggcctgagtatccttatgtcatggcagctggctttcctagagtgactgtgaggatcacctgccactcccctcgctccgccagacaacgcggagggcctccctgagctgtgactttgctccgccggtgataatttccaggttactgtgtaggagcgtctggcgcagcatcgtgtgcggaagaccgagagagggagtgtgcgtgtgagcctgtcaggccgggcgggtccatatccgggtggaccgggtgggtggggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagagctgctgatgcaaaagagaaacaattctgggtgactcagcttcgagcttgtgccaaataccacatggaaatgaattctaagagtgctccaagctcccgaagccgaagtctcactttgctcccacatggaacacccaattctgcgtctccctgtagccagagacacctcagtgtgggggcccccggtgttgtcacaatcacgcatcacaagtcgcctgcagccgcccgaagagccaagagtcagtattccggccagcttcacgaagtcagagagatgatgaaccaggtggaagggcagca

SEQ ID NO: 539974 - DNA, 138 bp, Homo sapiens
atagccggcacctttcaagcggagatctggcctggagatgagagtggtgtgcaataaccaaaagatgttggcaggccatgtgctccctccggaggctctggaggagaatccatgcctggcctctttcgggttctggtg

SEQ ID NO: 539975 - DNA, 2830 bp, Homo sapiens
ggatgtgtgttgcccgaatgatgtgctctgtgaggcaccggctagttgctgtcccgagggtgggagtgcagcgtgtggcataggttgcggttgtgtagagtggtccgctggtggtccgcaggttctgtcgtatcttcgcctctgcgcgctccttgaatggaggaaacttttctttgccagtgcgagttgcaattgtggggaaaggatggatagactctccgcagggatgtccaggttctcggtaggttgatcccaaacattgcgtgggccgcgtgtatacgaggcgcctggatggcgttaggggtcgccagggcagttgtcgcgactcgctgcgcaaaagtagaatgttgctataaggccacagttctcctagaagtcaagtgtccctggagggaagaggccaggccgtggctcctgttctttcctcttcggagctgcttcgctcacgtgacatgagtctttagaaatcaatagtggctgcagtggtgaccttcactgaggcgatctgcttcctgctctgtattagttatctgtttccgagaaacagaagtgatcacagaacttcgtggcttaaggcaacaaacactgattatctcacaggcgctgtgggtcgggatttggaggcacattcagctgggtgttcctggctcagtgtctctctgggttgtagtcaagctgtgggtcatggctgcagtcatctcaaggcttgactggtgacaacctacttccaaggtcactcacatggctgttagcaggtctcagaaaatctgcttataaggtgactgacacagtggctggcacaccttcatgcctcctgcctgggctatccattggtggcctgagtatccttatgtcatggcagctggctttcctagagtgactgtgaggatcacctgccactcccctcgctccgccagacaacgcggagggcctccctgagctgtgactttgctccgccggtgataatttccaggttactgtgtaggagcgtctggcgcagcatcgtgtgcggaagaccgagagagggagtgtgcgtgtgagcctgtcaggccgggcgggtccatatccgggtggaccgggtgggtggggctgcccctccctccaggtcccgaggtggataaggggtggggagtgacgtgcagagattccctttcgccccttcggatccaagagagggtggcagaaggaatgcgtgggtgacttggcgtggatttagggcgtgcccaccctgcagatcggcctcctagagtgtcccgagggcctgagaggccgcagggacacgaaggaagagaaggaggaacccgaagagggctcgcctagccggccacccgctccgaacttgcccgggaaactagtgcggagggaggggccgggccctggccgcggcgggaggagtcgctggcgcagctgcatccagccccgttggcttccttcccagctctccttcgcctcctcctcctcttcctcctgtatgagtcaggcatttcccggggatttggagcaggcacgcgcggcccgggcgtccggagctgtagcagcagcagcagccgccgtgccggggccgccaccgcggcgggcacccgcgtcccgggcgcccacggaccatggagagggcagtccagggcacagacggcggcgggggtagcaacagcagcagccgcagcagcagccgtgctacctcggcgggctcctcgccctcctgctctctggcgggccggggggtctccagccggtcggcggcggccgggctcggcggcgggggaagccgcagcagcccgggctctgtggccgctagcccgtccgggggaggcggccgcaggagggagccggcgctcgagggcgtgctcagcaaatacaccaacctcctccagggctggcagaacaggtacttcgtactggatttcgaggctggcatcctgcagtattttgtgaatgagcaaagcaaacaccagaagcctcgaggagtcctgtctttatctggagccatagtgtccctgagcgatgaagctccccacatgctggtggtgtactctgctaatggagagatgtttaaactgagaggtgcgttcttctcccagtaacttttcagacaggcctctagttgctatggtgatggctctcttgttttttgattttttgtttttttaaattgcctttgacagtttgctgtgtttggaggactctgtggtgacacacattgcctctcttatccctgggtggggagatggagctgacattaggaattacttgtcctaattaactgaggaattaaggacaaaggaaaggtgagtgattcccaaagcagcgcgccttaggacttcgaagatcttaagtgttagctcagtatattctctttgacgtaatagtatgaatcttcactacagtgccctgtgagggctgtgctataagggcacaaaaaagacctttaagggtcctagtgttttccccccaaagtttctctagaaccgtttcttagtaaagtgcccctttgagttttgttcaatccactgtcgtagagcctggtgagaagccaactggaatggagttaatgtccctttgtatgctttcttcccttctctttgcttcttgaaaatggatatctttgctttaataaagaaaaaaaagaaaatggatacctgcccagcatcccggaaatgaggatgactttccagggagtccagtattcaccctcaagacacatccatcgcacagaaatgtcagacttgtaataaaattgcagtgtaatttgattgctagatcattctaccaggatctgtcatggttgcattgctgtgattcttctgccacttttcttctaataaaataatga

SEQ ID NO: 539976 - DNA, 1363 bp, Homo sapiens
  misc_feature (80)..(81): n is a, c, g, or t
  misc_feature (87)..(87): n is a, c, g, or t
  misc_feature (97)..(99): n is a, c, g, or t
  misc_feature (102)..(103): n is a, c, g, or t
  misc_feature (146)..(146): n is a, c, g, or t
acgcagacccctcttttgcacggcagcccgcccgcaccaccatggccacagttcagcagctggaaggaagatggcgctgnnggacancaaaggcttnnntgnntacatgaaggagctaggagtgggaatagctttgcgaaaatggncgcatggccaagccagattgtatcactccactgtgctgactggctacaaaaccgtcaccactaacacacacctgcagcagccacctcttgcaaacagcaagcacagcttcttcctctgctacccctgcgcgagagcaacgctttgcaacgaagaccaccagcctgactggcacgcaacaaacctcaccaccctgctcctgcacacctcttaccagcactgcgtgcactctgggcttcacgccatccaggcacgctggcgactgggcgacagggacacagccacaaaataaccaacggacacaccctctgcacccacgacctgggcgcacaactctacgcctgcgctggcacgctagctgctcccatgcaaccgaactggtcaacccgtgctcacctcggcgcactccctacttgcaacaacacacgctacagacacctaacaccaacttcgcaactcaacctccaaccctctctgcgcaccacggggacggctctcaacttctacaccgaaggacacgtggaacgccaaaggccgtccacggctctcaaccgctggaagcccacaagcttccttcgccgcttagcttgcaccatacaatctcttcggtcttctcaccgcgccccacgcgcaactacaaccctggggtggcttcttccacaacctccatcttcgttcacgatactacaaattacacaccgcacttctcttcgtaccaaagttgccaacgccccttatctctttccacacaagcctgcatggctacgggaacttctaccctcccacgcgcactccaactccccgtatgggggccttctacacacctcacacaacctcacacgtggtgccttcagacggcccctacactcaaccagccgcccgacgcacaccaccagaaccaacatgaccacgccacgcacaccgacagcggcgcccgcacccgcgccagcacaaccacccgacgcacgcacccacacaacacgcgcggcgcggccccgaccacccccgaagcacgtccccccgaccaccaagggggacccccacacacaccacctcactccgcgaccaccaccgacacgctataactgcgcacacacacccggccgggccaccacagaagatcatcgcgcaccgctatcaaaacagcaagcacagccgaccgcccgcccccacgcaaccaacaccaacccgcagcacaagcggcaacaaacaccgcgcc

SEQ ID NO: 539977 - DNA, 1505 bp, Homo sapiens
aaaacagagaccacggaaactgaatatggtggtgtagatttatagccggatctatcatcgtcgagtaccgagagctccatccacgctcatgctcgcggtgctcctcgggtaaagatggcgtaaggaactactaggcttcgatgtctatcatgatatgcgagccgttgtttacgtgggctgaaacacgcattatctgtgtactcaagtagctggattagcgactattacaagatgctcgtgaaatcgcgctatgcgcaattgggtatccagacaccggtcatgtgagtgagtaaatccaagatctcataaggattcaggtattacgttgccatagaatgtttgatgaaccctatttttcgcaaccacaagaagcatgatctcaattgcatataatccaaaacggtacggcaatgagagcatcctgttgctctgatgcctttccagacgtcattaaaccgatgaagggatgggtaatcgaagaaacgaggtatccctttcttattaatgagtaaggttccattctcgacccagcacaaatactatcttcacgagactaacgtacggctaagagggaattattcctggctcccacctcagggtgtccttcggagacagtgtgaacaccaatttgaataaagggttcgttcctggacacctttagccttttggttgcatcacaatagcccaatgaactgtggaaactttcaccttttcaatttttggcacggttctcgcactcttactttccctctggggaaaaacaatcgcaaacacagtgattacgaaggcaaagggcttggctggagaggaaagtagtgcgactcctaaataaggttaaccatttacgtccgttgggtgcgactaactccattacaaggctcgcttcgggcatgatacggagattggtccacgggctatccatctcctggcaagaacaagcttttgggttttctctcaaaggaaccttgcgtcttataatccttacaacaagatccttctaaggactgcacccttgcaattagcgttcggctgtacccattttatagtgcatagcgtttgaatcttgccttacataatacggaagtgtttccactgaacccgaacgcgacatcacttcgagcgtcacacatgtgttgtgttctatcaattctcgtgggaacccacgaagatgtgcgccggtgacccacccaattccctgtatcgcttccatgtaaatttctcgtgtacgacactgtgagaaggcatcggggttcccactggcccatacgggaaactgtgtgcttagagcccacgcaacgatatcatacgctgttgacaaacccgcgtcgataatttcacatccacgcaatgcgcacatttccagagggggctagagtgcatatcctgtgaacgcgctgtacaaccaagtgttctggtatctcgagacgagcgaacgcccacatcctgtgcaacatgcagcacagttcaatgtatgagctactatgttagagcaccgaaatcacgca

SEQ ID NO: 539978 - DNA, 703 bp, Homo sapiens
aatagctggaattacaggcacgcaccaccatgcctgactaattttgtatttttagtagacatggggtttctccatgttggtcaggctggtctcaaactcccaccttcaggtgatccgcccacctcggcctcctgaggtgctgagattacaggcgtgagccactgtgccagcttgctaattttcacagaagcttgactggcaattcttcacatgctaaacagtgccagtgcacagaacctttatatatttcctgacgccagtactgtgctctgcatataacaaagctgcttcaaggactgagaccttctttctaaacagcatgtaatgtgagacgccggcctgccattattttctcttatattctctctctctaatgaattaaacaactacgtttgtggcaagcgccacggtggcctcaggcctgctacattctagcactctcgaggaggccgaggcaggaggattacttgagcctacaagctttgaggccagcatgcacagcatagcaagactgcatctctacagagagtaacacaaattacccgacgtgtggtgatgtgcatctggtatcctcagcttactgggaagggctgaggtgacagcgctcccttgagccttggggctgagggtggaccctggcagtgccttccctgatcctgcgtgctagcactccaatcctggcacaaacagagccgagacccct

SEQ ID NO: 539979 - DNA, 375 bp, Homo sapiens
caagtccctctctcgattcgggaatcgattgggccattggaaaaacttggcaaaaattctttccaagaatctcgtggtggcttctccctgtgtgcacattctcattttcagattgctcagacccgaaggcccttctctttctgaatgcctggtcactgtttaagtcctgatctgaccgcgtgtcttcgtggcctccgggaactcgcggcctcgttgccagacttgttgtggttctcatcgaactcactctctatatgaggccacatctctttcgttgttggtcctggtttaagtcactgttcctgtttctgttcctggatatgtccttcatcagctattatgagtttatcctcatccaaagagtcctcacgtgct

SEQ ID NO: 539980 - DNA, 852 bp, Homo sapiens
  misc_feature (580)..(580): n is a, c, g, or t
ggatgagaaggcaagccggaaagagcgtaaagttatattattgctggaggtctccagtctcatttgtttgttgatcgtgggcaaaggcattctagccagcctgaggctactccctctcctggtccccacaggaggaggagatacggggctgaggaggaagaagaagaaactgctcgaggattggagaggagcgaagatgaaggtggaagaagaagatggacgaagacagacagaacgacggactgatcgaagcggctccgcgctcgaagacgacgctgcccgaacgaggtacggactgaacgcggtactcccaacacgcgcacgaacgaccagaacaactggcggcatccggcgatgaggctctctgctcaaccaggtctggggattgggagcgcctctcttgggcactggaaggtgtcgggtgcggggcagcccaagtccaagccacttcttcacctcggctccctgcatctgggccctgcaccatgagctggcaccctcttctttctcacccagcctttctcatttccgcctctccacgacactgcgcccgtccaccctcactctgtccattgttccnacctcctgactctgctccatcgtagagctctaccagcaaggcccccaattgctcctctctctctttgctctctttctccctcccctaccagcctcattcttcctccggtagcctctcccactaacctctgcatcccccagcctcatgtcctgccccatccctatcctgcctgatccctggatgctccctcagatcccctcttactcagacagcgcaaggccggggtggggccggggttggggattagcgcccacagctgccccccttacaca

SEQ ID NO: 539981 - DNA, 1004 bp, Homo sapiens
  misc_feature (790)..(790): n is a, c, g, or t
gcattcgttaaagtctctcttcacacctgccgtcgtgtctaagtcagagtctcctaaagagcccgaacagctgaggaagctcttcattggagggttgagctttgaaacgactgatgagagcctgattgatgccattttgagcagtggtggaaacgctcacggactgtgtgcgtaagtgacgagatccaatagcaccagatgcgctccatggggcttcgggtttgtcatcactatgccactgtgtgacggaggtggatgcaggctatgagtgcaaggccacacaaggtggatggaagagttgtggcaaccaaagagagctgtctccacgatgaagattctcattaggaccaaggctgtcgccatctctaacatgtgtaacaccgatatcttcgtgggtaggacactctctcctgaccagagtacctggaatgaaaccagtcaccctatacgagatgtagtgtccgaaagcagataagtggtaccaacattggcatgtggatcctgcagcatcggagtgcatgtgggaagcacaggacagcggtgggtgagatagtagtggcgctctcgggctatcgtttgatgcctctctgaggcaaccattggactcgcgtgggcatcaaggatgcgtcgatgccagcatagtcatctcatggtagtcgtaataggcacccacatttagtgggtgatgccttaggaaagagaccgcatggtttcaatacgacttggctaggatcggggttaggtgctttccaatcctaggtcattgagcaggggtcggacaggtgagtgnccgggacagcttgccgggtggggggctccggttggccaggtcggttgtcacgtgtgcccgcaatgggcttgctcccaagttacgtgctggtggttgacccttttggggggcggtggctcgggtcttgggtggggccgacccggggggtgggcgcgggggctctcgcgggggcacgctgtggggcttggggtgagataggattctgggtaacgcg

SEQ ID NO: 539982 - DNA, 174 bp, Homo sapiens
aggatccagtggggacatcacttcctcttaccccaaattcatacctcatttccccgaccccatctctccccagtgttctcaagtgtgtgaaatgggagagtgtagcatccctcggatccagtgcccactccactcctgtctcctggcaccacgtgggcatggctagagtcatgg

SEQ ID NO: 539983 - DNA, 146 bp, Homo sapiens
aacagcggttcgctggtggtgtagtctactactttcttgggggtcagatcacattggttccctaccaacaattggtggacatttgcactgggcataacgatctatttcctggcagccactggtttaacagttatgggaacggactt

SEQ ID NO: 539984 - DNA, 220 bp, Homo sapiens
atttttgaagcttggcagtatcatgtctgtttgttgatatctgcggcataagctgataccgtctagttaggaaagtcactctatcaggctttgtagggactctgatcagcattctgatttgaacccttgaaatgttgtgtatactccctcttaggtccaatgatgtatttcgttaaagtaccatgatcttggcttttctggatttattttgccatgaggt

SEQ ID NO: 539985 - DNA, 995 bp, Homo sapiens
agcggggggtcctgtccgaccgaagaaaccttgctgggggcccgggtactggttgggtctggagcttcgtgcctaggcgacgacgcgcgcgtgcaagcactcgtgcgcggattcgcgagcgtagtcgtggcaggtctggccgcaggactgtgtgaaccactatcatggatgtacgcatgcaggggagtagcctacgctgcacgcgggacagagggacctgagatctgcggacggtgcaagtatctatctagatgacctcatgtctcgtagcgtgaggaagggaacagagacaagactcactacacgttgcgattctggaacctccccataaggcgtgcctccaatcacaggcttgaatcacacagacgagagcttaactactacaagttgatatatatgattgaccgtagtcaatacctagttgcgtcatgggtaacccttttcgtcgcgtctcgcgacatccattggcgacgatagtcgcgagtatggaatactagacagcgacgacggatatccttatccccatacgagagataccatcctataacttcgacacaatatgtgtagtacatctattttgagatcgtatagtaatggagagtcgcttgttctcaactacatttcatcggattgagataagggttccgtctcatggcatcggcgctgacggagaatctttcttgatttaaccggttggtggaacaagggattaacagtggagatagaataggaaggctgagtgcatagaatggttgcgaaagggaaaagcttgtttttacgatgctacatttctcgctgatcaagttaccccatgctgctatatgcgtgacgagggagcggggtaggtctcaccaattaagaccgttgttttgttggggcagtgaaacaatccacatgacactttccgagtggcaacttttgctccgggtgtgtgacccattcggttaatttacacacattctcatggcaaggaatgagtctctttgtaaccccga

SEQ ID NO: 539986 - DNA, 213 bp, Homo sapiens
catattgaggactcagccatccattacgaactcatgtcgtcctctggacatatttatcactatacttgggttctaaatagtataaaagaaaactgtgatctatatattgatgtatcacctccatagtaaatttagcaggaaatgcatcacaattatgattttttttttcaccagtgaaacaataaagatgctattgaaacttctaaaactagg

SEQ ID NO: 539987 - DNA, 191 bp, Homo sapiens
  misc_feature (91)..(91): n is a, c, g, or t
  misc_feature (172)..(173): n is a, c, g, or t
cggttttacgccgagcgtcattcgcgggcggcatgcggcgaagatcgagcgaggtggcaggtcctgatctgcgttgttgttggcggtgaantcctgtatgtcggagtggcgtattctttcgagctaatgaggagttcctgaacaatggaaagacacgctcaactggttgccnntccgcactcgattgaggc

SEQ ID NO: 539988 - DNA, 212 bp, Homo sapiens
catatgcatacgactcataaagtgggaggagccatgttgtgatggagggagttacatgaagcagacagtgccaacgtcgaagccgaattcctggtctggggcaccaacgtccaatgtggccaatcgatcattggcaggcgggaggtcttggtggttttgtattcaatcactgtcttgccccaggctccggagtgactcgtggaaatgtccat

SEQ ID NO: 539989 - DNA, 318 bp, Homo sapiens
gagaggatacgtggtacgaggctgtgtacgaggggccggcttgttcctggggcgtacacgactgtcagctgtgctccgagacgcctggggaactccgacaagagtgacgcgccccagatggaccttgtcaaccggctttgaaagagttaatgggtcctgcgaagatgtggatgacgtgcgcgactggcgggcgcctgacaacacggagagtgtgccaaaaacgccgcggcgggtacacgtgtgtgtgccccgcacgggctttctgctcgactcgccccgcagccagctgcatacttcccaacaccgtgatctcacagg

SEQ ID NO: 539990 - DNA, 432 bp, Homo sapiens
tggcctcgtaatgtcacatagtcttgcccctaggctattttttttttttcatcttttctccagcacggtgcccctttccttaggaaactctcattccagtaccatataatgctcaggaaaaaactcatttgggtaatatattacttacgggttacacggtttttaaatgtttcatgagattaagtcttacctgtccttagacatccgtggtttaaaatgagtgataaatttaacatcagctgtggtcccgtgtacatatcccgtgataaatgaataatctaaaaagtgtccaggaaaattaaaattaactttattcaaacgcagaatacgaccatttgattcagagggtgggggatttgggtgaggaggagtggtaggtgtgggtgggcaggtcatatatgtatgctcctccccttcagtaataaaaggaga

SEQ ID NO: 539991 - DNA, 260 bp, Homo sapiens
ttcatatctgggctatgactgggaactgctggatctttgggtgtgtgtggattatgtattccgatcatgaggatgagccagatctgcctcttcttatgaggtgtactcgagtgagatcttccacgtctacctaagcttctactgcgggatacttcctcgtcttggtgtcctagaccgagacctccctctactgggaggtgtactggagcgtgagagaccaatgcgtctagctggggttctagagcgtgagcggacaagta

SEQ ID NO: 539992 - DNA, 435 bp, Homo sapiens
attcaaaggggtttgcaactcaaacaaattgttagggggttagtaaaaagtttatttggtaaaaaggggtatactccagctttaactacccttagtgaaaaaaaaaattttttgttgtttcaaaaccccttttttaacaaaaaggttttttgaccccccaaaaagtttttttaaactgtcagatttaagccttgttacccaaattagactaggggttccaatatttaagggtaaattttgttttccaaaaaaggaaaattgtttccagtttaaaacaaagactgtttttacccatgattttgtatattactccccaagaaaaagggggttttgtaaaccctgtaaaacagtttcatattcctttttttaaaaaaaagttattccaagggggcattttttgtttaataaaaaaagttttgatgcacagttccccca

SEQ ID NO: 539993 - DNA, 253 bp, Homo sapiens
  misc_feature (249)..(249): n is a, c, g, or t
gatgcctctcatggtgactgccagggccgcagccatgccaaaccttccattgttgaggatgtgcatggcaaccttgaagccactcccaacctcacccagcacgttctccgagtggcaccgcgtactccactcaaatgaacaccctctgctcgtgttctgagacgccttgtatgcccatcttacttctcagggtggcccatgggctatatgcccccgtaagtcgccctctccaccacaaaagctgtgatncttc

SEQ ID NO: 539994 - DNA, 181 bp, Homo sapiens
gctcagccctactgggtaccatgacaccactccagggattctaacttcttgttgcctacctgccgtactatcctgcttgaatattcgcccgtgtatgctccctgttccgagtggattggggtgacctcagcctaaggatcagctcgacattatctccagcctgagattgaggaggtccagg

SEQ ID NO: 539995 - DNA, 171 bp, Homo sapiens
ccttagtctggctgcagtggggatgtgtggacgggaaccagcctaaggaaagcactcttgagactcttcatcctgcccgggtgtgggtagcctgggtctgtcactcggccccagcacccgcgggccccactcctgagcttcgagtaagcgacgtcacacaatgtctagccc

SEQ ID NO: 539996 - DNA, 177 bp, Homo sapiens
tagcgcatagatacctagtgttcctagaagctcctcatagtcaacaagatcaaagcaaacgacagcacagatgtccagacgcccagcaaatgaatcactcaaaaaccacgtaaagatgaacgttcctagagtccgcctttcctcccgttcttgtgtcctccatgctttgtctctctc

SEQ ID NO: 539997 - DNA, 490 bp, Homo sapiens
  misc_feature (430)..(430): n is a, c, g, or t
  misc_feature (454)..(455): n is a, c, g, or t
acgcctaatgtctttgacgccaaagtgactgttgatggtctgcgcgcggttaagccaatgcgtgaatggcaactctctgataatgctgcttatatgcattattgcccgaatgaaaccatcgatggtatcgccatcgacgaaacgccagacttcggcgcagatgtggtggtcgccgctgacttctcttcaaccattctttcccgtccgattgacgtcagccgttatggtgtaatttacgctggcgcgcagaaaaatatcggcccggctggcctgacaatcgtcatcgttcgtgaagatttgctgggcaaagcgaatatcgcgtgtccgtcgattctggattattccatcctcaacgataacggctccatgtttaacacgccgccgacatttgcctggtatctatctggtctggtctttaaatggctgaaangaacggcggtgtagctgaaatggnnaaaatcaatcagcaaaagcagactgctatatgggg

SEQ ID NO: 539998 - DNA, 121 bp, Homo sapiens
tgcagtactgtgtgttgcactgcattgtgtgtttgcagctgcacttgtgatgtttgcagctgcattgtgtgtttgccgctgcattgtgtgttctgcagctgcattgtgtgtttgcagcatg

SEQ ID NO: 539999 - DNA, 201 bp, Homo sapiens
agagcatccctcgaattcgacggtatctctctctctttttctgtatagcaggtgctcgctgtgtggcccaggcttgaatgcagtggcacaatcacaggtcattgcagcctcgatttcctgggctcaggtgattctcccacttcagcctcctgagcagttggaactacaagcacgcattaccatgcctggaattccagtcat

SEQ ID NO: 540000 - DNA, 80 bp, Homo sapiens
ggtgtcttgttccgggcgtttgttggtgcgaagaaggcgcccactctgaatgccaaacgggcccttaccgtggatcgcac

SEQ ID NO: 540001 - DNA, 558 bp, Homo sapiens
acaaaaaacaggttgaaaatcagaatcttttacttcaagttgaagaagtatctgcaaacatgtagcaaagtgaaatccataatgaaaaagagaaaatgttttataaaggaacatgaaaacctaaagccactactagaacaaaaagaattacgagataggagagtagagttgagtactattaaaggattccttagcaaaatcaccttctgtaagacatgatcctctgtcttcagtaaaagagttgtgaagaaaaaatagaaaatctgggaaaaagaatgcaaagaacaggaggagaaaatacaataagataaaatgagttgcccgtaaaggctaagaaagaactagattccagcagaacagagacccagactgtgaaggacgaacttgaatctcttcgatcagaagaggaccagttagtctgctgccatgagagatctcattccaggagcagaaagctataagaatctgttatgagaatatgaaaagcagtcagagcaactggatgtggaaaaagaacgtgcaaataattttgagcatcgtctcgaagaacactcgggt

SEQ ID NO: 540002 - DNA, 560 bp, Homo sapiens
agtactcagctaccagagtcactggaacagatcagctcacacccagtctctcacaagtgtacattccataaaagtggttgactaaagtgaatgcgtcccaacttcgacgaccattcagagattcaacttcttcctggtttagtcttgggagagtgtatgtgtcgaggaatgtatccatttcttctagattttctagtttatttgcgtagaggtgtttgtagtattctctgatggtagttggtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgacgggttttttgtgtctctatttccttcagttctgctctgattttagttatttcttgccttctgctagcttttgaatgcgtttgctcttgcttttctagttcttttacttgtgatgttcgggtgtccattttggatctttcctgctttctcttgtaggcatctagt

SEQ ID NO: 540003 - DNA, 853 bp, Homo sapiens
gagcgggaggggcaacatggcgtccagtgtctaaagcggcgtgcctgtgcgaaacgtggtggttcctgcagcccgacggatcccccagtccagcgcgacgaggaagaggaaacacagacacgtcgaaaatgaggactgaagaccgactgactgaccacgctgacaaggacacacacggactgacacgacggaccgacggtcacttgttcgacggaacgtgacatatcgacattctgaaagcttactatccgctatcagaactacactcgacttactgaccggacacttaacgaacccttactggcagcacgctattttctaaacggctcctagtgaaacactagcacagacaccgtacacacgatctacttaaattcaacagacaccatattgaggacgtagtgatacaccagcacaacggactgtatcagacaggacagccaaaacgatgactatagggatgacagatcgacggtcactaggcaacaataacgcccctaaagcacagtctacacatgcaccagacaacggggtaccccaaggacggcgctacgaaacacacactaacaaagcacgaagcgaatctaccagaaaacatggcgagacacagaaaccaggtgcaaaaagacgaccaaaggaaagaaacacgactggcaacacgataaaacaagagaaccagcaacccaagaccggaaggagacaaaacgtagcctaagacgcaacagactcaaaaaacggacccacacaagaaagaatcgactacaaggacacagaaacccaaggaaaaaaaaacaacagaacaaggagaagagacaacaaagaaaacaagaaaaaaaaaagagacaagagcaac

SEQ ID NO: 540004 - DNA, 298 bp, Homo sapiens
cctctgttcgcaaatcctttatagagcgtctttatcataaagcgtatctcttagtattaatatccttaccgtgttcacagagcagaaacagctgggctgataaacaggcatagtcctttagaaggatgtggttgatcctacaacaacgcactttcctaaggatgacaacaactcaccccacccctagaatggctggtatgaaccgagtttccacacagtctagctggcaatggggtcaggagacgttttgctacttcacatctttaggggttaaatataggtatactttgaatttagc

SEQ ID NO: 540005 - DNA, 321 bp, Homo sapiens
tatcaaggactcagaggtctctccaccacagcagttgcacttgctgagcaggcagcttgaggacccacaatggtagcttttctaacgcctgagatgacgtgaactgagtgtggcacagaaaaccagaaaaacttttggagcgctgcaagtacctggcctgcttgtaacaatggggatgagtgtgcctaccattcaccccatctcaccctggaaaggcttcccccaaattggtaaacttgctgacaaaatgtttgtctgtacacccaaattgtaaatatgatgcaaagtgtactaaaccaggattgtcccttcactccatgt

SEQ ID NO: 540006 - DNA, 230 bp, Homo sapiens
ccgagcatactccgcttacacaataattgtccgccgaacagtacacacccaccaggccaccgcctcagcgtgcaagacttacaaaatttgttacaccacaaccacatctccaaatacaaatgcagcaagtgatttgaagatcatagaaatgacaatacaggcaaaaaatgcaacaaatcccccctgccaaattattcaactatgtatgacttctgcctcttcacagcgcc

SEQ ID NO: 540007 - DNA, 112 bp, Homo sapiens
cgagtagcaaaaataaataaataaataaataaaataaaataaaataaaatatacaagcaaacaacaacaaaaaaaacaattcagtttataaactgaaccagtgtggagagag

SEQ ID NO: 540008 - DNA, 236 bp, Homo sapiens
atgggtctggaaagctgatttgcagagcagatgttcagagagcattcagaattttttaggccaccttctgagatagcatactatccatcacttaaaaactaaatggggcatcaaacataacccaaggctgtgattcaatgagacattaccaggagtccccttcatcctcaggggaacatgttcccagaacctccagtggaagcttgaaaagtgtcaggtaatacccgaactttata

SEQ ID NO: 540009 - DNA, 309 bp, Homo sapiens
tgttatcacgccaacacgtaatcgctcatactttctccgtgatgtactgcaattttctgtgccctaggtatggaacttctaacagcattgcactagaatcttcatcataatccaattatacaggcaagggcaagatcatgggctgcatacttcccagatgcctagaagtctgtgtgctttcccccgccacttgtaaggttgagctgaatcaggatccattacaatggctctgacacagtctcgtaatggcagcaatttggcttctgtaataatgacgaagccactggccctcttggcataaaaaattgg

SEQ ID NO: 540010 - DNA, 1891 bp, Homo sapiens
ctctaaagggaaatcccaaccttctttggtcttgtagttttgaacagggagggtatcctgtattacacctccaatacggctcagtcttaggaggaagcattcaaagtcttccagttcagatgccaaaaaaaccccattcctggccagcttatctaaaatttcattcctcatgtagttgttacaggaagtattctggttaataacatcaacagtcagaaggggccatttgttctgctgaagtgaagcataactatgctgggtttgaaattctccaatccataagataatgtttaaccaatcatggcgagctgtgaggtatctccagagggcttcaggggaatatgatttgtattctacatgaaaaaaaacacattttaaaatataattaattatgtctattgacatgtaactcaacactaaattactgagtaaatataacaatctggacatagatatttatacaatatattaattattcaggtcctctgttttactattttcctttttttgagacaggatctcgctgtgttgcccaggctggagtgcagtggtgcactcgtggcagcctcgacctcctgggctcaagtggtactcctacttcagctgcccaagtagcagggactacagggatgtgccatcatgaccaggtaaatttttttttttttttttttttttttttttttttttttttttttttttttttttttttttttttttttttttttttttttgagacagagtctcgctctgtagcccaggctggagtgcagtggcgcaatcttggctcactgcaacctctgcctcccaggttcaagcgattctcctgcctcggcctcccaagtagctgggattacaggaatgcaccaccacacccagctaattgttgtatttttagtagaggcggggtttcacaatgttggccaagctggtcttgaactcaggtgattcgcctgcctcagcctcccaaagtgctgggattataggcgtgagccaccacgcccgtccacccaggtattttaaaaaatatatattctgtagagatgggggtctcactatgttgctaggctggtcttgaactcctggcctcaagcaatcttctcatctcggtttcccaaatttctgggattacaggtgtgagccaccgtgcctggccacattgttcattttataatcaatgctacagccaaagaactagatgtagcttctaattactctggtggttaaaatgaaacttacgtattagctgtacatttcacttacctgttcaaccctttttttcccttctctttcccttaatgtaaataaaaactttgtttcagatggggaaggatgaaaagaaaaaaataaattaaaaataataaacaaacaaaaacttcagccataatagtaagccagaattttactctctgaattgctactgtttaccactgttagttatgacccagatcccccatatcagatggcatagatccccaatttacacaagaagctcaagactatttgaaaaaacagattgtcactttgaagctggaatgaaaactcagccttgaaatctcaattaactatttttttcttttattagcacattataaatccctcccagaaactctgagataagaaagagatcttaatgcaacgacttgcattttaaagaacctgaatattatttcccgaaaggaattctaaaattgagacacatcaaaatattcaaatatcaatacccaatttaatcctcattcagtatgttcatatttcaggctctctcacacttgccttctggacttatcctggggagaaggatggattcttgtgttagttgatcccaccacagagcccaatttaacacaattctatggtcctgtttgttaaattcatctttacctttagagca

SEQ ID NO: 540011 - DNA, 720 bp, Homo sapiens
cctaaaccgcgaacatgtcactcgcccagagagatgcccaggagctgtatgacggccggggagaaaccgcctgggaacagacgagtccaaggttcaatgcggttctgtgctcccggagccgggcccacctggtagcagtattatcaatgacgtaccccagagaagagacaggaccgggacattgagaagacgcatcatgaccggggacgatgttccgtgcgcgagccttcggatgtgagcggccatgtctgggccgtcggtgacaattgatctccagagacactatccccagccttcacttgccgtgagagcgctcaactaaggaccactcgacggggggtcacggaacataaggcacccggaaccctgatgtcgcagtcatggtgtcttcgcagctgacgacacgaccatcctggacatcagatcagagtataagcggatgtacggcaagtcgctgtaccacgagcatctcgggtgatacttacaggggagttaccgagctagattctgctgaagatctgtggtggctatgactgaagcagtgactggtggctcacttcagcaccacctgcacggcaacaccagtgccaggcattaggccataaagaatgtctgtttctaacaaatccacaaatagccctcgagattcaccgtcttagagcttaggcctgtctaccacccctcctgacccgtatagtgtgccacagacctgggtcggtc

SEQ ID NO: 540012 - DNA, 123 bp, Homo sapiens
agaggatccccgtacgcaggatttgcaggatagcattcacaggtcctgtccagttctcagagttaggaatggatgctttcatcagatgctaaaagctgaggggactagactaagcttgtgcac

SEQ ID NO: 540013 - DNA, 326 bp, Homo sapiens
attggccaggctggtctcgaactcctgacctcaagtgatccgcccaccttggcctcccaaggtgcctgggattacctgatgtgagccaccacgcctggcctgttaacctattttaaaaatgagaatagacggccattggtgcctaccacctattaatcctactactttgggaggccgagcaaggtggaatccttagcccaggaggtatataaggtatatataatcttcaagttttaaagttgtagagctcaatttaaactcatataaattaaacacatactctgtagggcaaacacacaacatcttggcaaacagcagcacatata

SEQ ID NO: 540014 - DNA, 988 bp, Homo sapiens
  misc_feature (829)..(829): n is a, c, g, or t
tcagtggttctcctttggtttattctctttggcaccccaaggggttaaaccccttttcttttcgaaccctggcccacaggcccgtgcccccccccatggcttgtccctgacctggattaaagggaatctcagaaggttactatttcgaaccacagatctgttcgttcaaaattagacccacctattaggttggggtccgccagatctctacggctattccccttactccatgcctggagccagatacgtattggctttttttgctcttttaagcagtctcactcagtcttattccacagtaagagtactgggagaatccctaggtaaccttattaggaacccccattgggaccaccgtgcctttgtaaattgtgttgtcttccaccagtccatcccaatagatttttgtttttgttgttcccgccagcccccgaagaaattaggggttaaaccagcaccagtccaccactggtttgtgctccagattcaccaaagtagatttcctttgcaccctggcaccagacaccatttatactccagtttccatgaaatgattggaataattcccatccccttaagaatacccctgtaggccctttaactccctccacttggccctggtcccctagcctgatggattttgcccaaatggagattgttgatgaatcccatgtgaaaaatgtaatttagaaactgatttcttccagaaattagaatggctttattttttaaaataatttggaatgtaaacaccattttatattttaaaataattcaccaccgggaggcttcgggagtttcttagtcattactgtccttttcccctcancagaattttccctccttgggtggtggattcgccaccagaatattgtatagtatatttccgttcccagattgtaagtgaaattgcctgatattgttttccattaataagaccagcgatgaattttttctaattatttaaataaaatcccccaaaacatta

SEQ ID NO: 540015 - DNA, 347 bp, Homo sapiens
tacaatgtgagcagcatctatgaatactgaaatgtgatggtcaagtggtccatcatcaagcacaaactacaaatggaaatcattaaactttctggagtgggccatttgaataacaatgtcaagtgcctgggtatatcccagcggaatctcggtcttcttatctggataagcacaggcagagatgggctgtgtagtggccggtttctggatgcagctgatcgctggctggactttagcactgctgctcctcctccttggtccgccgtgagcctcctgccaagctctgggcactggcatgggccgtggtgctgaggacctcctcaaaactgcctccactaggtcgcagt

SEQ ID NO: 540016 - DNA, 856 bp, Homo sapiens
gcctgggacaaagtgagactctgtctcaaaaaaaaaaaaaaaaggacaaagaattagaattttgattaaccaattggggctgggcttgatttggttctttccagactttcgggaaaagagaacattcttttctggtgggcaataattcatcctcagagtaaaacaatttcctctaatctccaggagggaagggtaagataggacagatttccaatagttatgggtcattggctattggaaggtagagacttgggttagtgtgggggccattcgtgatgtctccatggagtggggaagaaacctttgggttatgactctaatcttttgtgtctcccagaaagatttacccattacttttattccagaattgagatttcccaaatactaggttaatctctccaaattaaaagaaagatgcagagtgactttttaaaagggcaggagttatatgtgggttacaagaaaattaaacttaatggccggataagtgtgaagtaggagggaaaacggacttggaatactaggtttaagaagatctagagcagttctgtgactttccggacaaaattagactttgggaacggggaggttgaaccatggagatgaagaacattcattattgataaggggtcagttggcaggaagatagaattaatcaatgtgtcacttaaaataggagactttggagtgtccttaagggaactgggaaatggaaaaatgtcccacgttggggtggatggtaaaggccctagtaattatgataaggagacttgggagtccaattgggggatattaataaggtgcgcaagaaatatggaaaggagcactcgggaggatatccacctgggaggatgtg

SEQ ID NO: 540017 - DNA, 595 bp, Homo sapiens
ctgaaagggggctttgtgtggtgcacgtgaggaatgttgcctcgccggatgtccggagggggccgtctgggggtaactttgtggtgtcctgcaggcacccggacaaactgtgggactagttgcctaggcccctcagtttgactatgggtccacggtgtggggtgtaccgcccgtcgatggttctcgcctggccccgccctccgtcctctctgcttttatgggggtccccggtcgccccgcgaaggagcgcgcggtgtgtgttgccgagcggatggcctattacgtcaggagtatcgcaccccgttcgccttgcccctgagtgactatccctccgacttttcagtcccccccgggcgacccgtcgccttagatctctctttttgtgttagcccacgggcaatattagctacccactgctcttactcctgctatggccccctaacaggtaacacacactgcagtaacgaaactcgcccgcctgtgaagccaagctcgcgcacccccccactggtcccccccccccctttcccccccaccccccttattcgttccttttccccctttaaccaacaaaaattttactgaaaacataaca

SEQ ID NO: 540018 - DNA, 935 bp, Homo sapiens
ccagctgcccatccccaggagaacgtccacctcctgggctcgtgggaagacctgaccagacacgagggtgcactcctgcagtgccaccaagtggttggtgtagacgtggagtggacacctgtgtttgttgctgggggccggcctcggccgtcactcctgcaggtggccgtggagggccacgtgttccttctggacgtcctggcactctcgcagccaccaacagggcagggagccaggcttttccggctggtggcccagctcctctcggacccctctatcaccaagctgggctacgggatggtgggggacctgcaaaaactgggcacgtcctgccccgccctggcccatgtggagaagcagattctgggcggatggacctgctgctggtgcacagacagatgcgggtggcgagcgtgccagccccagccgtggacagggccaggagctgaggggcctgagcctcctggtgcagcaggtgctgggcacagccctggacaagacgcagcagctgtccaactgggaccggaggccgctctacgaggagcaggtcatctacgcagctgcgacgcctactgcctgtggaggtgcaccaagccctgtgcagagagcccgcccgcttccacctgtcggaggactggctggagccggaggcccaggcacaggagagagaccaggcgcacggtaagccacccggctggcgaagcgtcagcaccgggcggaccagcaggtcctgtggctggggcgggctgaaggggcgcccttcaaattcggcagggcctccgggggtgtggtggacctgctgcgggtggcggagccccgggccgggggtcaccttgcactgggtacccgcggggcagatcgcacggacacactggagcgggcacaacggcacggggagccatcagcgcgaaaggggaccgccactacgcccgcaa

SEQ ID NO: 540019 - DNA, 199 bp, Homo sapiens
  misc_feature (118)..(118): n is a, c, g, or t
  misc_feature (126)..(126): n is a, c, g, or t
gcccagcatcattcatgggaggccctagttcatgactgcacccctgatcctgctgcaccagcgtcccaacggcaacaggcccttgctatcccttgtcattctggtcagccaggcaggnctcggtgngctggtgggtggggtaggggaagtctattacatcctcgggatgactgaaaggttgcctcctcccaatgccact

SEQ ID NO: 540020 - DNA, 114 bp, Homo sapiens
agctcagctttcacgcccgctcttctcccctggttgttggggcctggcctccccctgctgtcaggtggggattggcccatccatctgcttacaattccctgctgtcgtcttagc

SEQ ID NO: 540021 - DNA, 483 bp, Homo sapiens
aacggtcatctctccacgcccagtaacaggtgtctagttctcccaccctcacccaggacctgtcccttgcgctgggaggaggatctccagggctcacagcagaaggcaggaacgaaaagtgcacttaggcacaagctttgcagacatcctgaaaagggtcatatggacaaactctgctgcctgcagtatccacatggttacatctgggcacgagaccccccgtcccacctaccccagggtttgaggcaatgcggagaaaccaacaggctgagacgacaggtcacctgcttacacatcaccacaaaagtgtcctagacgccatgaagggacggccaggacaaaagtccactcctccgaccttcccaaggcaccggcagagtgccaggcacaaggcagatgctccaagacagtgaagccacgtcggtccgccgtggattcacacatccgtcatgttgctcaatgttggacctatgagactgaaga

SEQ ID NO: 540022 - DNA, 593 bp, Homo sapiens
  misc_feature (20)..(20): n is a, c, g, or t
cattgcacgccggtatgtgngtattgcaaaatatagtctgtgatcagaagactggtagtctacactgtcactaacagctgaaatcttgggactgttgattaacaactctggacttcaatttcttatttatgagggattaaaaaaaaattgagtccacctttaaacaaatgaaagtccataatttatgattctagggtcaaacccaattttttggtagtctctggaaataatttagtttactcgaccaattgagaatcttcattgctatgatatccttcccctgtgatgtgtgcatgaaggactaagtatatactcaagaaggatagttttgtctttaattaaaaggagaaatttactctaaaaatccaggtccaaaagcaatctatttgggattgatgacattatataaaaatacttcactaagtgaaattattcaaattatgcaattctgcaaacatctttttttttccttttgagacagagtcttgctctaattggccaggctggagcacaatcttggctcactgcgacctccaccttctaggttcaagcaatcatgtctcagcctacccaagagctgaggtggaggatga

SEQ ID NO: 540023 - DNA, 1104 bp, Homo sapiens
ttgaaatgaccacgtggtgtccgccttcgagcgctcccgcacagctcacagccctgcctttgtgcggctccactgctgtcttctccttcggtgcagacaccagctccgtgctattggagaccaccacccatgaccgccagcagcagggagcagcagctcggatgttatggcagcacaacacacatcacccattcacgatttgggggttctggcagaccccgctgatggcagtcgggagctcttgggatcaactgtggacaccaccaggctccagctgccagcacctggagctttcagctttggcagcaggacagagtgggagcacagccacctaccaaccccttcacagggggctataggtcagaacgccctgggcaccaccggccagagcacaccgatcgccttcaacgtagggcagcacaactgagagcaaagcctgtgcttggaggcaccgacacccccaccttatggtcagaacacccctgcgcctggagatgggcacatcgggcagcagcctctcctttggggcatcttcacgcaccgcccaaggctccgtcggtgtcggaccgacggatcggcggaccctacattgccatatggtgcgggatccaagacccagggctcgacagcgactgcaggcccgcaggcagacacacgcaaaacagtagcaccttgtcgccctgtccctgtacacgccagccgctacccctaaatctggacattggcacgtacacacaagacgcctggcccttcacatggataaggacactaaccggcactatggagttacagcgcaagggacgtagctcatggggccactccccacgaggaaaccacacccacggcagggccacgcgcgtgagcacaagccgggccgccatgggacgcaccaagagaaagagaggaaaaaggcagtgagaaagcagcggcgagggcccgagaggacaaagagaggaacaacgactcgaggaccgtagaggagggacgagagggccaggagcgcaagaaggagacacacaagctgcgcgacacacggcacagagcagagggaacgggaccagaacaccaggatatcgtactcgtcgagcgcaaagaggaaagaag

SEQ ID NO: 540024 - DNA, 547 bp, Homo sapiens
  misc_feature (2)..(2): n is a, c, g, or t
  misc_feature (11)..(11): n is a, c, g, or t
  misc_feature (37)..(37): n is a, c, g, or t
  misc_feature (42)..(42): n is a, c, g, or t
  misc_feature (134)..(134): n is a, c, g, or t
  misc_feature (293)..(293): n is a, c, g, or t
  misc_feature (327)..(327): n is a, c, g, or t
  misc_feature (339)..(339): n is a, c, g, or t
  misc_feature (445)..(445): n is a, c, g, or t
  misc_feature (449)..(449): n is a, c, g, or t
  misc_feature (471)..(471): n is a, c, g, or t
  misc_feature (473)..(473): n is a, c, g, or t
  misc_feature (491)..(491): n is a, c, g, or t
  misc_feature (509)..(509): n is a, c, g, or t
  misc_feature (527)..(527): n is a, c, g, or t
ancagccctanctgctctgagatattgctcctgttgnagagnaagctgcagactgataaagagaggtggcttctcagccacagaagtgagttattacatcacccagtttggtggggcctttggcttgcctactnaggttgtaggtgttgctgcacttcctgggtgagggagttagggcccttatcagccatttcctctccctcccacacccaaccaacacttcagttttcagtcaatgaaagagcaagccttaaccatcagccatccacttttctaggtttggcccacataanaataccctcttgaaatggttcaccggagtttgancattgcaaacantagaaacatcagaatctcagattataagagagcacaggaagatcctcatgcactacatgttttttcgaaaaagtagaggccaaagtaataacttgatgggataatnaaangggggtcacaggtaagtcaatnanctcttaagaaaacaaagncaagattcttcttgaaanaagtggtggtaagcaaancctggggattggttgaaggg

SEQ ID NO: 540025 - DNA, 1025 bp, Homo sapiens
ggagcgctgtaggtagcctgtggtgtgccgcgcacttaggcgtcagcagccgaggagcactagccgccgtgggagggagccatgatgcattacgaggtggagattctggatgcaaagactgtggagaagctgtgttatcttggaacaaggtggagccccaggaccatccattgcaggaagatcaatgaaccctcgttcactacatgactcgcaatcctgggaaggtggataccctgacaccagtctagtcgcccgtccgtactgggagcccacaagggacaaagtctcttgtaaggcatagaggaattgtatcttgcaagaagtctgtccgttgggaccacaacactggcctactaactgttacgttcacgtgagtaactcgtgaggggccgcagagtcagtctgtgggtgacaggctcttttgctatagcatggagttaccgctgagtggacgcacctattgtcatcctagcacgtgactctttctactgtccgagtgggcacattcatcataatgggcccaacaaataatgacgttatatcgattgcagtcggacagtacaaaggggctgacaacatcgctctgacaatacttgtcaactgcagttacacaactatatttacatgacgtcgtgtctggatgacgtcgtccttcgctggcgagcgatttctggccatggacagatattgtcctgttggcgcaagcaatcgttctagatgaaatctggaacctagctatctggtgggctttcgcacgtcggtgcgagtgtgcctgacttgacactcaagtacagtcctctcatacagttccctgctagcgttgcaggatgctcaggaggtgaaacttggcgctcgccctgtcatttgtgatctggcagactcaggcgaaggttctccatccaacctgttgcctgcggggagctggggccggctgggtcaaagaggcggatatccatacccacgagaacccttttggtgggtcttctgctggtggtcttggcccaaagactataaggggggtctcg

SEQ ID NO: 540026 - DNA, 149 bp, Homo sapiens
gatagtaccaaggaaggggtagactatgtgttatgtccaggaggttgcagcaatgcagtgtgcaggcgtattcataccatagccgcctaattttcacagagtacagcggataagtactattgacccagcgaaaacggcatcttcatcgg

SEQ ID NO: 540027 - DNA, 844 bp, Homo sapiens
  misc_feature (116)..(116): n is a, c, g, or t
  misc_feature (161)..(161): n is a, c, g, or t
  misc_feature (169)..(169): n is a, c, g, or t
  misc_feature (178)..(178): n is a, c, g, or t
  misc_feature (198)..(198): n is a, c, g, or t
  misc_feature (320)..(320): n is a, c, g, or t
cttcagacctgagtacttagctgagggtgggtgagagccctttgttccaaaagtccattagttttgctgttgtttaggagtaggtggttgttgttgtttttacttttttttttttngggctttggtaatgggaatccagtgttcacatcctggtgaactcnggtctccnggaaacccntgaagtatttcctaaaaccntgaaatatggtttccttccttggaattttctctagaattggcagaatattaggaaggtgaggggtctgtatcccccggcccccttctttcccatgctggactcccgagagtctccgtcgaantgtactggcgcagtggcagacaccaatgcattggactgtaagcgggttggtcttggtccagtggtttggtaaggctatcactggcctccaagctggtccaagcggagagacctggtggtcaaactcttgaatttcccgacttttctctaacacgcccccaagaaccacatgcatctctctggggtggtataacccctctgaaatatgaccgcactatggttattgagagcagggtccattcagcggatttataagggtattttcgtcgccacaagatttttgttccccaacttggtgctgatgagaggcggaaggggtccattaaaaccccaagatgtgttgccattgggctatacacaccccgtggcttcgcaccacatggcgtagacagtgcacacaaaactcacgattccatcatgggcggaaaacgtttgtatcaacattctgtgtcgatgctccccaatttcccttccagtttccaattccccttaacctctgatcacgactcagggcgtctggcagaa

SEQ ID NO: 540028 - DNA, 412 bp, Homo sapiens
cccccgctggaaccctgtatcttagaagctttataccaactatggttttatttgaccctgcatcacagtttggttcggaataggaacagattcaccaaattgtgtcttatttataggtggaatacaggttcagaagctcttgacaatatcatgagacgaaagtatgagacgccttattcaattcaacttctgtattttgcacttcaagaaactgagtaccagagttaaaaatctggacatttggtggatgttcttagatttgtgttaatgcaagagggatggattagataatctcacagggtatgggaatggatggtgtgttccctgtatctactgtgtagtgtaaagttaattgatactagctcaacatattagattaagtggcattttagcaaacatgaatgaaaggcac

SEQ ID NO: 540029 - DNA, 339 bp, Homo sapiens
ttagaggatcccaagctccaacaagaaggctgcattgatatctgagcacagcatgacactctgcttgctaacctgaagaaaacaggaaagactgtttctaccttggcttgagtagcaggtgctggtcccacagcccacaggatggacaaagtggggcaggatgctgatcctcccgctggcttccagacagacctgggactaggcagtcatgccgggtgatggtgttccctgcggagaccctcagtttgtccttattccttcctagcttcccttgcaataaaaatcaaggctggtcttgttgggaggcttgggttaccgagctcgaaattccgtatccat

SEQ ID NO: 540030 - DNA, 301 bp, Homo sapiens
ggtgttccagctttcctgattggtttttgtccaatttgcttttctttcatatctgaaacctagctgcttacttggcttttcaatttcagtagttaggattctgattttgtctactctagcctttgtctttttaggtctgtcatgatgtctagtcttgttgctatgattcataggtgcataaaggctttaatttgtttagtttttaaaagacaggttagcatggtgtgcactgtgcatatctttatccaagacttctcggatcatccaatttgctgagctaaaattttagatatgcaaaatt

SEQ ID NO: 540031 - DNA, 321 bp, Homo sapiens
aggactttcagtccgtggcgaagggcacggggtttatagactggcttcaggaggtggtgtctgatttacgtaggccccaaagattggttggaccaggtgtgccaatcagaagctggctgccccaccctaatcttttattatgcagatggagtccctgtctgaccgcgccatgttgtatgttccttgctgtacacgtggttgacaaagaaaagggaagatggagctgcgatgttggacatgcctggcctccaggtagctctttcctattggcacagctgctggcattcacccgtgcaaacttccagcttgcttatctatgtc

SEQ ID NO: 540032 - DNA, 652 bp, Homo sapiens
  misc_feature (1)..(1): n is a, c, g, or t
ntttggaacttgtgccagctcagttatctgtttgacaagttaatcttccttgcactccaaagtatatcgacctttggtaataggaaagcaagtaccagcagttccgtggcatataggcacgtttgtttattgccactttcgtataagcatgatctcaacaatgttcttccaatgtcatgtgatacagtgacattcgcatccacctttggtctcaccaatagcttcagcatcagcctgcatactttgtgcgcagggagcctctcatttctctatgcttcatgcatagctatgcagacacccttccccgtatgggttactcagttactcgcaactgtgctccctaagactccgtgtcgtgtattcactatgcagctccacttcagagctgcctctactgcttctgatgtttttgcctacactgtcacttcacagtcaatagatttcatgatcaccacagttcctcccagtcagacagttaccactgactgtcgtctctagccctctggaattatattctgccgaatagttggggcgatgaacccgctcactagtgtgtgcttccagccgcagcctggcaatgccataacgcgatctcagtgcatccgcttgtgaagtagactttgcacaattcagggtccacagggtaggtccg

SEQ ID NO: 540033 - DNA, 151 bp, Homo sapiens
cccactctcctcttcgtccctgatgacaaagatcttgccttacagactttacagtgcttggctttgagattctgtaactgcagacttcatttagcacacagattcacttctttttttttttcttttatttttttttttatgttgttaaaac

SEQ ID NO: 540034 - DNA, 177 bp, Homo sapiens
cagagatgatgccactgcactccagcctgggcgacagagcaagactccatctcaaaaaaaaaaaaaaaaaagcggcggaaatcgggcagcgcctttaaaatcccgggcccagggtgatttcggtaactccgggggcacccggggctacgggcgccttcctagggcccgggcaattat

SEQ ID NO: 540035 - DNA, 611 bp, Homo sapiens
  misc_feature (455)..(455): n is a, c, g, or t
  misc_feature (467)..(467): n is a, c, g, or t
  misc_feature (488)..(488): n is a, c, g, or t
  misc_feature (544)..(544): n is a, c, g, or t
  misc_feature (550)..(550): n is a, c, g, or t
  misc_feature (599)..(599): n is a, c, g, or t
  misc_feature (606)..(606): n is a, c, g, or t
cgtaaaccatgatgcccactacagttttcaggttcagtgtggattaattgtggtggcctataaggatgggtcccctgcgcaccctcacttcatggatgaagagctctgttccaagtattgggccaagtggttctccgactagaagaatatacagaaaagcaaaagaacctgagcgctccagagccagcgtagaggcccgggattgcttggcgatgctgcgcggcgatctctgtttgggagatgcactgctgtccactgagtttctaaagaggaatgcggggaactgagggctacattaacacaagctgaaggtgtggtgggttgggatgtacccaccgagaagccagagagtctggaggtcagcgcctgactcaccagctgcacgacctctggctgtttctcaacctgagaggaggacactgggattggcagctgcccagggacttcttgggctnccttgcaaaacntctgtgtcccttggcaggatnccaagtctttgaattgagatcagaaggccaaatgaagcatcatgtgcacacatgtncctaanagttcccaggatggaaggggcctgaaccctcagggtttcagagagaganagattancaaca

SEQ ID NO: 540036 - DNA, 363 bp, Homo sapiens
cagagtaccacacagtgcccagagtccaaacagtagcctatactacagtcaccaaagtgtacataagcaaaaacaaaaaatagtaatactatatgaaaatagataggttaacaaataatagtaggtagtataatcagtatgtagtagtactacggggtaaccatgctagaaggaataagtggagtaagtagattacggagcagtgggctctaagagtacagagacattgaagttcaaatacctaaactagcaacttagagctaaatagacctataagcaagccaataaaccacaaggccacagtaaactatatttattgtaaaagggaagataataacaatacctacatatctaatgtaaaat

SEQ ID NO: 540037 - DNA, 798 bp, Homo sapiens
gatgagaatcactgttgttatgtgcttgtctggtagaatccgtaacaaacccctaacatcgaatacgacctgggttgagaatcactgttcattatgtgcttgtctagtagaatccgtaacaaacccctaacatcgaatacgacctgggttgagaatcactgttcattatgtgcttgtctagtagaatccgtaacaaacccctaacattgaatacggcctgggttgagaatcaccgttcattatgtgcttgtctagtagaatccgtaacaaacccctaacattgaatacggcctgggatgataatcactgttcgttatgtgcttgtctagtagaatctataacaagtacctgatgtgcactgaatgacagaaaaatttaaaattaaaaaataaataggccgggcaaggtggctcatgcctgtaatcccagcactttgggagactgagatcacaagtgtgatccactgtgcccagtgaaaaagtatttaaaattatctttgtcttacagagaggtagaaatcacttttcttcccttgaaagaaaattaacgctggggtcccagggctcacgcctgtaaatctcagcaacttgtgcggaggctgaggcaggaggatctctcgaggcccaggagttgagaacaacctggacaaaacgggaagaccagtctcttacaagaaatagaagtaaaaataattagccaagcggggggcatgcacccgtatacaggaagtcgacctaaagagcaagagctaggaaaatgagacctacctttaaaaaaacacaagcaacaaaaatctgg

SEQ ID NO: 540038 - DNA, 161 bp, Homo sapiens
  misc_feature (158)..(158): n is a, c, g, or t
tcctagctctggaggtgctgctgtagggcagggaaatatgggagaagtgggggcagcgacaggcggtttcacgccccacacgttatacagaccgagaggccagttgatgtgctatgttttatgatagtgacaataaagatgattttatgatacacgtntga

SEQ ID NO: 540039 - DNA, 86 bp, Homo sapiens
tacaggtgttttttgttgaaccttgaaagagtttaatcttaacgttttctaattttaaaattttaaaatctgtttaacaaaaaaaa

SEQ ID NO: 540040 - DNA, 381 bp, Homo sapiens
  misc_feature (155)..(155): n is a, c, g, or t
  misc_feature (188)..(188): n is a, c, g, or t
atggggagggttttcaaaggaatccccccttcccccccttcagactttattttttacccctcccttggtccaggggtgatgggggcccaaaaccccccccgggtttttataggaaattccccggaattggggcccattgtttttggaggcccttncccctttttttttttaaaaattaaggtggccanagcccttggttggggatttgttttaaaggcccccctttaagttattcccgcccccctccttgttttcaaaaacatggggggaaaaagtttttaaaaaaaactattttgttatagatcctaaaatgcctaaaaccggcccaaaaaattttgtaatgggttgtttttaaaaaaaaaatccgttaaaaaagtttta

SEQ ID NO: 540041 - DNA, 102 bp, Homo sapiens
tactctcaccacccactgccaacggtgtattggactctgagttagccgacaggccaccccctctcactgcaaactgtgacttgtgacctctgagttaacccg

SEQ ID NO: 540042 - DNA, 272 bp, Homo sapiens
  misc_feature (196)..(196): n is a, c, g, or t
gatctcgtgatcggtaacttggtcgacagaatttagctttgtctaaagacagtagaaagaaatgcttgagttaagaaaaggaaggttatggaagccaaggttcttgttatgtagatgaagcctctaggtagtattcttcagcagagaatagatggtcaatgtctcttttcagattttaagatagagtccaactcangttaaatctccgtctacgaccgtggcaacagacctacgaacagggcaaagagattctaacagatgcaaacatttta

SEQ ID NO: 540043 - DNA, 127 bp, Homo sapiens
aagggtttccctctagagtattacaaagaagcaggtgactactggaaatggacatatggccaggttctaaaatgttatccttcctttgtatgtgacacaagactaagtgatttttaaaattagtatt

SEQ ID NO: 540044 - DNA, 186 bp, Homo sapiens
gcttccccagaaaggacgtgagaataatagttcttcagatctcctgcattgttagacactctctgatcatatcatcttactcttctgtctatatctggatcatacatcaggttaaagaaggagatcctgagggcaggaagatattaacaatgagatttgggtagtcataagagatatagggaggta

SEQ ID NO: 540045 - DNA, 245 bp, Homo sapiens
  misc_feature (86)..(86): n is a, c, g, or t
ctaattggttcttcgatgacgaatctctcaggatagaccacaatggaagataatataagaaaaggaatgtatacatatgtatgacngggccactttgcttactgcagaaatgggcacggcatcataaatcaactatactttaatggaaaaagtaattaaaaataaaattttaaaagatttaaaaaaaaattttaaagatggtttaagttaaagaatgacagttccgtcatcgaagaaccaattag

SEQ ID NO: 540046 - DNA, 228 bp, Homo sapiens
cgtagacacacaccagagcccaacacacacaccagcagccccgtgatacaacgccacaggatcccaagacacacacagcaagagcccccaacatacacagccagagcctccaagcacacacacaaccaggagccccacaacacacacaaccagacgccccacaacacacacatccagagacccccaaacacacaacacaaccagagacctggagtcctcaatgtgtag

SEQ ID NO: 540047 - DNA, 554 bp, Homo sapiens
gggagaactcctgacccgggaggcggaggttgcgtgagccaagatagtgccactgtcctttacacacggttacagtgtattaatattctgtgttattatctctgcacttactattaccagtaaggttgtaccttcaggtgagtatttattgctcattaatatccttttatttctgattgaagtattccctttagcatttcctgtgggacaggtttggtattgatgaaattcctccccttttgtttgtctgggaaagtctttatttctccttcatgatgaaggatactttcaccagatatgccactcaagggtaaagtccagcagtttaaatatgtcatgccactctctcctgcactgtaaagtttccatggaaaagtctgctgtcagaggtattggagctccattatatgttatttgtttctgtcttcttgatgcttttataatcctttctttatccttgacctttaaagtttgattattaaatgccttgaggtagtcttctttgggttaaatctgcttggttctataaccatcttgtacgtggggtaggaggt

SEQ ID NO: 540048 - DNA, 1076 bp, Homo sapiens
gtcacgacataaggcagactaaaccaatcccagcgtaccagatcaggaatgcacgagatcctgtctcgagaaaggagactaaagcagtctcagaaatgtctactgaaataggaccaatgatctcggtatcatctgccagaatatggtactaatgcaaaggagtcgtgtcacagactatactacaccctcttcttctataagcctaacaccgtggctactaataatacaaagatggaggatactttggttaaataatgatgccccatgacccaaacaccacttcccctccctaagagggagactatacaacagagctccagccataactacagttcctcccactactatacagccgtcaccttcacagatggagtcatagcacgcaaaagccatgggagaatactccacaaatgtaaggaaaaaggggtctccagtaactaccacagcaacgtccaaaagcaacatggaagaatcaagcaagaagatgccagatggacacaagcaacagctaaataaacaaaacgaaacacacgatgacaatccaagccacagaaaacacagacagcaatacagacaacgccctaccagacaaacaccataatcaaaggagacaggtacaaagcacaacacacatacgaaagacgacacacaacagtctaacaaccaccaacgagaacctgccaagatcagtagaggaaccaaacagaaacacacacacaaccacggacacgagacaacagcaagcaccggacaactaaccatggaacgagagcaaagaaccacacaggaaaaagccagaaatgacaaacaccaaaacggacccaggacacaaacagaatccggaaagaaaaagaagacacaaaactagcaaaggagcacagacacaagggaaaacagacccaggaacacaaaacaaaacacatacaacgaccacaaagggcaaagaagaaaaccacaaaaacctagatcaccaaaaacggaaaaaaaccaagaatacgaaccaaacaaagacaaaacgaaatgaaacgaagagaagcgcaacgagacgcacccaaaacaaaagaaaagagcgagcc

SEQ ID NO: 540049 - DNA, 179 bp, Homo sapiens
tggccggtgttaggaaattatttattaatttacaaaacaggttttaactcagccgaggtgtgggaaaggggtgtcccgtgtccctcccaaagcacagagcacagaaatgtgaggccgttatacagtggcgagttcctccgggcgtgggtgtttaagtctcattaaaaagatactcaaag

SEQ ID NO: 540050 - DNA, 244 bp, Homo sapiens
acctcccaggtaagaaaagcggtataattggttcatggttctgcaggccctgcaggaagcatggtgctcacatctgctcagcttcggcgaggccccaggaaatttacaatcatgagggaaggcaaagagggagccagcatatcacgtggcaaaggcaggggcaagacagagggaccaaaaggaccaccccaaaaggaaactcagatccattagcagccactccccttgccccttcccctagacc

SEQ ID NO: 540051 - DNA, 1531 bp, Homo sapiens
  misc_feature (1531)..(1531): n is a, c, g, or t
gggcgcttcgacgggctgggctgtgcgcctgcgcagtgtgggtcgctcccgattccctgccccggccggcccctcctcggctccgtaccctcgccccgctctcagcctgtcgcctctgctccctgtagcgagccagcacccgttgttcctggcaggtagtgttcaagcttggtgtcagcagacggatgcctctgacgcacagaacggatgcctggatgcgtcttcagcagacggtgtggccgacggtggcgttgcgtgcaagcatgtatcgcgcaggaaagtctagcgtaacactcctggaatgggatgcatctaacctgcctattccaacgaggttgccatcctcggcccaggctgactttgggaaagagaaccgactttggaacctatacggaaacacaagcgaaaagaccccttagttgcgtttgccttaccctaccggtttggtcggtgcaaggatatcgaagacaagcggtgacgagataggaccacgaggccccttttcgacgttcgcatgaagcagacccccgtaggaagtcccgggaactgcccgagtgggaaaacctttttcccctcagggggggaggcaatttggccaggtccacactccggtggaggaggcccctccgcggaatgtccttcgcacaacatcaaggctgcgggtaaagcagttacgcccatttttcccaatagtttccgggcacccttaggcatcacacctttggtccaaaccataggggtcggctccaccgaaagctattttgaaacgtgacgggccacggagttaggagggtatgtggcggcataggtcgggtgcgaaataacattcgggtacgagctttatccagaggattgggtgggttatggtgagaaacaccccctggacaagggagtggcatggagctccgcggccaattatttcatcgggggcccaaaaaaaaagggcggtttccacatagagccttgggcccgggagattacaattggggcgggcccgaataagatccctgagcctggttaattatatcgccaccagtttcccagagagtaccgaactggctggcgtttctcccaacagttaggagatttggagttatggggccgaccactctaaagcggcacgtttttggtagccgcctgccaaagagaaatgaccacccacacaaccttgtggtatcctccgcacatttttgggacgggcgaattcatgaacggggagctcaacagtgtttcccgggaaggaggaccccacaattttttcccgaaaagatctccccttatggagaaaggccagagaacttgccgccggcactgccgacaccaggacgacggagtggggaagacaaattttcccccctctgttgtattgagagagtttctccacgtttcggcgggagggaacccacagcgacaaaatctgggacaaccagcatggcggggcgacgatgatgcgccgccctcgtgtgtcgacacatatccacaataaggagagccacacgaacgaagcacgaaagggtgggggccctttaan

SEQ ID NO: 540052 - DNA, 319 bp, Homo sapiens
ggtcagtgattcctctggtgctcagtgtctctctatgctcttaacagtcccagatcccatcaatagtcacgccttgtgtccttccgccttctcacatattcagaaagcagatgtatagctgggcacggtggtgattcaagcttataatcccatcacatcggaatggcggagtggaggaggatcgcttgaggccaggaattttagaccagccggggcaagatagtgaaaccccatgctctaccagaataagaatagaacttagctgggcgtggtgtgcgtgtgcctgctgtttcagctactggagaggctgaagcgggag

SEQ ID NO: 540053 - DNA, 796 bp, Homo sapiens
caccttgtcacccttctgagtctccaatgtggagagattccacactccatgtccacgtgtacacattatttagctcccacttacaagtgagaacatgtggtatttgactttctgtttttgagttatttcacttaaaataatgacctccagtttcatccatgttgctgcaaaagacatgatctcgttcttttttatggcagtgtagtattccattccatatacatatataaacgttatatatatgtaacgttttctttatccaatcatctgttgatggatagattccatatctttgctactgtaaacagagctgtgataagcatacaagtgcaggtttctttttgatatactgatttcttttccttgggtagataccagtagtaggactgctggatcaaatggtagctctatttttaagacagtatggagaaatcaccatactgttttccataggggttgtactaatttacagtcccaccaacagtgtataggtgttcccttttctctgcatccttaccaatatctgtaatttttgacctttttaataatagccattctcacttgtgtgagataaggtctcatgtggttttaatttccatttctctgatgacttttgatgttaagcatttttttcatatgcttcttagccacgtgtatgtattctttttgaaaaaaatgtttattcatgtcttttgccactttttaatggcattattggattttgtcgagtaaggaggtctatatatctggaaataagttggataaatatctggaaattataaagtaaatatcgaaa

SEQ ID NO: 540054 - DNA, 161 bp, Homo sapiens
cctcgctttttcctccttctttcctttgttcaccgggttggccggaaccttttctggattgtagttgtccacaaattttcagtattttttccacttcattttttaggaagggagccaccggttggttgttcttcctttttttaaaaaaaaggttgcggccg

SEQ ID NO: 540055 - DNA, 100 bp, Homo sapiens
gcgcagatacgaatcgagccggacccctagtttagacagttcaactagcacaacatcaatgatgcatatgtccagaatcagttacaaagaccatccgttt

SEQ ID NO: 540056 - DNA, 164 bp, Homo sapiens
gatgtagttatgccaatatccgggttgaaatagagtaccaagtatagcaagatgtgaccactggaaaaaatggaataaaggatatgggggaatactataatttcgttataactgcatgtgaatctataattatcgtttactctattttttcactttgggaaccg

SEQ ID NO: 540057 - DNA, 209 bp, Homo sapiens
  misc_feature (118)..(118): n is a, c, g, or t
  misc_feature (185)..(185): n is a, c, g, or t
cacggtctccctgtttcccaggctggtctcagactcctggactctagcgatccccccagcttgagctcccaaattgctgggattcccgtcgtgagccaccatgtccagtctaactgtnttttaaagaagtttaaaaattactctctagctgcgcagggtggttggtgcctgtaatcccagcagtntgggaggctctggtgggaggacca

SEQ ID NO: 540058 - DNA, 408 bp, Homo sapiens
  misc_feature (1)..(1): n is a, c, g, or t
  misc_feature (129)..(129): n is a, c, g, or t
nttaaaactcagtgtactgccagattcgtctaaatgtctgtcatgtccagatttactttgcttctgttactgccagagttactagagatatcataataggataagaagaccctcatatgacctgcaganctcattttccttctgaaagaaactactacctaggagaatctaagctatagcagggatgatttatgcaaatttgaactagcttctttgttcacaattcagttcctcccaaccaaccagtcttcacttcaagagggccacactgcaacctcagcttaacatgaataacaaagactggctcaggagcagggcttgcagggcatgggtgggatcaccggagtcaagtaagttcaagaccagcctggccaacatggtgaaaccccacctctactaaaaattgtg

SEQ ID NO: 540059 - DNA, 212 bp, Homo sapiens
gcgtgcgggccacattgcagtgctgtcctctggctgcgagaatgtgatcctcacagcgttgtggaacgccacaacatgccggacgtggaagtcatggagtagcaaaagagctcctgttacaagctgtgaccatcagcagcactgagaaggaaaaggttctgatcgagggctccatcaactctgtccgggcgcattccgtgagcgggtacgct

SEQ ID NO: 540060 - DNA, 416 bp, Homo sapiens
acatcatgtggtctggagtgtagaaatctaatgcagccttcacgtagctggtcagcatctcagtgtggctggcagtgttgcgtagacgcctgactaactccaagatcaatgctggagctcctagcacgaaacccaaattaggtgacagcacatcgaagccccagcggtcctgatgtggcgtgacattgtgctttctgtctcgcggggaccggtcactccctcgctatgtgagcctgtctccttagcacgagagagaatatttctcctcactattaatggcgatataaacactattgttctacttgtcctgagactgaaaacagtagatgacccatatgcatacctaacttgtcccggatcagagacactcaatactgggccattgcaggtccaatgttccccgaagcattgcacat

SEQ ID NO: 540061 - DNA, 922 bp, Homo sapiens
aatctggtattcgtctgacagatgtgaagaaaattcttccatagaaggaaatgggcatatgattacccgcgtccttgatctctgggagtatagagagtgcgtagtgttagcagacgggaagctgtaatcactaatatgtctcactcatcatgtcaataccagactccatgtatccttcagaagaatgagtagtgtgtgtgctgtaggaaggagacgcagatctggtgctgctcagcgaacaagtatgctcatgggaatgctattaccgtaggagcatcctactacctacggtaacaagtgtgagatcatgactagagaggaattttctagttatcccgaggatgtggtgactactgaagaggattttcctagacgtgggcccggggcagctgtctggttccattatagagagggagtatttgatccgtaataagtaagataagctagttgtagaacctggggagggatctgagttgttagtggcggattcatgctagagatagtactagagcagtgatatctccagagaggggttcagatatgattaccaagcagttcgtagatcagagagatctttatatgaggagaaattagctcaagattttctgggtgataactaacacagtgtaggactaaggagctcatgacctgtacaagataagccccgctacttgggttaatgatatacacatgtggctactgggtttaccgggggatgttaggcgcatgaagtcccttgattgggttcaaaaacgggaaaaatccagaactctcaagaaaccaatctggtttgtcccatttgaccttggtgcctggcctggtctggctttattcttgacacttggctttcggcacactggcgtcactggtgcccagggggggtttccctgcgcccaacagtgggatgtttgtgttaccgaca

SEQ ID NO: 540062 - DNA, 773 bp, Homo sapiens
  misc_feature (5)..(5): n is a, c, g, or t
  misc_feature (92)..(92): n is a, c, g, or t
  misc_feature (112)..(112): n is a, c, g, or t
  misc_feature (142)..(142): n is a, c, g, or t
  misc_feature (206)..(206): n is a, c, g, or t
  misc_feature (241)..(241): n is a, c, g, or t
  misc_feature (243)..(243): n is a, c, g, or t
  misc_feature (256)..(256): n is a, c, g, or t
  misc_feature (279)..(279): n is a, c, g, or t
  misc_feature (281)..(281): n is a, c, g, or t
  misc_feature (298)..(298): n is a, c, g, or t
  misc_feature (301)..(301): n is a, c, g, or t
  misc_feature (308)..(308): n is a, c, g, or t
  misc_feature (322)..(322): n is a, c, g, or t
  misc_feature (340)..(340): n is a, c, g, or t
  misc_feature (352)..(352): n is a, c, g, or t
  misc_feature (354)..(354): n is a, c, g, or t
  misc_feature (363)..(364): n is a, c, g, or t
  misc_feature (366)..(366): n is a, c, g, or t
  misc_feature (369)..(369): n is a, c, g, or t
  misc_feature (371)..(371): n is a, c, g, or t
  misc_feature (378)..(378): n is a, c, g, or t
  misc_feature (380)..(381): n is a, c, g, or t
  misc_feature (388)..(388): n is a, c, g, or t
  misc_feature (392)..(392): n is a, c, g, or t
  misc_feature (394)..(394): n is a, c, g, or t
  misc_feature (396)..(396): n is a, c, g, or t
  misc_feature (400)..(401): n is a, c, g, or t
  misc_feature (408)..(408): n is a, c, g, or t
  misc_feature (411)..(411): n is a, c, g, or t
  misc_feature (414)..(414): n is a, c, g, or t
  misc_feature (437)..(437): n is a, c, g, or t
  misc_feature (459)..(459): n is a, c, g, or t
  misc_feature (464)..(464): n is a, c, g, or t
  misc_feature (466)..(466): n is a, c, g, or t
  misc_feature (470)..(470): n is a, c, g, or t
  misc_feature (480)..(480): n is a, c, g, or t
  misc_feature (483)..(483): n is a, c, g, or t
  misc_feature (497)..(497): n is a, c, g, or t
  misc_feature (529)..(529): n is a, c, g, or t
  misc_feature (558)..(558): n is a, c, g, or t
  misc_feature (605)..(605): n is a, c, g, or t
  misc_feature (631)..(631): n is a, c, g, or t
  misc_feature (641)..(641): n is a, c, g, or t
  misc_feature (648)..(648): n is a, c, g, or t
  misc_feature (752)..(752): n is a, c, g, or t
gaaanagaaaaaagtatttataaaaaaatgaataaatttagaaattgtacaaaacattaatccagcaagatattaattacagtcactaaaangaacactcaacatatttggnactgccacttccatgaaaagctcagaaaangtcactggctaaaaagtcacaacaaaagcaatttaagcgttacgtacaacagaaaagggaaatnttccacaataacaatgcagacacaatcactaagangntctccatgcggcnatgggttccggggaggtgttggngngtccatcttctacaagnganatcatcngcgttccaagagcnacacttgaggcattagangtaatacaaaananggggggctnnantantnagacaananngggacantaanananaggnngagtcanganggnggggggggggcggggggggggangggggggggggggggggggggngggcncngggngaatgggtcngtnaccaacctcctggncacaggaactaggcacagttctagggccattnacggggctccttcactggctctgaaagcngactttccctttcattaggctcggcaagcaagccagggtttcctggncaacattaaagaacattatcctctcnggcccaggcnagagaantttatcagtacacaagttgatttttatttcttgaacacttccaataaactagcataagttttattacaacatatacagatttgatacagtttacaaaaaaaacnagatttttcaactaaataaaa

SEQ ID NO: 540063 - DNA, 327 bp, Homo sapiens
acagtgctgtaccttcttcgctgtgtagacactgagctcgctgtatagggacctgggcatgcctgtagacgtatccagcacaggcgcgccgtgttgatctacctcatacgggtcttgcataaccgaccgaagcttgggtatttccacgtactgattgcgtttcaaacgagataggttcgatcccatgggtctccgtcacgcagggtgcgcaaaaccttggcctttttgccagcggctttggcaccaaccctgttgccatttgcttttggggccattgaaacgggatcctgggcttgaaaaaccacttgtgagaagctgtatgccctg

SEQ ID NO: 540064 - DNA, 1250 bp, Homo sapiens
ggttccccgaccaggtctggcgagacttggggccagcgcttctggtctggtaaatatgtatgatagtgtaagtgcttttttaacacaaggaggggccagtggattccacacagcaaaaccggtcccttccatgccctgggatgcctacaccacacccaggtctcttcctttgctctgaggtccctatcaaggcctaccccaatccaggccaaagccccatgtagcctatgtaccaggaaactcgcctagggccaatgccgacggggccacgcaggagggcagccaccacacacacatgcaccggcctagggcgcacgcccaacacacacgaaaccacatactaccgccctacatactagaactccaggaaacctacgtcctatgacacgaatcaggcactaagagaagtcactgcgcaacacccaaaccaaagacaacgcccccggaacataatgcggacaagacaacaaacggacacgcagagcaagcggaggacaaagaaaccaccgagagaacacacaccgacatgtaaaccaccggaaacagcacacaagatcacacaagcacaacgacacgcacggaggcgacctagagccgataacagcacaccatgcgagcccattcacaacgaatgaatcaatcgaaaagacatatatacactaaaagaaacaaacaccacagaaaaaggacacaccacaacaacacacgcgtacatacaaaccaaagagcaccacagaagcaacaaaccaacaagcgacgccgaacaaacaaaacaaaacagaacagagcagaactcacccgcagaaacaacaagccagaatgcaaagcaaaatgagaaaacgagaggcgcgcaaggccgcacaatgaacgaaacacagatagagtacaggcaagagacatatcctacgcgcacagtcggcacgagaagcgtcagacaaaagagcataaaaacaagagaacaatataagaaagaaaagacaggaacacagcacatacaacgacacaacgggacaaacgaacacaacaaacaacaaccgctactagcaacagacgcacagagacacacaaacacatgagacgacagcaaacagcaagcaaagcgacaacaaagacaataaacaaagacaacaacaacacacgagaagcaaacaaagaggagaacacaccaagagaccgaaccgacacatcaagcaacaaaagccacgagcagaataagtagagagacagacgaagcgagaaacgagaccgct

SEQ ID NO: 540065 - DNA, 736 bp, Homo sapiens
tggcccagtctgggcccccggggcatgacagtggaccaccagtggcctgctggcccccccgggtctaaggtgaccgaggcctagacaggagagaagggtccagctgggggccgcctgggctcctggggcctccagggccccgtgggcttcctggagagatgtgtggcgccccggccccccatgagaacaccctggtccagctaggcaacccaggcccctcaccaaacagccccctagaggcgccctctactcactgcagccagtctacgagacaaagacaatggagactcataggctggcctctgccatctgtggacacaaggtgctggcaggtgtccaaggaccccaggaggtccgccacttgagtccaccaagtggttccacccattgagtagacctaaggaagggccaccccaagagaagctccctaggataacacgcatggaatcacaagaggcacatgagcttggaagaggccagaaaggcacaaagatgggggcacagtccaggagtgaaaccgtgggccggttgacaacgggggcggacacatgaaacgcgatgaagtaaaaagcacagcacgactttgacaagaaggtgagcgcacagggacgtgaccagacgatcctgagcagaacggccactgagaagataccatggacaagaagcaaaagatccttagtactatagacgcagcacttgagtaggggattccaggaatccacagtagccatccacc

SEQ ID NO: 540066 - DNA, 256 bp, Homo sapiens
cacgaggggcgccctggtggcgagccgcgctgtgcgagtgtcggagatggtggggcttcaccacctcggtcgtcctgggccgccggacatccccgctggggtcgttgtccaccagtgacatccacttgatcaacctgttgcggctggagaagtaccggagcttctcccgccaccggagctgggcacagcaggaggcgcaggccccgcactggaggcggacctaccgaaagtaattcggggagaaatcattttccat

SEQ ID NO: 540067 - DNA, 283 bp, Homo sapiens
gctcgaccatggctctagcaaagcttttggctcggcaagggttggctcgcaggacttcgaaacctgccgcctggagtgctttcatggctcttcgctcgtagccaccggtcgcttccagcaatgcacgattgacttgatggcgcttcagcactcaaccatccttgaaaagtcattgatgtcattgggaaaaaccgcccccatcccttgtggatcaagttcgatctgcagggtgtctttagaaacgtcgatgccagcacaggtaaacatggccaaatcctcttac

SEQ ID NO: 540068 - DNA, 314 bp, Homo sapiens
  misc_feature (20)..(20): n is a, c, g, or t
  misc_feature (32)..(32): n is a, c, g, or t
  misc_feature (71)..(71): n is a, c, g, or t
  misc_feature (99)..(99): n is a, c, g, or t
  misc_feature (107)..(107): n is a, c, g, or t
  misc_feature (207)..(207): n is a, c, g, or t
  misc_feature (251)..(251): n is a, c, g, or t
  misc_feature (272)..(272): n is a, c, g, or t
ctcccagacttcctaagaancgccgggcccanctttgtactcatccaccccagccggcttgggactcaganaccgaagtcttttttttttctctccganccttgganacctcctctgtctgccatttattagccatgtgaacttggccacatcacttcacctccctgagcctcagtttcctcatctgtcaaatgggggtttataaanacctacctcgcagggttgttgtgaggatttaatgcgataatgtntgtaaagcgccttgcacactncctggcacacagtaggcgctcaataaatctaagcttcccttt

SEQ ID NO: 540069 - DNA, 166 bp, Homo sapiens
tgagtcggtacctaatcctatttgtcacggcaggacaggtggaggtattggatcatgggagtggtttccccatgctgttcttgtgatagtgagtgagtttacatgagatctgatggttttataagtgtctggcatttcccctggttacactcactccatcctgctg

SEQ ID NO: 540070 - DNA, 378 bp, Homo sapiens
atgaagatatgtggctcatgtactctacaaaaagtaaaatttgcagctgctcaggatatctctgcactcttcttcacaaccattaccccaattgcctggtaatcgttacgcagtcattctgcttgaccaattcaaatgtttcgcactcatgatccatgccaacatggtgaagacagatcacatatatattgtttgttattgaatccccagtgccaggcacatagtgctcaaaaattatttgctaaactaataaagattcactacaaaagaataaaacaagattcactaaaaaagaataaagaagacagtcatcttgtgtctttttaccaagagccagacatgatccaggatgaaatgggaccctttctcttacatgcc

SEQ ID NO: 540071 - DNA, 451 bp, Homo sapiens
  misc_feature (32)..(32): n is a, c, g, or t
  misc_feature (58)..(58): n is a, c, g, or t
  misc_feature (163)..(163): n is a, c, g, or t
  misc_feature (259)..(259): n is a, c, g, or t
aatttaaatttaaattttttttcatttttttnagaggttttttttgttttgttttgtngttgttgttgttgttgtttttgagacagtcttgctctgtcacccaggctgggagtgcagtggcatgatctctgcaacctctacctcccaggttcaagcaattctngtgcctcagcctcccaagtaactgggactacaggtgcacgctaccacacctggctgattttttttgttttagtagagacagggtttcaaccatgtngcccaggttggtctcaaactcctgagctcaggcaatccacccgccttggcctcccaaagtgctaggattacaggtgtgagccaccacacccagctattttttcctttgcgttttttaaattttaaagttggggggggtctcaatttgttaccctggctggtctcgaactcccggacttaagcgatcctctgg

SEQ ID NO: 540072 - DNA, 1214 bp, Homo sapiens
gctgggaagatggctgtgactcggtggctagcctgatgaggaggcctgtggggtgtgaacccgtgcccccgtggccccgagacctgactgagtggagcgactgcgcagtggcctggggagtcatggtctccatcacccaactccatgcttcgatgtcctgctctctgcctcagacctcccctgactctggctgtctggcctgctgcttgatccctccagtacagccctgctgtttttggtgtgcccagcaaatgggtgggacctggcctgttgtgaggatggccccagtgcaggtgtcctgtgcaaggacttgcatgctgtgcattcttggaacatgtgctgaatgagccctgtggtgaagcttgcttgctgcttggcttggtgccatgaaggcccagcaaggtagctgctgccccaccatctaacctcgtgttgagcagcttacgattcagttctgggagccaggcatcattgaggggatctcgggaccaacgtgcccccacttccttgttggacgcaggtgtacacactgcaagggacattgaactcatgccttcatcaatcctgaaacttgccccgtccttttgacaattcagcaaccatcccacagttgtttgtcattgcaaccatttgcaaagatctataccttagatgcctctatcgcgaatacttgagtgagttcccacttgtgcttggtgatagcacacatgtgtaaaacccaggtgatggcgacagggcttccgagcatcccacattcggtcaaagaccgacacttcacacctctatgtgcagggacacctatcatccccggatgttgtatggggcaagtgggcgtttggaagagggcttctgatttctacagagcttttgcctcgcactggatttattttcctttcgtagtgggtaatcacctcatgggtgcccatgcaagttcttcgacttcaaggacagggaggcgtttggtctggagtgaatatgctccaacgtgttccacgagaatgtaaagactatgtgtagaatccagcgcaaagctgttacacatgtgtgtgaacattaccttaagtggccgcaaagaacaaaacctatggtgccgcatcgatcgactacgtgctattttcatgatcgtgagatcactcccgcgcaaacacactgctgtgaagtgtccaaatggtgccgcaatctattaccattgattgtgtggtgcaggtacaacg

SEQ ID NO: 540073 - DNA, 162 bp, Homo sapiens
ataaaatattaaggatactagtataagagatcaggttcgtcctttaatgttgtgtatggttatcatattgttttgagcgttagtttgattagtcattgtagggtaggtgattagatcagttgttgatagagatatttaggaggtgggcgatcaataagaggg

SEQ ID NO: 540074 - DNA, 186 bp, Homo sapiens
  misc_feature (129)..(129): n is a, c, g, or t
  misc_feature (135)..(135): n is a, c, g, or t
  misc_feature (179)..(179): n is a, c, g, or t
tccttaggagggcgacaagactaaggcgatgctgtatcacaggaggcacgatcccaagctctttttttcttttttctttttgtctggtacagacgaagtctcactatgtggcccaggttgatctcaaantccggnggctcaactggatcctcccaccttgggcctcccaagaaggctanggattac

SEQ ID NO: 540075 - DNA, 103 bp, Homo sapiens
  misc_feature (12)..(12): n is a, c, g, or t
  misc_feature (21)..(21): n is a, c, g, or t
  misc_feature (82)..(82): n is a, c, g, or t
accgataaaaantccgaaagnaaaaaactggcccaacatgccgctatccgaaaaatgtccttcaaggctgggaatgaaaccntggaaagctccgaaaaacaaa

SEQ ID NO: 540076 - DNA, 109 bp, Homo sapiens
  misc_feature (101)..(101): n is a, c, g, or t
acaacagaagaactcacttgtggttctacacatgagtgcattgatagtcacactagtgcaggaaggtccaaatgagattaacaatcctgtacataacccgncttctgtg

SEQ ID NO: 540077 - DNA, 566 bp, Homo sapiens
  misc_feature (326)..(326): n is a, c, g, or t
  misc_feature (387)..(388): n is a, c, g, or t
  misc_feature (396)..(396): n is a, c, g, or t
  misc_feature (473)..(473): n is a, c, g, or t
  misc_feature (508)..(508): n is a, c, g, or t
caggcccagcatgcagcatcaaggagacagtcggggtctctgtcccttgagagcctgcagtccagaggtcgtgggaggaaggaaggagggtggagggaaagccggaagcccaggcgagctccaaggcctctggctcagtcagctgggcagcaggtggtggatcctgggcagagcatccctggagggaaggagaagggggcaggtgtggagctggggatgataggttcggttttgtcctgaaactggaggggaaggtggcatggtgcagaggtgtgtaccagtgaccaagaaggtccggtggccaggcatggtggctcacacttacnatctcagcactttgggatgccgagacaggaggattgcttgagcccaggagttcgagaccannctggccgncataggaaaccccatctctacaaaaaataataagctgggcttgatggtgcacacctgtacttaggagactgaggtangagaatcacttgtgcctgggaggtccaggctgtantcagctatgattgtgctactgtactccatcttgggtgacagtgagaccctttctcagg

SEQ ID NO: 540078 - DNA, 88 bp, Homo sapiens
taaattcacacgcgtcagacacagcaggatggtggccatggaagtaggcatcgggcgccttaacccggcgttcggttcatcccgcagc

SEQ ID NO: 540079 - DNA, 352 bp, Homo sapiens
gcgctgccctgtgtagacaagcattccaagctctttgaagacgcctgaggaccccagctaagcgcgcattcttcggccgagatcatctcctccgtgtccgacgtgaagtacatgccacatgcggtcgctaacatgctcacccggggactaccttacagtcaaggtctgggacctgaacatggaggcaagacccatatagacctagcaggtccttgtacgtaccttcggagcgagctctgttccctgtacgagaacgactgcactttgcgacaagtctgattgtgcctggaacggtagcgacagcgtcatcatgaccggggcctactacaactacttccgcatgtccgcttgt

SEQ ID NO: 540080 - DNA, 183 bp, Homo sapiens
tcctggtgatctaagtcgtcgtcgacaccagcatgatgtcgacttcaaagtgatatgtgatatatgaactagcgggtatgcacctgatcgcagcacttgtgcatttaactaagtactacccgacttgagggatgatacagttcctatagagtatacactgtcgaggacggaccgggtcgatcg

SEQ ID NO: 540081 - DNA, 190 bp, Homo sapiens
  misc_feature (85)..(85): n is a, c, g, or t
gtggaacatcagaacttccagcttctgtgatgcagcaggattccaggaaggcaaatggaaagtacacagggaggaagatgaactncgcaaagcctttgtcatatgatagtgactcgcgggctcccgggcgtgagggcgtgtgtgtagctagccctcagcggcctagtcagggtttctctatgggaaagtg

SEQ ID NO: 540082 - DNA, 102 bp, Homo sapiens
tctttgataggaacgtactgggatgaggaactttactgggatgaggaacgtactgggatgaggaacgtactgggatgaggaacgtactgggcaggcggtgcc

SEQ ID NO: 540083 - DNA, 300 bp, Homo sapiens
atttaatattctgtaggagcttggctgtgagtcttgggctctggcctccttgaagaaccatgccatgaatgaagaaaagtagaggtggctttgctgcctcctgggagcccagaacttgcagtaaccctttagtggtcctgccccaggcccatgcagtgctgaggagctgtcacagagagggcctcagctctgacctgacacctgctctccccagcctgttttctcttttctaaaagacaaattatggtaccataatgctgcaaatgatccctccttgctcagaccccttttgccagggcg

SEQ ID NO: 540084 - DNA, 224 bp, Homo sapiens
acactggaccatctctgtaggactcgtacaaaacactagaacacaaagaaaacacaagaaagaaagcgggaaaaagagctggtggtattgctacatttctgccatgatgtttacaagatggcgaccaccaaagtcaaacgactaacctatctatgcccaacagtcgtttctcagggtcactgtcctatgagcccaacagtcccttatgagcgtcagtatagata

SEQ ID NO: 540085 - DNA, 1211 bp, Homo sapiens
gtgtgacgagtcccgcgattctctccttgaatccactcgccagccctgcctgccctctgtctgccagcaccctgcacaccctgcccctctcctgtgccaggaacttgctactaccatgcaccatgccctaccaatatccatgcactgacccctggagcagaagaatggcatgctgtcttgacatcgctcacctgcctctgtggcacctgtgcacaggtgcatcctgtgctgcatgatgagtccactgggagcatttgccaatgctgcgctgcagctccatatggcacctgagcaacacccgagtgagaaccggcgcttctacctgccatgctgctcgctgacacgctgactgacctgcgatgaacccctgccatctgcgcggctgtacatcctacttccactgacgacaactcataccagcaagcgcggcatgactgggcgctcccattcccccaagctctatcacatcactcccacacgggcggcgcttgctgcgcactcccggctcacacacaacggccgtggctcccacactgagcagcgcgaccacaccgcgcggaccacctaccacccacaccggcgctccgcgactgccgctgctcctgacgccgaccagctgcgccccagtccacaccaacgcgacctcgccgccctgcaccgcctcgcgccaccagccggacgcacagtagctcgcccagcaccgcactcagcccgacccccaaccacccaccccctccccgcccccccaccgcccaacatcacctgcgcacaccacatgcccaaccccgcccctgcccgccggctcatgccccatagcgcccttccttgcccccaggaccgacaattgcgtcccctctgactgccacccacaaccacccgtcggacgttccttgacagcactcacaatcgccgactaacatgctgcgtcccccctactccacacttatcaatacaccaaccacttccacaacacaccataatctcacccccctcctcactctgcctcgtaccttcacaccaactcacatcttcactaccacactctgatcccttcctcgtcacctctcacctcccacccctcaccactctccccctccccttctcacacactctccaacccccttccaacctcacaccttgcctccaacccctatccctcacaccccccaccacatccccattacatccactcacaacactccaccacacac

SEQ ID NO: 540086 - DNA, 519 bp, Homo sapiens
atcaggactgctgatcactacatatccagatgctcatctttgggtgaaaaattgtcgggatcttctgcagctccagctacaacaaacagcgcttggatcaacctttagaggcttcaacctggctgaagaatttcacaacctacaaattgcgcgcttccttgaaccagggcataacacggtgtgaggaacgccacaagatgcagttaggaacttgtgctagaaaggagctaaacgaggcaaagttctatcgggtatgtttcacctacctagtgaccgtggatggaatcaatgctctttggggaagaaaccattctaaaaagagaagatcaaagcccgattgccccccaatgaaatttagcacttgttcacaacttgaggaaaatgatgcacaatgattcggcatggaggcgccattatgtcggcattgagccagactgggtctctctttaagccccggaaagcctatcttccccaagagtttgctgggaaaggagggattatatgccctggatcccttta

SEQ ID NO: 540087 - DNA, 1133 bp, Homo sapiens
tctggggggcaaagtctccctttgtccccagggtggattcgcagggggtggccatctcgggctccactggcgagcactggttctcgggctcactggcgagcctccggcctcccggttattcaaggcgattctcctgtgtgctcagcctcctggatgtacgctggggactacgggtgttggcaccaccacgcccgggctatattttgtggtgtattttcttagtagataagaagacggggggttacacatctgggtgtgtgtggcgccaggagagtgtgggctctcacaatctcttcagagctcctcgtgagaatctcgcgccacactctctttgagggctctccccccaaaagtgtgtgtttgcggagtattaaaccaggggtctgtgagaaatctctcaacccgatgggccccagagcaccatcttaaaggtgttatttcttcttatatattccgaccactctttctctatatccccctatagagaagacaatctcttctttttatatatatcttctcctctgtgagaaccctatattttgcgtatgaggaatcataaaatatagagggggctgtgggaggcgtctgtgggcgcccccccttgttgtgggtgccaactcacaaacgacagagagtgttatattttcgctctctttgtgggacgccacgagagtattgggagaaatagttttttggggcgccacaattagagagtatgaggagagtctggcgtgtgagagtagttttcaccacacacagaaggtgtgtgaggagccttttttgttttttcctgcggtgtggcgcccactaattttgtggtgtgtacactggggaggacagcaagacggtggtgtggggtcaccccctttgaagaaaaagaggggcgatagatagggcgaccacgttgtgtgcccctcgacaaatatcaacgaaggcaatactagtagaacagtggtacccaccactctgtggcgccagaatctctgtggtatatccccctgaggagttacattctggggaggatataaaaaccccaaaccttggcgggactaaactcttttgctaatatactcttcttgtgtgtccccccccaaaaaatgtgtcggggggggagggacacttttttattcccg

SEQ ID NO: 540088 - DNA, 855 bp, Homo sapiens
tggccaaaaaatcccgcttttttttccttaaatccggtgaggaaagggggggaaaaggcgccccttgtttgaggagggcgccttaaagcaaagagttgagggttcatcgccaagtcgcccgtgggctttgggggcatcgcgcggggagcatctgatgatggggcgtctccccgccagtctggtctggctttctcagacgggcgctgcggcctggtggttcgtcctgaaccttggttgccctccaggctcccggctctcaggctctcggggcctcgatcagtggccgacctcgcggtgcctatagttgcccggctcaagcgctccctgaagaaacaccccgtcgggggggccctccacgcctgcatcgtcctggtcgtctctgggcggtgttcacccttggggtgtacggcttcatctcaagggggggcgaggggttgcactcttgccgctggctctagattggtcctcgcgggctcatgcgggcccctctttcgggggggcactggcgctgcccgaggttttcttgccacacactgaagcctcccatctctgttacatcccgcgggaagcccccccttaaagagaccctcggatggtgtgtcccctcggagacaaggcgccacattcgggcgttgtaggtcccaaggcgctgggaggacaacatacctcccgggtgagagggcccaaggggagaccgtcttatgtcggccccagtaaagtcacaaagggaccccacagaaacgttgccgggcgggaacaccccaccctggacgacgttcttcagaaattggcccagcgcacaacggcttttgctccagtcccactaagctcgcccatataatgtgccgcaaccaa

SEQ ID NO: 540089 - DNA, 225 bp, Homo sapiens
acagtacgatacttatggtgaagaaggattaaaagatggtaatcagagctcccatggagacattttttacacttttttggggattttggtttcatgtttggaggaccactcgtcagcaagacagaatattccaagaggagtgatattattgtagatctagagtcactttgagagtatatgcagaaatttttagagtagttagaacaacctctgcaagcagcctct

SEQ ID NO: 540090 - DNA, 693 bp, Homo sapiens
cgcagtggttcacgcctgtaatcttagcactttgggaggctgaggcgggcggatcacgaggtcaggagtttgagaccagcctcaccaatgtggtgccctgtctctagtatacagctgtcttagattcactcgtttcctctacgcagtgacttgtcctgctatagcttttcttgttatttatctctatcgcttatttcttctcttcttgcagatttccgtctatctccttcctcttttattcttatcttcctttctatttccctcatttttttattctctcccttttttctattctatatcttcttatcatgtccttctcgttttctctatttttcttcattcttatcatttcgtttactctcctcatctgtatctgtatcccttcttatctcttttcttttctctccttatctcttcgtatctattattgttctctttcgtttcgtttttatacatgttctttttctatacactttctgctctttttcctttctgttatttatatttttattgtcttttatgatttcccttttccatctctcttctctttcattctttctctccttctatttcgtgtcttcgttttttttcattcctttttctctctttcctgctcttttcttcttattttttgctctttattgactcatcctatatctcatccttgatactgtttcttatcttttgtcctcg

SEQ ID NO: 540091 - DNA, 167 bp, Homo sapiens
cgccctggcgcgtggaaaccgctgagatcacatgtgctctcaatcaggatgccccctgcccctcccgcatgcagcctaaaattcagaaggatcccagtgtcttggctgtgagggaaaaccgagagaaggtcgtggaagccctcacccgtagctgtagctcacccgta

SEQ ID NO: 540092 - DNA, 305 bp, Homo sapiens
tttttgggggccccctttttaaaagtttaaaaaaatgttgccagggggggtccgtttttaacccaagacttgggggttatgccaccaattcccgtcggtggggtttaaagggttttaatcccccctgtatggggaagaagttccggggatcctgttgggaaatttaaaccgtaaaaataaagggtttaaaaacctgggttgttgctctgtatgggaaaaactaattttggtccgccagggacaaaaatactaaaccctttttttcccccttccagcccaaaaaaaggttgggtttttacccccca

SEQ ID NO: 540093 - DNA, 1185 bp, Homo sapiens
  misc_feature (222)..(222): n is a, c, g, or t
  misc_feature (521)..(521): n is a, c, g, or t
  misc_feature (556)..(556): n is a, c, g, or t
  misc_feature (949)..(949): n is a, c, g, or t
tcaatagccccttgagggtggtcaagcacggcccctgccgcggatttttaggggtgccccgcctatgttgtggacctccgtgaaggtagtcccccgccaggggttgtggtgcccacgagaataagccccaggccttttgggtttaagaacctgcactcgcgcccccacgttgtaacctttattttaaccgcgggtctccttaataggggttttcgcgtaagngccccttgtgtgttggccggaaaattttccgggcgcccccgcagaggggttcttcccctcgcccgaccgttttcttggggggttttccccgctgtggcccggtgtcccttcgggggacacccctcgggggaccctctcggggcccttgggcccctctagccgcgagatttttatggggccgcaccgcgatagagccccgctgttggcgctgtctctgtaaaagaggcgctacacgcgcccccacgcgttccacgggggcatctcactcacaatttgtcgaggcccacgaataggagaangttataattgtgagcccccgctgagaaggttttgngggaaagccactctataaaggagcctcgagctctgagaaggcccctcgccactgggaatgtccccacacgttgcactgagagttttgggaaggatataatatccacgccacgcgctcgtatacccacgctggccacggttcctcccacactctttatattcctctctattcccacgaaaaacacaccgcgctggggccccaacaagggagtgaaaagagagagaggccactctttgtgaagaacttgggccacaatgtggagactcgctgagcccacaagagttggttgtggccgccaatgggttctatttgagaagagtttctcgtgagttctcacacttctccacggaagacccacttgcactccacttgggccccaccacctcggtggtnccactgaaaaagccacgatgacttgggcccaaggtggaaatgaagaaagtacccaagaccacggaaaccgcctggaagttgctttggcttgtggtgtaaattgggatcgcccccatataaccactttcccttggatgtagtctgaggcccccttaactccatctgttatcctgctagctgtagaaatgtatccctgataaacaccattaaacccctgtaatcttataaagtgttta

SEQ ID NO: 540094 - DNA, 168 bp, Homo sapiens
tcgtatacggtggctgcactcctggatcgtcttgatccaagctagcatatcatctctgtcttcagcctgaaacaggcattcacacgtcggacgtggttgagtcgcaacacatttttcctacttggtctcacgagtaaagagatgtctatacaagcaagcattaacact

SEQ ID NO: 540095 - DNA, 1193 bp, Homo sapiens
aaaaaaaactgccagccaagaatattaaactaagtaaagcgtgtccttcaattttgaaggatagctttacttagtctactattcttggctggcagttatttttatttcagcactgtaatatactattatcccattctctcctgaccatgtaagctctttgtatccttttttgttctcttacaacccaggacaatctctcttatacgtgcacttgactgcctttcccttttggctgatctttagcacattctcatctggtgttggcactcttgtggaccaatttgaattgtaactgttgccttgtacagacacaacaccgtctatctgtgcgtttctgcaactcctcttctctgcgggcgcatctcacttgcagatcatctctcgtgcttactcactgagactgctcatgagtacttcgtcgtgtgcgaatacgcacctttaacagccacaactgttaccgaaccactggactatcattacataagaggccttacacatctaccgcgctatcaaccctctcgaggtgacgcgcattctgtactacgcgtcactattcgaataccatcatcaccccttgggataacaccacagctcccggaagagagacatctgtcactccactgcagagtaccattgagaacctttagggatgtatcaaatttcgacccaacacacgaagaggcatcacccttgtgatcgcctcattcacaacagaagtgtccacaagaacaacaaccaactccctttctcagggttgctcatcaggcaggcccacatacagcacattaccccatacaacagccggatagcaacctcatatacgcagcgacaacaaagaaccttccttcccaacaggtatcatcgcccgaaccgtgactgccaccaacaaagcacccttgagtcgagcagagatgactcccacaacatccaacggaacacaaacatattgcaatggagcgcccacaaagaatcaatcaccctcaacagacggacaactctaacaagcaggcactcacaccatggcaagcacgtaacataacttttataatcgtacacacgcctaaaagctaacagctagcctaagcaaactgtgcacgtcacaccactcaacccgctagggaccacaacctagggactgcaacgtcagacagatcagcccgccaaagaacagcacaccactaccatcgcaacac

SEQ ID NO: 540096 - DNA, 428 bp, Homo sapiens
gacggatcagggtttatctggaacacatgtactcaaggggtgtatagaacagtgaagtggcttgtctcttaacaacctcttagctgtttgcctcaatttcccatcacattctggttaaagccttacttcattaataatgtggtttatattatctttcactattcatcatcgtgaagatgatttctcatgggggggaagatttttttggtattccattatattttctcaaaatttaaagagtaaagaactgaatatttttggggccaggaagtgtggcttatgactataatcccagcactttcagaggctgaggcagtcagatcacttgaagtcagaagttcgagaccagcctagccaatatagtgaaacctcgttggtatcgaaaatacaaaaattagccgggcatggttgtgcgcgtctgtcatgtc

SEQ ID NO: 540097 - DNA, 162 bp, Homo sapiens
gacccctgaaaacagatctggcatccataatctcacctcgctgagaagatactgccatttcagccgacagtgcaatgacagtttctgcacagggactggagattatctccatgaaaagagcttggagtgaggaaattagttaatgtggatgaatgacgttac

SEQ ID NO: 540098 - DNA, 217 bp, Homo sapiens
ccaatcagctcccaagtatctaggactacaggtgcgtgccaccacacctgaccaatttgggatttttggtcgagacagggtttcaccatgtggcccaggctcaccacgttgaaccccggggctcaagggggcaaataggagaaggtttcaggcattggtttggtctctgggagggaaggcacaatgaggtggagtggacaaatggctgaggccttta

SEQ ID NO: 540099 - DNA, 293 bp, Homo sapiens
ctcacaacaggcatagtatttggaaagcaaaataaggttttcttttccccttctggtaataaatgataaaattccgagtctttctcactgccttggtttagaagagagtagctcgtcctcacgggtctacacgggtggccgaatttactggtatccctaacggtttggtatatgctgcatggagacttacggcaagaaggcattttttttttttcaagggaacacaaattctcaactcatgcagtgatcatacaacgctgcatatgcctcacaagctcgtgaatcaggtccca

SEQ ID NO: 540100 - DNA, 322 bp, Homo sapiens
  misc_feature (58)..(58): n is a, c, g, or t
  misc_feature (80)..(80): n is a, c, g, or t
  misc_feature (116)..(116): n is a, c, g, or t
tactagcgaacgtgaaggctaagcgctgagttaatgtatttagtgttttggtcctttnctgccctgtgattgaacacgcnttagttccaaagggcgcacaggaagagaatcccaantatggggaagaacagtgttcctatcctttcttttagatattatcacatgctcctgtttttcttttagaaagacaatagctacaacaaggataccatgaattctatttgaaactgagttgttgcagataaaaaatttgcctcaaagacattgtgatatatatgaccccatacaccacggaattgtgataagaaaattccatttaaat

SEQ ID NO: 540101 - DNA, 302 bp, Homo sapiens
gatcagtttatgagagcttgtgggacaccatctaagtggacaacaaatgcataatttgatatgtcagaaaaatgaagaaataaaatatattcaaatgaaattattgtcagacaaacttcccatgcttgactgagacgtcttgagcaagcttgtggaatgtgtagccctgggtgcactgggcacttgctcacaaaggcccaaagcagtgcatgtcaaaatgtggtaccgattgtgaacattgcaccatgactgtgttggttgctctgtcgttgaatgcacaccatggctcacatgcccaatcc

SEQ ID NO: 540102 - DNA, 354 bp, Homo sapiens
  misc_feature (9)..(9): n is a, c, g, or t
  misc_feature (90)..(91): n is a, c, g, or t
  misc_feature (274)..(274): n is a, c, g, or t
  misc_feature (290)..(290): n is a, c, g, or t
  misc_feature (311)..(312): n is a, c, g, or t
ccctgaacncccagggcatacctatacagccatgaaaaagaatgaaatgatgccctttacagcaacatggattccatctggagcccatcnncctaagtgaattaacagagggacagaaaaccaaataccacatgttctcatttataaatgagagctaaacattgagtacaggtgaacataaaaacaggtactacagacactggggactactggagagggtagaagggaagaggggaatggaccgaaaaactacccatcaggtactatgctctcncctgggcaacagggcnttccataccccaattcttagnntcacataatattcccatgtaacaaacctgcacttggaccccc

SEQ ID NO: 540103 - DNA, 446 bp, Homo sapiens
tgttatagttatgaacaaactgaaaaagaaacatctcatgtcaaaaactggcaaattggcagatgtctttatatacagcagcgtgcaagctaaagtcattaataacccagagaaaccaaagaacaggcaggtctatagcctgccctctatactcacatcgcgatgacaaggaccatttcactggtcatcaacgtttttgtttttcgtccatcaaaatcagcatgccttaacaacactggagaaggtgtggggtgaagggtcattaagggcacgcagtagccataatgccacaccctttgtgccagccactgcgcttctggaaacctaccccacagcggtcaaccgaaagacagcaaaggcttctggcactaagctggtcacaaacgcattactaattattgtgcacatgtggaacctaccatctaagcctcctttctaaggcgaaa

SEQ ID NO: 540104 - DNA, 127 bp, Homo sapiens
  misc_feature (76)..(77): n is a, c, g, or t
ccggaccgtaggtaggtttgttggggccactttctgagggcctcgcttgttctttacttttttccactctagggcnnacggatccccgcagtaccaaaccctgggaagggagtttaagccggggctt

SEQ ID NO: 540105 - DNA, 229 bp, Homo sapiens
tggaatcccctggtttgaaggcatacattttcctaccatgcgttcagatctgaaacttcaagaaaagtacatgatgagtttgtgataaggggtgaagatgtgataatatcgacttaccccaaatcaggcctaaattagctggctgagattatctgtctgatgggttctaagggggatgataggtgagtttaatctatgccaatttaggcgcgattgccccgggtagaaa

SEQ ID NO: 540106 - DNA, 174 bp, Homo sapiens
ggtcgacccagctactcaggaggttgagatgggaggatcactggagcctaggaagtcaaggcggcagtgagccactgcactccagcctgggtgacaggaatgagactgtgtctcaaaaataaaaaacaagttacagcttttgctttagaaaacttggaaagtacagaaatatat

SEQ ID NO: 540107 - DNA, 872 bp, Homo sapiens
  misc_feature (246)..(246): n is a, c, g, or t
  misc_feature (253)..(253): n is a, c, g, or t
  misc_feature (771)..(771): n is a, c, g, or t
agcgggtcagacccggcttagccgtccggctataagcctactgcttgagctagtcaaccccggggtcccagggcttctcgggcttggaggtcgtcgcacaccgtgtgaaggacagcggatggcgcgtggcactagtgggattcgtgactgtcgcgtggacgccggatcgctaatgcaagggaattgatagtgatactgccagaagagtggcacttgtgcgcaggattgactcaatagcgatgcacntcacacngtggacggacgactcacacaatgtgacctatcgtatcgtgaccggcgccagtagtaccgatcgacccatgctcaagcttcatcgcactcggtgcaggcatcgatgtactggtcgccttgtactcaggggatgcactctgtgtccagaaagaccaagggatcatgggaggacggcgatccatcatcttgtgtatagtcgctgtcattgtactggatcatgcagttgtggttgagcttgttcaccgcaaagaaggatccattcatctcggaacatcaatccagcctatatggtcgaagtgcgttcttgaggtactcagctgtgtctcgtacttaccgtgtacctggatattcctactacttcctagaatttacgacgctgggttgagaagtctctaatgtagttggctagatccaaactcgttcgaatacgccaacaagggaatgcaagatagtcatggagctatgcatgtgaagccgccactgtgatcacgctggagacgaggacttgctcatgccacntttgatatgagagcattttggacagttgctggggcatgggccattgaaaggctagcatggatccctaagtaccgtctactgctggacgaatcagtattacc

SEQ ID NO: 540108 - DNA, 150 bp, Homo sapiens
accccggtttctgtaaaatccctaaattttcccatctcaaaattatatctgtgcctgggtcatccacctccttcttgggtgtggggaaatgagtatgctttgatagatgctgcctaactcatccctcctgtaccatgacgctgaaaactg

SEQ ID NO: 540109 - DNA, 296 bp, Homo sapiens
ctggcgccccctggcccgctgttacgcaatggaaattacgaaagccccgcccgtcctcctggcccttgggggagtgcggcaggtttggcagactttgttttctttacctatctttgaacaccagcttttcttttatgggtgtctttttttctttttcttttgagttggagtctctgtcacccaagctggagtgcagtggtgtgattatagctcactgcaaccttgaattcctgggctcaagcaatccttccacctcagcctcctaagtagctaagaccataggtgtatgccaacat

SEQ ID NO: 540110 - DNA, 893 bp, Homo sapiens
  misc_feature (3)..(3): n is a, c, g, or t
cgncaacagacagtagagagagcgagcgagagagaaggcggaatgagagggaagcaaccagctctcaacgcgggtacgaagagtgccacaacagggggttaacccaacggcccccgtggggagccattgaacacaggggtccgaactaaacgtctcgcaccaaattaatcttggaagggggttacacccgccacacgacggtgggttggaggcaagcggcctcaagaggccgttaaacccggtgcttatccccggagtggtactctgacagaccggtgctcggaaagacccctttatcacccgcggaagaaaacctttcgtcgagcgctctaaaaaccaagggcggtcccaatacggggagcatctacatccgaggacccttgttgtaggaaacaacttgtcctggcgccaggggttccgggtctgtgccaaagagagaaatttttgcccgccccacgagggaccttggttttaacaccccctcggcccgttacagagtttccttggaaaaatcctcttgtggtcgtgaacacacatcagaacgtagcaacaaactgcccgacgcgactcccatgtgttcgaacccacgcgtaccctgatatgactgcggagtcattgaccctcacctgggcaaccgcgattttccatctacctccaggagttctgagtattagtgaggatctccacaccacgttgggaggttcggaggttaacactagaagactcgggagaaaagctttaccacctcccagcctcgggtgaatcctcccctgcccacctaaagggagacaccttctttgtattaggacaggggagttccccacccattactcggttgacaatcggagggtccgaaaggagaaaaaaatattcttttggcgggaaacaaaaca

SEQ ID NO: 540111 - DNA, 145 bp, Homo sapiens
cagaaagccatgtcggactcggcgcccagagcccaagcgctaacccgatgaaagtttctcagcgaaatcgcagggacgatctggaccccgctgagaggaactgatttagagtgagatggtcccacaggcctggaggagcggactg

SEQ ID NO: 540112 - DNA, 453 bp, Homo sapiens
  misc_feature (140)..(140): n is a, c, g, or t
  misc_feature (194)..(194): n is a, c, g, or t
  misc_feature (258)..(258): n is a, c, g, or t
  misc_feature (296)..(296): n is a, c, g, or t
  misc_feature (314)..(314): n is a, c, g, or t
gtttttttcagttattaattcttgttggtatcggattaagctttttcgtgccctttgcaccgaaatcctggcctgctgctatcgactggcacaccatcatcaccttaagcggcctgatgctgctgaccaaaggtgtgganttaagcggttattttgatgtgctggggcgcaaaatggtgcgccgctttgctacngagcgtcggctggcgatgtttatggtgctggcggcggcgctgctttctacctttctgaccaacnatgtctcgctgtttattgttgttccgctgactatcacnctaaaaagactgtgtganatcccggttaatcggctgattatttttgaagcgctggcagtcaacgctggttcgctactgacccaattggcaaccgcaaaatattcttatctggggacttctggtctttcgttgccggattattgccccaatgcaccct

SEQ ID NO: 540113 - DNA, 163 bp, Homo sapiens
aagggtgagacagaggttgaaaatgacaggtgtctacggaggagccaggcagccacgtgagacccttctattctaagtggcttcttgtccattcctggggattggggaaagaacgacagaacttaccttccatctatccttctcacaagcagtgtattgggtg

SEQ ID NO: 540114 - DNA, 593 bp, Homo sapiens
tcaccacttggtaacagcatctgaaggtttgtagttgctggtttctgtagccccatgagctacctgtgttccctctccatcccagagtgaagagcgaatcaaattcactcttttcctaaacagaggctctgctaggtcctggaataacttcctaacactagatttctggagatgcaggacctaaaagacaaaggtgggataactgaggagaaagatggggtgaactgaatagaaagatgggatgaacagaagtcagacagggagataggcacagctctctgcaaacatccatgtagacagcaacataccccagtcctgccagagaagctccatacatgttgacttgcatttcttttctcatgcttgtctgtcagtattctgcttcttatctttaaaatcaccaaccctagcctcagtcaatgatactgccagtctaagaagtattcaagaagtaaaaaattggcccggcacagtggttcacgcctgtaatcccagcactttgggaggccaaggagggcagttcatgagctcagggatcaagaccatcctggctaacacagtgaaactccatctctatttaaaacacaaaaact

SEQ ID NO: 540115 - DNA, 277 bp, Homo sapiens
cccgtcgtgaatttcatccgcgttaacggcacacttagacaggtgccgattgcccgaagttcggatctggtagacatccagatcttcttttttgctcgagacagatatttctcctgacgccgggagagctcaatgagtatgttctctacacggccggatctgagtgatttggagcaattctgagatttgatcgttggctgctgcggagcaggaagcaaaatattcggacgaagagctgaattgatgatcgaggtgaaactccgcttgacacttgata

SEQ ID NO: 540116 - DNA, 464 bp, Homo sapiens
ctgaggcccccccgggtcattttttggaaactctgggtctgtaggggcgggctgggggagggtccatcactggggggtttaattttggatttcgaacccctccccaggggtaaacgccaggtggtattccggcaaatgaaaaaggcccaatttggggagtgggggggggtgctccatgcccatggggggaggggggtaggggttttgggcccagtccttaaacccatggtgtggccccatggctggcatgggcgggtaggggtaggggtaggccccccaaaaatgttttggggggggctccccatgggaacgctttcctgaggcctttgctttccttttttgcggtttgaggggtttttttgccttttcctcatctttgaaagcttttagctgggcatttgacagggggacctgggcctgcaggttttccctttcccccccaataaagtaccccctttcagcca

SEQ ID NO: 540117 - DNA, 271 bp, Homo sapiens
gtcattatcctggctcattgcaatctggggctcctggtttcaagtgattctggtgtctcagccacctgagtagtcaggattacaggtgcacaccaccacgcatggctaaaaatacaaaaaattagatgggcatggtggcacatgcctgtagtcccagctacatgggagactgaggcaggagaattgcttgaacctgggaggcggaggttgcagtgagccgagatcacgtcattgcacttcagcctgggcaacaagagtgaaactccatctc

SEQ ID NO: 540118 - DNA, 841 bp, Homo sapiens
  misc_feature (325)..(325): n is a, c, g, or t
gcctgggcaggcttctcctgcaccttgggtcctgcttgggctgaggtcacacgagggtcaatcccgtgtgacaatggtcaggtaggtgtgcatccgtgacatagcccagctggcgggggtttgtcatggagcatacctgatggccgtgcgagaagggacaccccagtgcccctgggtcgtgcagcgttgccgtgcctgtatggagggttggtgtcattggcagcctcgatgccccttagggtcagatgagtcgtcggcctgcagtataggggtggtgtcgataggcagcccgaatgatccatcctggggtacgtgcagctcgctntggcatattgctacgggatctgtcattgggaacattccagtgtctgttgcagctaaggtagtgcctactggcccgtgggaggaatgagacctcagcttgctctgggaagtgcatgctcttgatgaaggttggtcttacagggctatccaataggtagttcctattgtcgcgcaccgggaacaagactggtcctgaggggtccacgagattattgcgtaccatccaagatggatggttacgagggagtgtggcgggacgtatacgccaaagagtgagttggaccggtgagccgatgggtatgactatggcttgggtgaatgtaaaacgtgcgggcaaggctgtgggaggaacatatggactagattggtggccatgtggaacgatggcgaaggacatcgccaatggtccattcatcagaagtttcctatgagagcgttggcctcgtgccagagtaggttcgcgcaaaaccttggtacgcctccgaaggctttaattacccatggggatggccgtaac

SEQ ID NO: 540119 - DNA, 492 bp, Homo sapiens
tagttctgagtgtaatgttttatgtaattgacatttttgaagagtccaagccagttgttttgtagagtgacctcagtttgggtttgtctgatgttttctcaagattaattttaggttatgtccttttggcaggactatgccaggagtgatgccaaattctcaatgcatagtatcaggaagcgtgtgctgttgattagtccagatgttcccaaacttggttatttgttggttttctgttgtaaggaagagctatctcttttttcatatatttgcttattcagttgtttttcatgtcattgtggactcttgaatttttactttaatacagtgggatctagccctttgcaatagttatttttacttgattttttaaaaatttattttcagtgtacagtgaaatttctctttgatgtacagatctatgacttttaacacatagatcatgtaattaccacagtcgaattatagaccagttctattacatccccccca

SEQ ID NO: 540120 - DNA, 346 bp, Homo sapiens
taaaaagtaaagtctgtctctgtcacccaggctggattgcagtggtgtgacggctcactgcagcctgcgcctcccaggcgtccagcaattcttgtttctcggcctcccaagtagctgggactataggtgcgtgccatcacatctggctagtttttgtatttttagtaaagacggggtttcaccattttggccagactggtctcgaactcctgacctcaagtgatctgcccgccttggccacccaaagtgctagggttacaggcttgagccattgtgcccagcccaggctctgggaattttgagataaataaaatgcttctatccatttattcaagcacattttggt

SEQ ID NO: 540121 - DNA, 668 bp, Homo sapiens
cgtgttttattgatctgtgctttaagggggggaagataggtacttacgaaacacagattaatggtgcggtatcctccgaggcaattgttatccaataatagctattgaattccagagaacagtgagcatactatgaggagcctctattcgcgatgagttcataaaatatcacgaaggcctagtttgtgacctaggtaacatacattattgacaataaatttctttgacctgatgacctagggctttgaggtcaaggacgggggttcattaccaagattatattctcgttactaatacagaaatttacacacatggattatccttcagctgtcaggaaatgcgcgctttctgttctggtggaggggaacgatactccctttcaggtggtcaaagggaagagcccttgcataaggagcggtgcacgattcctaggggtattaaaaaagggtcacccaaagggggggggaaggcgttaacatgtgggcggggaagcaagctgaactgtgctcataaggcggtttaacaggcccgctggagcaataagccttttttgccttggggaaggaggcgtgggtcttggggggtgcgggggacttgcgggtaaaggccggcccttctcagaaacattggaaaccttttcttttgggggcgagttgtttaatttttgt

SEQ ID NO: 540122 - DNA, 950 bp, Homo sapiens
  misc_feature (31)..(31): n is a, c, g, or t
  misc_feature (61)..(61): n is a, c, g, or t
  misc_feature (64)..(64): n is a, c, g, or t
  misc_feature (127)..(128): n is a, c, g, or t
  misc_feature (130)..(130): n is a, c, g, or t
  misc_feature (152)..(152): n is a, c, g, or t
  misc_feature (160)..(160): n is a, c, g, or t
  misc_feature (200)..(200): n is a, c, g, or t
  misc_feature (215)..(215): n is a, c, g, or t
  misc_feature (223)..(223): n is a, c, g, or t
  misc_feature (230)..(230): n is a, c, g, or t
  misc_feature (251)..(251): n is a, c, g, or t
  misc_feature (276)..(276): n is a, c, g, or t
  misc_feature (290)..(290): n is a, c, g, or t
  misc_feature (292)..(292): n is a, c, g, or t
  misc_feature (302)..(304): n is a, c, g, or t
  misc_feature (357)..(357): n is a, c, g, or t
  misc_feature (380)..(380): n is a, c, g, or t
  misc_feature (387)..(387): n is a, c, g, or t
  misc_feature (390)..(390): n is a, c, g, or t
  misc_feature (448)..(448): n is a, c, g, or t
  misc_feature (455)..(455): n is a, c, g, or t
  misc_feature (475)..(475): n is a, c, g, or t
  misc_feature (478)..(478): n is a, c, g, or t
  misc_feature (484)..(484): n is a, c, g, or t
  misc_feature (522)..(522): n is a, c, g, or t
  misc_feature (527)..(527): n is a, c, g, or t
  misc_feature (604)..(605): n is a, c, g, or t
  misc_feature (816)..(816): n is a, c, g, or t
  misc_feature (949)..(949): n is a, c, g, or t
atgttcctccactcatcttgaggtggtttantggcacacaatgtacatttctggcaacttnttnctccctcaagttcccctggttggtttttactcaactcatattaccaccaactctccctctcgnncnccaaaagtacaactggccagancacaaatngtttacattcttttttgtaagccattgtaagaaaaatggngcatggacacaaaanatgataanaactgcntttccatagaattcttaagtngcaaaagaggtttcattttaatganaaaataagcgtttntngtgggttttnnntttttcttacaaaaaaccttaagatattcagcaagggtcatttatacacagcnaggccccgccgttttcgttttanttgtctnccntttttaataattatatgagactcttcaaaactaggaacaataggtcagcactaaagtnaacctanaggtaatgagctcaatgccnccntttaancacttttaaaaggctctctccaataaggctgccgtccngtgcncctgccagtcttggagtaataaaacatttttactgcacacacctcatgggaaagtgtttatactgagtgtagtctcnngaggggtaaatgaagattatttccacaaattaagattgcacttagtacacgcctttacacaactctgatggtatttaccaaaacatggcatgtcttttcacgtatattcctgaaaacaccaaatagaactcttaacttttaaagaaaaatacagcacatttagttaagacagttgtggtgcagtggaaaattaagtactgagcactgagtnagaactctgctgttattaactagctgttcatatgaagaagaaaactcacctcatcagtctaatgagacaccagaaattttaaaatttcatctagctcaactcagtgatctaatcttatatgggggaatacacnt

SEQ ID NO: 540123 - DNA, 407 bp, Homo sapiens
  misc_feature (270)..(270): n is a, c, g, or t
  misc_feature (273)..(273): n is a, c, g, or t
  misc_feature (360)..(360): n is a, c, g, or t
tgagatgggagtttcactcttgtctcccaggctgcagtgcaatggcgtgatctcggctccctgcaatctccacctcccaggttcaagccattctcctccatcagcctcccaagtagctgggattgcaggcatggccaccatgcctggctaaatttttttgtatttcagtagagacagggtttcgccatgttggtcaggctggtctcaaactcctgacctcaggtgatccacccgcctcagcttcccaaagtgctgggattacaggcgtgnatncgtgcccggccgggtattcaggttcttactttgaggcagattccatctattcaggtcactggtttataacatattaaagtatctggntataaaagttgggggaacagctagggatcaagttttatttggatgga

SEQ ID NO: 540124 - DNA, 1457 bp, Homo sapiens
  misc_feature (216)..(216): n is a, c, g, or t
ggagtgttctgagggaaagcaaggacggcggcggcaggtcggcatatcgagtggcgagtagtgggaaaatgttagcttcgtagaggggagcccaagatgaccaggttctgaacggagttctaagacgtagaaacgcgagacacaccggaggtatggcatctctctctcggtgaatttgcagggctcctaagaacatcccaagtttctcgtggcttntggtcttcgcgtccttgggagactagcagtacctagtagcatgtctcataacggattggtagctcaggtgcgcggaaaatctcaattgcagtgcatcagaaagtaccgcaggcgatcaccacgtgcgagccttgtcgccttggaatatggctagctcttttcttacacgacttctccaagcaagcattagctcttgagtaaaggaattgttgaagaggaacatatggacgtcgacatccaccacttttgtaacaacagctgtgcacttgagcttgatgaacaccgcatggcacgtccaaagggacatacaccaatcgctgtgcttgtgtgaagaacaccacaagtgggaattggcccacctttacttccaagccagtggtttgcatatggcaaagatatacgatggtttgccgagcgaaccgattggaaactgcgttgaattgggttccgacattgggtaaaggatttgggcgggacattcaaagggacccaagatgtcaaaacacggtgcgttgtgcggaatacgcccaaaggtatactcgtgtcacttattaggttatactcggtcatagggggggaaactcgttcacagtcattactaatagagcctttgagagacatcacagtggtaaattcatttagcaaccctttcccattcagggtgaatcatggagtaaggcactacaggtgggcatggaagtatatcggtggacgagaaaaatatacggacagaggggactccgtaggaaaggaaagatggattatagcgtggtgactgaggaagaacaatatttagcagtgaaaaaggaattggaggggattttcagccggttggaccaatgggctaagtacggcggatggggggaacaggatgccgcattcgatcaccacgggaacgagatttatgtccgtaggaaaagcagtcagggcgtagaacgaatttagcacgaaaggcggcggtttaattcaccagggaagacattaaggggcaaggaggagggaataacggttggctataattatgcaaagaaggcgattcacgattacgttagagcaacattgcgaccttgtggacaggacagtgggcaaaatgtgtgaaagggcatagaggttaaggggcgacacacacaaggagaaagggatcatattgaagagagagatataaatgatataacggcaacagagaagataattgggtcgatatcaggaagtgttagttaacaatatgaaatggttacaaa

SEQ ID NO: 540125 - DNA, 488 bp, Homo sapiens
  misc_feature (108)..(108): n is a, c, g, or t
  misc_feature (199)..(199): n is a, c, g, or t
  misc_feature (425)..(425): n is a, c, g, or t
  misc_feature (435)..(435): n is a, c, g, or t
aattgcttgaggccgggagtttgagaccagcctgagaaatataatgagaccctgtctctacaaaaaatttaaaaacaagttagctgggcatggtggcacgtctctgtngtcccagccacttgagagactgagttgggaggatcgcttgagcccaagaggtccaggctgtagtgagctatgatggtgtcactgcactccngcctgggcaacaacgagaccccatcttaaaaaacaaataatgtatgtgagggtgtgtgtatgtgtcaaacactacttcattatggcttctacataaatgtcctatcatatcctatctgtggaattccacagttgtagtggtagaagtcattcttttgctttacttctttctggctctttcatttcacaaatatttgggcaagtggtctattttaaacctcccaggnactggttctnaggcatttgggaaagagccaaaaggaaattcaaggaaggatccggatcctttg

SEQ ID NO: 540126 - DNA, 125 bp, Homo sapiens
ggcggggggggtttttttcccccgggacccctttccttggtcccccccccccccgtcccccccgtttcccattttggggcccgggggttttcagggggtttcccttaggggttttttgggcccca

SEQ ID NO: 540127 - DNA, 104 bp, Homo sapiens
tagcggatcgccaaaaaaaaatgtgaagccgactgtcctcagaatctaacctgtagataactatagatgaaactcacattgtcgttcctttcgtgtacacattt

SEQ ID NO: 540128 - DNA, 173 bp, Homo sapiens
tatcctgctactgtaaaaactgaaataaagcagtatcatctgtgaccaattgcaggctccatgtctagaccagcaaaggaggtgctctctaaggcaaggggtcccccgccatgtgatgcaacaggtctacggcagggggttctcctatccctacaatgcacggagagcagacc

SEQ ID NO: 540129 - DNA, 273 bp, Homo sapiens
acactcaccggtcaggtactcaaaaatcaaaggtagataagcccacaaagatgagaaacgatcaatgcaaaaatgctacaacctcaaaaaaagccagagagtctgttctcttccaaatgaccgttaacacttctccagcaagaacacagaactaggttgaggctgagatggctgaaatgacagaagtaggcttcagaaggtgggtggtaatgaacttcactaagctaaaggagcatgttgtaacctgatatggtttgagtgtgattctggccg

SEQ ID NO: 540130 - DNA, 216 bp, Homo sapiens
accgtgccaaataggaagaggtagccttggttgtagccaaatggatctttttaacagtgtgcctttggggagggacccatgtccatggcttcgttgagggccatccatatgccagctgggggccagcccacagtggccatgttggctgcagctggaatggtgcccacctcggcgaattgaagggctaagagtcccagatagctaggccagagctgg

SEQ ID NO: 540131 - DNA, 875 bp, Homo sapiens
gcaggctcactgcatcaccaaatgggagaaaattttgcaatctatccatctgacaaatggctaatatccagaatctacaaggaacttaaacaaatttacaagaaaaaaacaaacaaccccatcaaaaagtgggcaaaggatatgaacagacacttctcaaaagaagacatttatgtggccaacaaacatatgaaaaaatgctcatcatcactggtcattagagaaatgcaaatcaaaaccacaatgagataccgtctcacaccagttagaatggcgatcattaaaaagtcaggaaacagcagatgttggagaggatgtggacaaattagaatgcttttacactgttggtgggagtgtaaattagttcaaccactgtggaagactctggtgattcctcaaggatctagaaccagaaataccatttgacccagcaatcccattactgggtatatacccaaagggttataaatcattctactataaggacacatgcacacatatgtttattgcagcaccgttcacaatagcaaagacttggaaccaaccacatgcccatcaatgatagactggataaagaaaatgtggcatatatacactgtggaatactatacagcgataaaaaaggatgagttcatgtcctttgtgcagggacatggatgaagctggaaactatcattctcagcaataatacaggaacagaaaacaaaaatggatgtgctcactcataagtgggagttgacatgagacacatggacaaggggggcacatcaatactgggtgtgagtgggggaggagggaggttggtcgggaaaatatggctgaggtggggggggacccgggttgttcttttaaaggtttggatttcggaattaaaa

SEQ ID NO: 540132 - DNA, 291 bp, Homo sapiens
gtcccagcagaactccccagctgactgcgaagctctgcttgtatgcggcacagtccgatagaagtcacagagacatacatcctcgctggaaacggtccagccacctccgtccgtgtccatgtcacagagcacagtcaggcgccggcagtcgggcaggtagatggtgtgccagacgctcaggaaatacccccggtctagcaggttattgcagttgcgtgggcctgtagcacacgactgagactgaccagcgtctcctttctctccacgcatccccttctctcctcggtctcc

SEQ ID NO: 540133 - DNA, 237 bp, Homo sapiens
ccaacataaatagaagagtatctgaggcatgggggtcaggtgtgaggtcttggtgagtgtttaagtggggttagcgatggaggtaggattggtgctgtgggcgaaagagtatgatggggtggtgattgtgattaattaaggagggacataaatagtgtacgaaagtggaagaaagggtataaggatagatgtgagagtagattctagatgctgggattggggctggagctgggcgtg

SEQ ID NO: 540134 - DNA, 850 bp, Homo sapiens
gcgtggtggctcacacctgtaatcccagcaatttgggaggccaaggcgggcggatcaccaggtcaggagatcgagaccatactggctaacacagcgaaaccccgtctctattaaaaatacaaaaaaaaaaattagccaggcgtggtggcaggcgcctgtagtcccagtctactctggaggctagggccagagaatggcgtgaacccggaaggcagagcttgcagtgagccgagatgacactactgtactctagcctgggccacagagtgagactctgtctcaaaacaaataatcaaaataattaacaaataaaagagaaacagacaagaaattttcttgtggccaagcactgtggctcacgcctgtaatcccagcactttgggaggccgaggcagggagaacgcttgagcccaggagttggagaccagtccaggcaacatggcaaaactccgtactctactacaaaatacaaaacattagccaggtgtgatggtgcacacactgtagtaccaggatacttaggaggacgatgcatgagaatcccttgaactcggtgagatggaggcctgaagtcggctgacatagcaccactggtaccccagaattgggtcacagagcaagactctgttctcaacagaaacaaacgggaaacaaacagagcccaacacaggacagcacacacccaaagcaacgccagacaaaagcaagcagaaacgctagcaaccaaaccaacccacgccacgaccgaacagtcacaaacgacaatctgcgtgtagacccaaaccgggagacccactgtgagacggggcatggaacaaccttaactttgtgagactcttcacaggaccac

SEQ ID NO: 540135 - DNA, 266 bp, Homo sapiens
ctaatgtagaatggctggcctcctcagctatgtcatcctcgatgagcagttcatccgtccacacatctgcacagctccactctgagaagcccagtgcggtcagcgtatggagaacgtcgcaagacccctgcccaccgcagcagtgtacacaccgactgtgcctcgcttctgaagtcgcagacgcttaaacacctacggagaacttctcaatgattgcccaaggttgggcagcttgatatgcacacctgcccgaagaccggtgccca

SEQ ID NO: 540136 - DNA, 358 bp, Homo sapiens
  misc_feature (210)..(210): n is a, c, g, or t
tgctcgcggcggacacggattcgagatcatcctctcgaaggtggagctgccggaggtcaccggcgcacagctgtacgagacggagaagcgcaagtgtccgcacctggcgtcccagatgatcttcgtgagctcccacggctccgcgccggaggtccgcccgctgctccgcaagccgatcaaccgcgactcgctgctgcgaacgatcgggantatgagcaagcgaatcgcggaagtgcaccagaagtagcgcttttgggctagaagctggtctccgtgaggcagctccataccgccgagatcggcaagctcgttgaagcgttctcgcccggcgcaacgtggtccgagatcgccaccccgg

SEQ ID NO: 540137 - DNA, 449 bp, Homo sapiens
ctcttcctcctgctccagccatataggatgtgcctgcttccccttcaccttccactacgactgtaagtttcctcaggcctcccaagccatgcttcctgaacaggctgtggaaccatgagccaattaagcctcttttcttcataaattacccagtctcagatagtttttttagcaatgtaagaacaaactaatacagtgtgtgagaaggttcactgtctcctatggggctggaatggcagaggtctcatgaagcttattgttccccagtagtgtgcactttctaaatttttttccccagtattttattcaccaggttgaacagttcagggtttatgccagtaggaggtgcccatgggtaaaaactggccgcagcaaagacaggtgggtaaatgcaatactgcaatggtgggcagaggtcccagccttgacagaagtggctgtggaagctc

SEQ ID NO: 540138 - DNA, 1003 bp, Homo sapiens
ctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagaccacgctcctctgccttctcctggcctgggacacacagagccaccccggccttcctggtatcgccagccttaaggtgtctggagcccccacacttggccaacctgaccttggaagatgctgctgagtgtctcaagcagcactgacagcagctgggcctgcctcagggcaacgtgggggcggagactcagctggacagcccctgcctgtcactctggagctgggctgctgctgcctcaggaccccctctccgaccccggacagagctgatgtgccagggccaggagggcgggagggagggaatgggggtgggctgtcgcagcatcagcgcctgggcaggtcgcagagctgcgggatgtgattaaagtccctgatggttttcacacaaaaaaa

SEQ ID NO: 540139 - DNA, 496 bp, Homo sapiens
tcacacactaatcattagggaaatacaaatcaaaagcacaatgagatacacattgcacccatttctattaagaaaaaaagaagaaggaagtaatgctagcaaaatggccaaaaaaaaacccctactgcttgtccccctcacaaagacaggcagaacaatgaataaacaactacattttaaattttaatttaatttaattttatgtatttttttgagatagagtcttgctcggttgcccaggctggagtacaatggcgtgatctaagttcactgcaacctccacctcctgggttcaagcgattctcctgcctcagcctcccgagtagctgggattacaggcgcttgtcaccacaccctgctaatttgagtatttatagtagagacagggttttaccatgttggtcaggctggtcttgaactcctgacctcgtgatccacctgcctcggcctcccaaattactgggattacaggcgtgagccattgcacctggcccaa

SEQ ID NO: 540140 - DNA, 184 bp, Homo sapiens
tgtcgacaaagagacctagaatcgctcattgcatagtcttcaatcagccacatagccctcgtagtagagacattctcatccaaaccccctaaagcttcaccgtgcgcagtcaattctacctaatcaacccacggacctgagtacctgagactcgacattcgtaactccatgatcatagcatatt

SEQ ID NO: 540141 - DNA, 1093 bp, Homo sapiens
  misc_feature (736)..(736): n is a, c, g, or t
  misc_feature (745)..(745): n is a, c, g, or t
ctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaaacaggacacgagcatgagaccacgctcctctgccttctcctggcctgggacacacagagccaccccggccttgtgagtgacccagagaagggaggcctcgggagaaggggtgctcgtaagccaacacagcgtgccgcggctgnacaccctgntgacatccagcctggtatcgccagccttaaggtgtctggagcccccacacttggccaacctgaccttggaagatgctgctgagtgtctcaagcagcactgacagcagctgggcctgcctcagggcaacgtgggggcggagactcagctggacagcccctgcctgtcactctggagctgggctgctgctgcctcaggaccccctctccgaccccggacagagctgatgtgccagggccaggagggcgggagggagggaatgggggtgggctgtcgcagcatcagcgcctgggcaggtcgcagagctgcgggatgtgattaaagtccctgatggttttcacacaaaaaaa

SEQ ID NO: 540142 - DNA, 931 bp, Homo sapiens
ctgaagggtgtggcgcgagcagcgtcgttggttggccggcggcgggccgggacgggcatggccctgctgctgtgcctggtgtgcctgacggcggcgctggcccacggctgtctgcactgccacagcaacttctccaagaagttctccttctaccgccaccatgtgaacttcaagtcctggtgggtgggcgacatccccgtgtcaggggcgctgctcaccgactggagcgacgacacgatgaaggagctgcacctggccatccccgccaagatcacccgggagaagctggaccaagtggcgacagcagtgtaccagatgatggatcagctgtaccaggggaagatgtacttccccgggtatttccccaacgagctgcgaaacatcttccgggagcaggtgcacctcatccagaacgccatcatcgaaagccgcatcgactgtcagcaccgctgtggcatcttccagtacgagaccatctcctgcaacaactgcacagactcgcacgtcgcctgctttggctataactgcgagtcctcggcgcagtggaagtcagctgtccagggcctcctgaactacataaataactggcacaacctggtatcgccagccttaaggtgtctggagcccccacacttggccaacctgaccttggaagatgctgctgagtgtctcaagcagcactgacagcagctgggcctgcctcagggcaacgtgggggcggagactcagctggacagcccctgcctgtcactctggagctgggctgctgctgcctcaggaccccctctccgaccccggacagagctgatgtgccagggccaggagggcgggagggagggaatgggggtgggctgtcgcagcatcagcgcctgggcaggtcgcagagctgcgggatgtgattaaagtccctgatggttttcacacaaaaaaa

SEQ ID NO: 540143 - DNA, 329 bp, Homo sapiens
ttttaaaaaaaaaaatttttaaaaaaccctaaaaaaatatttttaaattcttttaaaaaaaaaaaaatttttaaagccccctttttggggggatggcccccccatggggaaagaagggtttttaaaaaaggcccaatccgcccccccggttttcccccagaaaaaacccccttttttggggggtttttttttttttttttttgattttgcccggggggggggggccccccctggccagggccccccggggggggggccaaagctttttaaattggggtgaattggagggtttttcccttttgaaaaaaaaaccggggaaaatgtttcca

SEQ ID NO: 540144 - DNA, 398 bp, Homo sapiens
aatttttattatgcagtttgttggccatgggtaatcctccctttttacaaagaaaaaagtttccagcagaaagaatcagaggcttttattttggactcccaggggttttttttccctttttccccttccaggaaaacaactgttagttttgtgggtttctggtgctccccccagggtttgcagacttttgacctggtgagtttattaacactcaagaacctcaggagggctgccagcttgaccctggggaatccagccagtccagcccactttttcatcctgttctgttcaatgcggggggcctgcagaactttttaaaaatgttatgatttaggttcaaaggtaaaatgcctttcccctttccccaagttgggatatatcctccccccaattaagga

SEQ ID NO: 540145 - DNA, 231 bp, Homo sapiens
gtcgacaacctatcctacagagttatgagatgagatgacagaactgtgtgttcctgtgtttactgagtgctgacagtccatccatccacctagaggacttgtgtgtttactgagtgctgacagtccatccatccacctagaggactgtgtgtttactgagtgctgacagtccatccatccacctagaggactgtgtgtttactgagtgctgacagtccatccatcgtcgac

SEQ ID NO: 540146 - DNA, 245 bp, Homo sapiens
cttacactgggttcgagttcgagacagcctgagcaggtggcaaaaaccctggctctctaaaaaaaatacaaaaatggccgggcgcagtggctcactcctgtaatcccagacagtttgtggaggccgaggcaggtggatcacctggaggtcagggagtttgatgagcagcctggccaaccgtggtgaaagccgtgtctccacgtaaataatacaacaacttagcccgggcgtggtggcgggatgcc

SEQ ID NO: 540147 - DNA, 134 bp, Homo sapiens
cagccggacctagagccgtgtgagaatcgctgcagccgaggatgctacgttgctgtgagctgagactcgcaccactgcactccagcttgggcacagagagagacactgtctttaaaaaaacaaaccaatacaga

SEQ ID NO: 540148 - DNA, 1555 bp, Homo sapiens
  misc_feature (1549)..(1549): n is a, c, g, or t
tataggctaggtataggctccgtgtttaatcggcgagggtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggtggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtggttcccttgctctctgagcccattaaataaagaggttgtcttggcgtaaaaaaaanacaaaa

SEQ ID NO: 540149 - DNA, 1245 bp, Homo sapiens
  misc_feature (580)..(580): n is a, c, g, or t
  misc_feature (1245)..(1245): n is a, c, g, or t
gctcaaaatacaaagttagctggatgtggtggcacatgcctgtaatcccagctactcgggaggctgaggcaggagaatcgcttgaacctgggaggcagaggttgcgatgagcctgagatgcaccattgcactcccagcctgggctgaactaacagtcggaaactccaatctcgaaaaaaaaaaaaaagaaaaaaggggtgacgaggggaggtcttcaccaaagggcttttccggaaacagcagagagttgtgaaaccggggcagttccattgcacgagtttttggaaacaggtgtttttcacattataagttcgtcggataaaatttataggcgaagagaagaaatcttacaaaggttaaaaccctatagaatttctccatagcaatggggcttggggggcaactgtgggtaagaatgtggggggctccgagtgttgcccccgatattgagccaaccaaatgtgtggtctgtgaaaggttgtgaagtgtggaattgtggcaaaatttttctggtggcagagaacggggacgtgtgggtgttcaccacctgtgggtgagtggcctatactactcaataagnttgtcgggctctccacaaattccctcccaaaagtatgtacccctgtgtggtgttcttcttatgataagtagcccaaggggtaacggcatcctatggggggaccccttgtgacaagggggtgtgctcaataagtttgtggactggggaatatgtggccatttaacaggctactactcaaatatagttggcgcgcggggggaacctgggggcttcaccgtggcgaaggggggggtcgccaattggcccacggacagtgcatggggttctggccagggtgaacgcacccacaaaaaagggggcaaaggaacggcattgcgaaacaacaccttgcggggtgcgaaatcgtgacaacagacaacagcaacagcctcatagacgtagttgcccttgtgggacacctgtggaaaaccgaggaagcccaggcgtgggagcgctccagaggcgcggaaaacgaacccggctggtcgtagaagccaacacagaggtaggagcccccgtgggagaacacagtacacttggagcgaaaatagtgaggggtggcacacgccacggggtgggactactcgagccccggcggacctggatggagcgggcggagaaacaatttccacaggtccgggggcacctgtgcccggcggaaacaattggcgtccgggaagaaactn

SEQ ID NO: 540150 - DNA, 741 bp, Homo sapiens
aaatgacagttgagggatacaaaacccaccccattcccggacgcgtgggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggacaccagaaagggatcgcacgaacgacatgtaactactgacaaccggacccgcttgtagctaaactgctttgtatgaagtactgaccatgcagaccatgagcatgctatgtaccatcagactcagaacatacagcgtgccaccatagtcgacaccaactgatactacacagacgttaagcaaaacatgaacggcacataaccacacataagacgataatgcctctaaaaagagtgaagcacaatacatgccacagggacatggaagacaagtagcaccacaaggcggcacttattgagtgttgacgagatcatatgtatactaactgattgcctccaagcgcaacgaataacaacagaccaacaacatataaccaaccgacgcagaccaagctcgacaaacgaaagaccgaaacaaacgctacactaaagagattcaacaacagaagatcacctggataagatacaaaactatacaccaagacataactcgcatgatcaacacaaacatgaaaaaaaaacacgatgacaaatcctcaagagacaagataggagaaaaacatgaacaaaccgcatccccacgaaca

SEQ ID NO: 540151 - DNA, 1646 bp, Homo sapiens
  misc_feature (32)..(32): n is a, c, g, or t
  misc_feature (61)..(61): n is a, c, g, or t
  misc_feature (1640)..(1640): n is a, c, g, or t
tggcacagccccccgtgacacctcgagtcctnacactcggtgagccttttgcctgcctgcntggagccagagcctggggcccacaggctgggagccacccccaccactggcgggcgacaagccccacaagtgccctgagtgtggcaagggcttccgccgaagctctgacctggtgaaacaccatcgtgtgcacacaggggagaaaccctacctctgtcctgaatgcggcaagggttttgctgacagctcagcccgagtcaagcacctccgcacccaccgtggtgaacgggcccggccaccaccaccatccactctgctgcggccacataacccacctggcccagtacccatggcccctcgaccccgagttcgggcccagccttctggacccagccagccccacgtgtgtggcttctgtgggaaggagttcccccggagctcagatctggtcaaacacaggcgtacacacacgggggagaagccatacaagtgtgcagagtgtggcaagggttttggtgacagttctgcccgcatcaagcaccagcgtgggcacctggtcctgacgccctttgggataggggatggtagggcaaggcccctcaagcaggaggcagcaacaggactggaatgacgcggtccagggagggtggaggcccaggagaccaaagggaggggctctgccgcttagcagagaagaaagggcctgggaggtggtgggagggagaaggaagggaagaaaggggaggaagaatagatagaaatagggattggagacagtaaccttgaagctcaggaaactgtcctggctgggctgagtcaggaccttgccaggacgggctgtacccctggcttctagaagactgcctagcacacagtaggcattcaatacttgttgaataaataaactggctttcacctaaggactcaaccctaaattcctgctgcctcatctgttaagaactgacactttccccttgctgggcaggtagtacacacctgtaatcccagcagtttgggaggctgaggtgggagaatcacttgagcccaaaagtttgaggctgcagtgagctgattgcaccactgatgcctcccaaccttgctctgggagaccaatgcctgaaccagggtttgtttaccttctgagctgcagagatggggcttctggaatttaaggtaacaggatgaggcaggggtatcttgatcatccggatggggcaaatactgctgtgtggcatggtggtacccacccctatggaggggcactcttggacagagcccagacctttgtgccctggagggagccaacccaccctgacacggagacactggcagaatagaccagagacagaaggtgctctcatggtatccagcctggatgccaagcccaagtcctggtggatagcagaggccagctgtttgggaaaagggcaggatgctctgaggcctggcagccacatttccatgtgtctttttaccaataaacggcttctcttctgaggcttggacagtgtgtgtgtacacacaggcatgaaaaaggtggagaggggtctctgcgcgcaaaactcagactgtaaattttgtgtggttcccttgctctctgagcccattaaataaagaggttgtcttggcgtaaaaaaaanacaaaa

SEQ ID NO: 540152 - DNA, 301 bp, Homo sapiens
  misc_feature (42)..(42): n is a, c, g, or t
gcacgaggtttgttacagaagattttaagggccgggcacagnggtttattcctttaatcccaatactgtgtaatctcgaggcaggaggtttacttgagtccaggagttttatacctacctaggcaacatggtgaaaccttgtctctaccaatatttaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaa

SEQ ID NO: 540153 - DNA, 450 bp, Homo sapiens
tccagcgtactagtttccattggaataatctaacccgcgtgtcctttcccctttctggggcacaagccactgcgggccatgtacccaaataaacctcttaatgcgtatgttaaaattagttggacatctgagtttccctctgaagaaatggaaaaagtgtcgggtgtcccatcccgacctcccccatccccgaccggaccataaagtccctacataagagggcgtgtcatgctgcctccggactctggcaacatcacatatacgcacacaaacacggaccatcaccgcacgctcacatggaataagaagctgaaacggaacgaacaagcagaagaccaaaacaacaaccaacacaggacgacacctcccacaagcaacgaagacaagccacccaagaagtcaacagcaaaacacagagcacaatgaagcccgagaaagaagacagacaaa

SEQ ID NO: 540154 - DNA, 162 bp, Homo sapiens
gcggagtgatgtaaaatgtaagtgtagatgaaattactaatcttttcagaagtgattaaaagtggaaaaaaaaggaggccaaccaagcaccacagggaaaattgggtggagaccattccagtttcaaactagaacctagtgaagatatattccctagcctca

SEQ ID NO: 540155 - DNA, 331 bp, Homo sapiens
gtagcctaacccaatggatagctgtcgtgggggtaatttgtcagcgaccacctgtgcaactgcggtactttgcgtgccattaccaataccttgaaacgcacgcagtaaaatcaaaacaagtaatgattgactaaaaatcagtaagccgaaatcgaccactaaaacgagcaacccaatcacgattaatggcttgcgcccaaagcgatcatcattttacccacaggcacacgcgctactagggctgctaacccccaatcccattcaccaggcccgcatcatcgctttgccacctatttgtgtcctatattggtacgtccccttttgtgcggtc

SEQ ID NO: 540156 - DNA, 419 bp, Homo sapiens
ccgagaccacctctataggacagcctactcaaaggactgcgcatcggtgagtcttgcctggcgatatatcggaacatggctctgaaacacactacagaagtaacacttactcagtagaaatggatgcacaacccgaatatctcactgagaggcctgacagtgactacaggcgtgtagtactacgctcattggcaagggtctctatataggtatgagtcatggcctggagaaagaacctgacatgaatgcactacggatgtggacagatttcaacgaagcatacacgagcaagacgaaagagtcagcactacaggagcattgaacacgctaactgaatgatgacggtctgagcgtatcagcggtacacttgcgctactgctacgctgattagtgctcacagacgaagtatcatggtgcct

SEQ ID NO: 540157 - DNA, 400 bp, Homo sapiens
  misc_feature (400)..(400): n is a, c, g, or t
ttcatacatggcggctccactagggggtgtggtttctggtcagccacccgggcccgctcagggctcgccgggtcttgcgggccaagcttcggtcgttcaggcaggtccaggcgcttctagaccttccagcagtactttggtggacgagttggaggcatgtttcgaggcttgctgtgcatctctggtgagtcaggactatgtgaatggcaccgctcaggacgttcggaccggtaagcattgcgtctgtgtacacaatggtctgggcttccgctgtctgtgctagctgctagtcatctgcttcatgtgtttcagtgctgctttgatcctatgacgacatctccgggactataatgtgggcacataagctctatgagctgctgattgctggttgagtactgtn

SEQ ID NO: 540158 - DNA, 319 bp, Homo sapiens
  misc_feature (39)..(39): n is a, c, g, or t
  misc_feature (51)..(51): n is a, c, g, or t
  misc_feature (270)..(270): n is a, c, g, or t
ttgtggccgccgtacttggagatcatgaagaggagaccngtcttcaatcanttggttgagcagatcgagagcgagctgccgggggcggtttgaggcgggcgaggtgtgggtgctggagcgcgctcgtggctccgcaacctggggcaggccgagaagatcacggtgctaggatcgcgtgccatcactcgtaggcgcgatcctgcttcgttggcggtacttcgactacatcaccacgccggatcagctcatccagatccaccgccgaagcgnccaggcatcctgtgcatgaatcccacttgtccttgtactcgcgtgccag

SEQ ID NO: 540159 - DNA, 101 bp, Homo sapiens
accacacacgacaagtatcttttcttccagtgtctcagcctcgccactctgtccaacacacacaacaagtatctttttttccagtgtctcaaacttgtctt

SEQ ID NO: 540160 - DNA, 470 bp, Homo sapiens
aacgatacagagcgggattcagtggcctagacggggaaggagcgtacgaggatgcgggacgagtccagatgagctggcttcttgggagcacagaagtgctcacctgtacttgacaataccacggatcacggggtgcccgtcgatgtatctttcagcacaatactgaacatcttagctgttcatgagggatcgctatctggcgaggatggggccgtggagcttccatcggcttggggaaccgcccagctatagttactccagatattcggcgtgcacgggcttgtggcactggagaaccttgatggcatcttcgactttgaaccactctcgcttcctcccaatgctaaccgaatcttcccaatcctccagcagctccgtgacagtcagtacatacacgtacgttttgtgcttgcgatcctggttctgttcgaagacgcccaggagccggcctaacttccccttgactcccg

SEQ ID NO: 540161 - DNA, 985 bp, Homo sapiens
  misc_feature (234)..(234): n is a, c, g, or t
  misc_feature (488)..(488): n is a, c, g, or t
  misc_feature (508)..(508): n is a, c, g, or t
  misc_feature (542)..(542): n is a, c, g, or t
gcaccaccacacagaggcggggcttgtgagaaccccccggcgttcacacagggaggcgtacaattcttgcgctcgcacacaaaaaagacgaaagtgcggcaaagagggaacggcgggtcgggtgttgtccgcggccccggttggttgccccaaagcaaactgcacccgcaagcagtgtggtgaaacccggtggtggcctggtcgtcggtcccacggccagaagtcgcccacgtnctctcccgagtcgcctgagaaactcccgcagtcgatggaaactctggggcacaatcatgcagaagatacagaccgaactcgccgcatcatggggaatggtccgcacacaccacctgcagcagggtgcacacaccggggaccctcccacaacgtagccctgtaggattgagcacatgcgagatcccgctaacaaaaaggcaggtcacgaaggtgcgtggccgctccaaggtacacaggcagctagctccctcaantgtgtgcccagcagatgctnggtgaagcaccgctcaactcgctctctggcgagngcaagtattgttaggacgagcgtgcccgacacgaagcgcacccgctgtgcaggggtgaagttccacaatagcacaccaccagctcggcgtcctccacaaaaataaacagacgcggcctgtttcctgcccccacaagaaacaggtgggtaagatgggccccaccggcagagacaaaccacgaaaggtgagcccccgcgcacaacaacatgccaaatcatggacggaaaagcaccacgtgggcggcaggcgtggtgccccccggcatcacacccacaaccgccatgatgccacacaagacatccgtacaagatatatttccccgggaaaataaaggggcaagaaaagtttgacacccgacacccgaccggagcgggaaagacgatcatacaatgaaaagacgcccggaggaatttccacaaaaaaaaaaaatcgcccaaaaaaca

SEQ ID NO: 540162 - DNA, 125 bp, Homo sapiens
gacatgcgcgtacgcatacatacgtatgcgtgcgcatgtacacatatatgcatatgtgtactgcgcacgagtacgctgctatatatacactatgttctgtacaagcgttcgttctactaggccag

SEQ ID NO: 540163 - DNA, 288 bp, Homo sapiens
taacacataggcaattgcgggattaattttacggtgagaaacagaccacaggtaattgatatcctcagcaccccactcatcatttctagcaaacttagccagattttcaaaattactgacatttcggcccgtctcaatatctccaaataaataattattttggcagaataccccttcgatcaatgcgaacacatcgagaagggaatttttataatacagatgacttttgaattaaattggcattaaaaccatattttgataaatctccatacttttcacagcatagag

SEQ ID NO: 540164 - DNA, 967 bp, Homo sapiens
  misc_feature (7)..(7): n is a, c, g, or t
  misc_feature (148)..(148): n is a, c, g, or t
  misc_feature (200)..(200): n is a, c, g, or t
  misc_feature (207)..(207): n is a, c, g, or t
  misc_feature (268)..(268): n is a, c, g, or t
  misc_feature (301)..(301): n is a, c, g, or t
  misc_feature (357)..(357): n is a, c, g, or t
  misc_feature (421)..(421): n is a, c, g, or t
  misc_feature (430)..(430): n is a, c, g, or t
  misc_feature (444)..(444): n is a, c, g, or t
  misc_feature (459)..(459): n is a, c, g, or t
  misc_feature (486)..(486): n is a, c, g, or t
  misc_feature (492)..(492): n is a, c, g, or t
  misc_feature (500)..(500): n is a, c, g, or t
  misc_feature (518)..(518): n is a, c, g, or t
  misc_feature (570)..(570): n is a, c, g, or t
  misc_feature (598)..(598): n is a, c, g, or t
  misc_feature (601)..(601): n is a, c, g, or t
  misc_feature (605)..(605): n is a, c, g, or t
  misc_feature (621)..(621): n is a, c, g, or t
  misc_feature (631)..(631): n is a, c, g, or t
  misc_feature (643)..(643): n is a, c, g, or t
  misc_feature (649)..(650): n is a, c, g, or t
  misc_feature (654)..(654): n is a, c, g, or t
  misc_feature (659)..(659): n is a, c, g, or t
  misc_feature (663)..(664): n is a, c, g, or t
  misc_feature (682)..(682): n is a, c, g, or t
  misc_feature (693)..(693): n is a, c, g, or t
  misc_feature (719)..(719): n is a, c, g, or t
  misc_feature (730)..(730): n is a, c, g, or t
  misc_feature (746)..(746): n is a, c, g, or t
  misc_feature (757)..(757): n is a, c, g, or t
  misc_feature (770)..(771): n is a, c, g, or t
  misc_feature (783)..(783): n is a, c, g, or t
  misc_feature (789)..(789): n is a, c, g, or t
  misc_feature (804)..(805): n is a, c, g, or t
  misc_feature (812)..(812): n is a, c, g, or t
  misc_feature (819)..(820): n is a, c, g, or t
  misc_feature (830)..(830): n is a, c, g, or t
  misc_feature (832)..(832): n is a, c, g, or t
  misc_feature (871)..(871): n is a, c, g, or t
  misc_feature (899)..(899): n is a, c, g, or t
  misc_feature (947)..(947): n is a, c, g, or t
ccggganggacccggcaccctcccctgaacttcctggctactcatttccagcgaatttaatcttattttttataattcgtttcagtttttcaaggaaatggaggagctgttttttcccacgggagcgggcgggccttgggaggtgtgncgggcccaagaaggttccggccgcgatgccgtcagcgccttcggcagaatgnatgaagncgagattttcttctcagaagtgagatgccacgatttcgagggaccagggagggcgggcggngccgcggggccacagcccagccccgcgccccgnaccgcgtcacaaccaaagccccgccggggtgcgcgctgcagaggggacacgccgcntataactgggcaccgcggtcggtcggccgcgtggcgggcggcagggaagaggtggggtccgggnagagcctangggacccgggagtncacccgcggaggccngcccccggttggttgccgtgggggggncggcancggggcancggcccggcgccgcctcnaaaacctccctcggtggcacgtctggcgcgccggtaggtcccacccaagctntgcctgcccccgttgaaagaacatcgcntgntacntttgagcaaccttccntcggggccgnccagaggtgggngggttnntggnttctncgtnnggccggacggcggaatcnatctgccttgngccctcgctttccacgcggttggttnctcggttccangaggggtcccatggtngactcctcccnaactccctccggnngggttcaagaanggccgntccgtgggtgtgtgnnatccaanagaaacnncctccaaaantncctttttttttctgctcttttttcacccgagtttgtttngtgcaaatgttccctgggcccctcgctnggtttctccccacggtggccccacggggggagggggaggatggaactncggggcaacagaagagctgg

SEQ ID NO: 540165 - DNA, 624 bp, Homo sapiens
tgtggagtagatggaaactccgcactatctgtgcagctgtaaatcagacttttctaaaaaatagtcaatttaaaaaaagctcacacagggcatcagcaatgtgttgcttctaaatgtcacaggaaaccgttaaacatacaacaggcatctcaatttatttacaactatttttcaacaggcaggcaagaactccactgggactcagaagtgcatcatataccacaccacttgccacttaattaactcgtagcattccagtatattagtcagactgacccaggtcagatggtcaacagttgacaaatatcaggtagacacttggcacaatattacgcagcatatggcagtaggacagctcgcgataaggcatgacccttcactatgcaaccctactcagagagttagacattgatcactcaaggaataatgacttgaaggccagtgcagtgagtgggtacacaaccatgtaatacctagacacatttgaggagcactaggtgagatcagcctgtagccccagcgagctttcgacgaccagacctagaggcaaccatatggagaaaccctagatctcatacataaagcaatacaatcaaattgagacagcgtgcacgtgtgtgccac

SEQ ID NO: 540166 - DNA, 836 bp, Homo sapiens
ttttttttttgtgaagtgaggtaaaggtaatgatgaacagagttgtgccaaataaagaacagacagcagcgtgtatttttaggggggaatgattttaagaaagaatacatacagaatatttatagaatacttaaaaatacttaacagacagtggaagtttggaagattatttttttaaagaacaaccctgcctgaatactctctggaaatccagtctctcagaaatgggagtaacctaattcctagggaatcaagctgattttaagaagtaatgaattgacactgagagtatctatggaaagtatgaaaaaggacacaggaaaataaaatgtctcaatcaacctgcctttaaaatgttgaaatttcaggtgaagtaaacaaagcacgagcaaagtatagacattgatgccaatgtgcctggatatggttatctactaaaggggggaagcatttcatgtttcaaaaggcgctggtcatgtttgcctgggatccaggaaatttagatgggaatggttagaagggaattcactgagctaggtgtgaagttattaacctttgggggcctcgggttcctggtgttagtagaatgattttccttaaggaatgaaggggtacttcgacccattttcatttgtggaaaaaaaaagatgatgcaggctatactggattttaaaacattgatcgagcgggcggaatagtaaacccgcgaggtggttggaaagcaagacaagagttcaaagtttatatggaaaaaaatattggtggacaccgaataggggcgctttggctggggacgtttgagaggtgagacggattgtagggggggtgccgccagt

SEQ ID NO: 540167 - DNA, 849 bp, Homo sapiens
  misc_feature (483)..(483): n is a, c, g, or t
tctaattggtctgtttattcccacaaggtagccagggtttgggggcgccgagccaagcccagcaggccatggaaccttcctccggcggggtgcacgctgaatttcgggtctgccccaccagcaggtttgcaggcaggccgcatgagtgccggtggaaggtctccaagggcgtgggcaggggctcgggcggggccacacactggtggagctagaacatagtggggcaggtccttctctatcaccaggggctcctccaggggtccgtagcgcttcaccacgcagccgttcttgtcgatgaggaactgggtgaagtctccacttgatggcatttcccaggatgcccttgccctggggtgggatcttcatccacttccacagcgggtgggcgtcgtccccgttcacgcagatctgtgctgaacatatcgaatttgacgttgtagcccgggggaactcttggatctcttcgtaactcccgggtccggncttcccgaacgggttacacgggaaggccaggatccgaaaacaactcaggatatcgggcgtgcaggtcgacgagctgagtgtagtaactcgggactagcctcacggggaggccccgtgggtcgacgatgcaccacgacagccccggtactgggtccaggttaacatgtgccgtgatggccttggcggaaaaacccgtgcatggaggggcacagggcaagtcgcccgagaaggcattggcccgcaggcagggggcaaaccaagagaaggccgacagccaggggggtcaaaacaggctacaaagggcaaggatccaaaagggtgccctctcaagtgtcgcgcacccgctgcatacattgaagcgcaaga

SEQ ID NO: 540168 - DNA, 316 bp, Homo sapiens
gcacgagtcatcgctgaagtgcggtggaaagcgagttatgtgtaaggatactgatggaagttagagaaatggtcgtgactggagaaaaacccgaggaatattaagatatataagttctaaaagattttaaaaagtactttgaagaagccaactatgatgaaatctgcaggtagacctaatttcaataggtgcaggataatataagctgaagccaaaaagttggaaaagaatattccggcagagcttaggtctgtacttcctgtgtctgggaaatgtccagtgaacaaagaaacaaatgaagcccagtgtggcagaa

SEQ ID NO: 540169 - DNA, 605 bp, Homo sapiens
ggtgcttggttacaggaatttaagcaaattacagggactgcactccatgagtttgtgaaaggaaaaataaatctcaggaccccaaaatcactaagccaaaaagaaaagtcaagctgggaattgcatcgagcaaacctgcctctcattttattcctgaataagatagctacaaagattaaaaaaaaaaaaagctacatacctccctgacaatttgcccccaaggaaattccttgtgggcctcaagaccttcactctaaaacagttctgttgtatttcaccctggcaatgtaaattgatagcttatcttcacaggtatgggacaaaggacagaactcaaagtcacccctctacccacctgagacaaatgcgtaactgactgcttcctctgccctactgtgtatgtaaaatcgcagattcatttagccgactaaggcataagtgactattcttctgtccctctctcacatgtaactggtgtattacgtgaaaagctgatcaaagactcaaaagaatgcaaccatttgtctcttatctatgacctggatgccccccatccttctagttgtcctgcctttctggagggaaccaagcaacccctggggtat

SEQ ID NO: 540170 - DNA, 1945 bp, Homo sapiens
tgaaataaatgtcctattccggtaaattttaaaggactgttttgacatgataatttgtctcctaaaataatgtcccaggacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540171 - DNA, 194 bp, Homo sapiens
taccttgccacgactcgtttcttgccaacgactcgggagaagacccaggtaaccgagctgaatcgggagtgcaatgaacctgcaggtccagattgacgtcctccagcaaagccaaactcgcaggagtgagcctgcgggcgcgtgactggctcagtaagatagagaccggagacgcaatatcctcaacgtgcgcc

SEQ ID NO: 540172 - DNA, 1087 bp, Homo sapiens
gggttccaaaatccataatgaaacaatgtgttttgcaactaagaaacattcattatgatatatggaaaacactgtctgtctacttgtcctttacgaaaaaaatgtaaaactctgaggatcataaaatttaactactaaaaataatcttcgtgtttaagtgatacttatttaagactttacactgttctgtttaaccatggtctcctgtctgattttagccataattgcaaagtatttctaactacaacaatttaattttagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540173 - DNA, 118 bp, Homo sapiens
ctccatttctaaaatacagttgtttcaaccaggttatgtagtaaaatagaatcacacagtatgcaaactttagggattttgttttcagtcagcataattttctggagatccatccagg

SEQ ID NO: 540174 - DNA, 4430 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgctgaaagtatagaaagtggaacatgaaaaatatttacataaaaacctgaacaaaggttttttttttttttccttttcttttttgtctctgtaggatactaaggtacaggatgtggtaatatgttcaggcagtcagatacaggaaatatttatggtacataatataatatcttctcatgtccaggtgttgaactctgaagtctagtgacttgaatttgatctagtgaaatatatactcacaaagtgaggaattatatctagaaatctgtaatttttaattgtaccgctaaagcgctttaccttcttttgtacttcttgaaaatactggctgcattgcaacagaagacaaatatgattaatgtcatgcaattcataatatcttaaattgcattgctggattctttctcaattaaaagaaaaaatgaaagaaaaaggcttttaaaatgtttttcatgcatctgataacagtgacatagaaaggaaaaaatgaaacatagttcagaatacttaaaagtaagaataaatttcagccagccagacatgagctctattcaacaaacatgatatgatcagtatttaagttataggctaaaaggtctttaattttcagctttgttatcactatccttttttttttttaatttaaaggtatatattttaaacgtgtgtcgtctacctaagtaagataatagtctttgaactaggtactatgtttgctgtttgggtgatgggttcactagaagcctaaaccccagcattactcaatatatccatctatcaaacctacgtgtgtacccccctagatctataataaaagtaaattaaaataaattaaataccagtcaactatttggttgactttggttgtactgattaactggaaatgtgcctctgaagccacacagccagagcaactggctttttgtcatttctaatgaaaagccttgaaagatggttctattagataacgggccacactgaagctaactgtgcatctagatcacatcaaagcagtagaggtgagatgttagcacagctttggtttctgcagttctcacctcatgcttgtaagatgtttagctgtgtcaactttttgaattaatgtgggttcttagccttcatagaccctgtgtttcagccttattaggttttgtattttgagatctcaaattgtgaagctctaaaataaaacaaatctgtgtgtttaggtactagttccacaggtggtcttgccacagaagaacctttccatgaaagtcgaatacgaatacacagggctctctattgctgctatcaaaatggactaattccttttagcttacattttttacatcatgttaaggaatttgacgttttggatgttcagctggttggtagttttcatttcaatcttgattttctgcagacttaaatagttttgacaggtgaagctctgaggattaaatattgattttagccctctccaggtcaaatgttccatatttgacaacttataccaaaaacagcatccttcccctcaactatacactttaaaatggatgttattttggggatgaggataatatgcagcaaaaaattataggaattttagaaacaagtcaacaacgaaatataaaaatagaaaatttggtttaatttacctttacttctactttaaaatacttcttaataacagcataccgtctaaggaggagtaaaagaaacatcttacattggaatgtaaatgttagagctgtttcaaggcctctgggtaggtagggaaggaccattgaacatgtgtgtcttaataaaatgtagcttatgctctgtgagtgaggatgtaatttagtaggagaaaataattatatttttgctcattgtaatcaagatattgcattcacatatatagaaagtagtgaaactaagatggataaagaagggaagctaaagaaatgtagtgggaatgtgtatatatatatgcatatgtatatatttatacctttgatgaagaaagatggcataacatgtctgatgaatagagcccataaggattgcttaattttcagaaaacatattttttacaagattgtattcccatggtgaatcataactattccaattaaatctttaatacagtgctgagctggcctgatcctggaattgcatgttattattgcataattgaaatcaacaacagcagcagacattttgttttgctccttacattggctttactccttttccatatctagtataaatcttaagggaaattttcttaattaaataactggatgctcatggtataaaatggaatgattttctagccagaataaatgtgggtattgaagtaatgttttagctactgatacactttgagtgtttaattacagagccaaaacaaaatgaaaagaatttctgcttgaaagctacagggaaataaagaaagagagaaaagataaacagagaaaaagccatgatggaaaagatatactactagctacacttatgagaatgaaataccctttatcattgttaagtagtagaggtttaattttgataatctggttgtgtcagagatcaaagaaccctggaatttggaaactttaaatttgtcacatggcagatttttttgttcctttgtccaattttggatgggagagtttttgaactgccaccttataaacattggtattcttcaacacgtgcttctcagcctgcccttagatagctcagggcttgagggtggcgtgaacaacaagtcttggctaaggtcatttctgtgtccacacatctgaatttttagatatttctagagggtcttttcgccatctcttccctttatatgtcttttaattttcctggctctttgccacgctaatattatattttgctgtctttctcatgtcatatcatttctgtttttccaatgagtggggaagaagttcattggagtaa

SEQ ID NO: 540175 - DNA, 4346 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgctgaaagtatagaaagtggaacatgaaaaatatttacataaaaacctgaacaaaggttttttttttttttccttttcttttttgtctctgtaggatactaaggtacaggatgtggtaatatgttcaggcagtcagatacaggaaatatttatggtacataatataatatcttctcatgtccaggtgttgaactctgaagtctagtgacttgaatttgatctagtgaaatatatactcacaaagtgaggaattatatctagaaatctgtaatttttaattgtaccgctaaagcgctttaccttcttttgtacttcttgaaaatactggctgcattgcaacagaagacaaatatgattaatgtcatgcaattcataatatcttaaattgcattgctggattctttctcaattaaaagaaaaaatgaaagaaaaaggcttttaaaatgtttttcatgcatctgataacagtgacatagaaaggaaaaaatgaaacatagttcagaatacttaaaagtaagaataaatttcagccagccagacatgagctctattcaacaaacatgatatgatcagtatttaagttataggctaaaaggtctttaattttcagctttgttatcactatccttttttttttttaatttaaaggtatatattttaaacgtgtgtcgtctacctaagtaagataatagtctttgaactaggtactatgtttgctgtttgggtgatgggttcactagaagcctaaaccccagcattactcaatatatccatctatcaaacctacgtgtgtacccccctagatctataataaaagtaaattaaaataaattaaataccagtcaactatttggttgactttggttgtactgattaactggaaatgtgcctctgaagccacacagccagagcaactggctttttgtcatttctaatgaaaagccttgaaagatggttctattagataacgggccacactgaagctaactgtgcatctagatcacatcaaagcagtagaggtgagatgttagcacagctttggtttctgcagttctcacctcatgcttgtaagatgtttagctgtgtcaactttttgaattaatgtgggttcttagccttcatagaccctgtgtttcagccttattaggttttgtattttgagatctcaaattgtgaagctctaaaataaaacaaatctgtgtgtttaggtactagttccacaggtggtcttgccacagaagaacctttccatgaaagtcgaatacgaatacacagggctctctattgctgctatcaaaatggactaattccttttagcttacattttttacatcatgttaaggaatttgacgttttggatgttcagctggttggtagttttcatttcaatcttgattttctgcagacttaaatagttttgacaggtgaagctctgaggattaaatattgattttagccctctccaggtcaaatgttccatatttgacaacttataccaaaaacagcatccttcccctcaactatacactttaaaatggatgttattttggggatgaggataatatgcagcaaaaaattataggaattttagaaacaagtcaacaacgaaatataaaaatagaaaatttggtttaatttacctttacttctactttaaaatacttcttaataacagcataccgtctaaggaggagtaaaagaaacatcttacattggaatgtaaatgttagagctgtttcaaggcctctgggtaggtagggaaggaccattgaacatgtgtgtcttaataaaatgtagcttatgctctgtgagtgaggatgtaatttagtaggagaaaataattatatttttgctcattgtaatcaagatattgcattcacatatatagaaagtagtgaaactaagatggataaagaagggaagctaaagaaatgtagtgggaatgtgtatatatatatgcatatgtatatatttatacctttgatgaagaaagatggcataacatgtctgatgaatagagcccataaggattgcttaattttcagaaaacatattttttacaagattgtattcccatggtgaatcataactattccaattaaatctttaatacagtgctgagctggcctgatcctggaattgcatgttattattgcataattgaaatcaacaacagcagcagacattttgttttgctccttacattggctttactccttttccatatctagtataaatcttaagggaaattttcttaattaaataactggatgctcatggtataaaatggaatgattttctagccagaataaatgtgggtattgaagtaatgttttagctactgatacactttgagtgtttaattacagagccaaaacaaaatgaaaagaatttctgcttgaaagctacagggaaataaagaaagagagaaaagataaacagagaaaaagccatgatggaaaagatatactactagctacacttatgagaatgaaataccctttatcattgttaagtagtagaggtttaattttgataatctggttgtgtcagagatcaaagaaccctggaatttggaaactttaaatttgtcacatggcagatttttttgttcctttgtccaattttggatgggagagtttttgaactgccaccttataaacattggtattcttcaacacgtgcttctcagcctgcccttagatagctcagggcttgagggtggcgtgaacaacaagtcttggctaaggtcatttctgtgtccacacatctgaatttttagatatttctagagggtcttttcgccatctcttccctttatatgtcttttaattttcctggctctttgccacgctaatattatattttgctgtctttctcatgtcatatcatttctgtttttccaatgagtggggaagaagttcattggagtaa

SEQ ID NO: 540176 - DNA, 84 bp, Homo sapiens
gctgaggacacggctgtgtattactctgcgaaagatatgagctactatcctcctaggagggactttgactactggggccaggga

SEQ ID NO: 540177 - DNA, 4086 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgctgaaagtatagaaagtggaacatgaaaaatatttacataaaaacctgaacaaaggttttttttttttttccttttcttttttgtctctgtaggatactaaggtacaggatgtggtaatatgttcaggcagtcagatacaggaaatatttatggtacataatataatatcttctcatgtccaggtgttgaactctgaagtctagtgacttgaatttgatctagtgaaatatatactcacaaagtgaggaattatatctagaaatctgtaatttttaattgtaccgctaaagcgctttaccttcttttgtacttcttgaaaatactggctgcattgcaacagaagacaaatatgattaatgtcatgcaattcataatatcttaaattgcattgctggattctttctcaattaaaagaaaaaatgaaagaaaaaggcttttaaaatgtttttcatgcatctgataacagtgacatagaaaggaaaaaatgaaacatagttcagaatacttaaaagtaagaataaatttcagccagccagacatgagctctattcaacaaacatgatatgatcagtatttaagttataggctaaaaggtctttaattttcagctttgttatcactatccttttttttttttaatttaaaggtatatattttaaacgtgtgtcgtctacctaagtaagataatagtctttgaactaggtactatgtttgctgtttgggtgatgggttcactagaagcctaaaccccagcattactcaatatatccatctatcaaacctacgtgtgtacccccctagatctataataaaagtaaattaaaataaattaaataccagtcaactatttggttgactttggttgtactgattaactggaaatgtgcctctgaagccacacagccagagcaactggctttttgtcatttctaatgaaaagccttgaaagatggttctattagataacgggccacactgaagctaactgtgcatctagatcacatcaaagcagtagaggtgagatgttagcacagctttggtttctgcagttctcacctcatgcttgtaagatgtttagctgtgtcaactttttgaattaatgtgggttcttagccttcatagaccctgtgtttcagccttattaggttttgtattttgagatctcaaattgtgaagctctaaaataaaacaaatctgtgtgtttaggtactagttccacaggtggtcttgccacagaagaacctttccatgaaagtcgaatacgaatacacagggctctctattgctgctatcaaaatggactaattccttttagcttacattttttacatcatgttaaggaatttgacgttttggatgttcagctggttggtagttttcatttcaatcttgattttctgcagacttaaatagttttgacaggtgaagctctgaggattaaatattgattttagccctctccaggtcaaatgttccatatttgacaacttataccaaaaacagcatccttcccctcaactatacactttaaaatggatgttattttggggatgaggataatatgcagcaaaaaattataggaattttagaaacaagtcaacaacgaaatataaaaatagaaaatttggtttaatttacctttacttctactttaaaatacttcttaataacagcataccgtctaaggaggagtaaaagaaacatcttacattggaatgtaaatgttagagctgtttcaaggcctctgggtaggtagggaaggaccattgaacatgtgtgtcttaataaaatgtagcttatgctctgtgagtgaggatgtaatttagtaggagaaaataattatatttttgctcattgtaatcaagatattgcattcacatatatagaaagtagtgaaactaagatggataaagaagggaagctaaagaaatgtagtgggaatgtgtatatatatatgcatatgtatatatttatacctttgatgaagaaagatggcataacatgtctgatgaatagagcccataaggattgcttaattttcagaaaacatattttttacaagattgtattcccatggtgaatcataactattccaattaaatctttaatacagtgctgagctggcctgatcctggaattgcatgttattattgcataattgaaatcaacaacagcagcagacattttgttttgctccttacattggctttactccttttccatatctagtataaatcttaagggaaattttcttaattaaataactggatgctcatggtataaaatggaatgattttctagccagaataaatgtgggtattgaagtaatgttttagctactgatacactttgagtgtttaattacagagccaaaacaaaatgaaaagaatttctgcttgaaagctacagggaaataaagaaagagagaaaagataaacagagaaaaagccatgatggaaaagatatactactagctacacttatgagaatgaaataccctttatcattgttaagtagtagaggtttaattttgataatctggttgtgtcagagatcaaagaaccctggaatttggaaactttaaatttgtcacatggcagatttttttgttcctttgtccaattttggatgggagagtttttgaactgccaccttataaacattggtattcttcaacacgtgcttctcagcctgcccttagatagctcagggcttgagggtggcgtgaacaacaagtcttggctaaggtcatttctgtgtccacacatctgaatttttagatatttctagagggtcttttcgccatctcttccctttatatgtcttttaattttcctggctctttgccacgctaatattatattttgctgtctttctcatgtcatatcatttctgtttttccaatgagtggggaagaagttcattggagtaa

SEQ ID NO: 540178 - DNA, 3093 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagattagtaaaaggacaacaactaacccccttaacaggttctagtgactgagttcaactttttaaagaccgagcaagcagattttttcttttaattgggttaaaaaaaaaaagacaacatccactgttgtcttaatagatggattggttcaatggtagttaatagttatgaagaaatgattactagtttaaacagtctttaaaaagttctatggtataaagtttggggagcaatgaatattttttttgctttgattcagataattttaagggccttttaagtatgcaaaagggaaataattgttaaattgctagctgttaaacaagcccaaatttgatatactttttatatttaaaaaattatattcactgcccccataagagcaatcaaggcatgtctttaaattctatacatagatatagccaaaaatagtgcatttagtaacattcttttccaaaactatattcttgggaatgaatatctgtttcttctaacagtttgagtgataatctatacctgtagatataagttattttgcatataaaattaatcttaatcttttatggaatgttctctgtctgtggcattaaatgaaccttaagaacaa

SEQ ID NO: 540179 - DNA, 3186 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatata

SEQ ID NO: 540180 - DNA, 912 bp, Homo sapiens
aatttcaattcctttcattttccggtagagacaaaggagacatgttttatccgtggacccaaaactccggcgccggtcacggactgggaaagcagccttccttggtgtttaatcatgcagggatgtctctctgattattcacccacgtttcaaaggtatcagaccacacagggacgcctgccttggtccttcacccttagcggcaagtcccacttttctggggaaggggcaagtaccccaaccccttctctcctggtctctaccccttctctgcttttctggggaaggggcaagtaccccaaccccttctctccttgtctctaccccttctctgcttttctggggaaggggcaagtactccaaccccttctctccttgtctctaccccttctctgcttttctggggaaggggcaagtaccccaagccccttctctccttgtctctaccccttctctgcttttctgggagaggggcaagtacccctcaaacccttcttccttcaaccttagtggcaagtcccgctttcctggggcagggtcaagtacccctcaacccttctccttcacctttagcggcaagtccgcttttctgggggaggagcaaggtacccctcaaagcccttctcctttcacccattagtgaacaaggtcctggctttactagggggcaagaaacccccaatacccttattttccaacaccaaactcttatcttctgatgccctaatccattatgtgccgggggccccaaagccccattcccaggcgtttaaagagggtatagaaaccgcgggagcccatgactacaagtgcataggccctataatcagggatgccaaccatcaaaggcaactaccacactccaagttcagtctatacctaagcacggtttacaactaacacttcagcagg

SEQ ID NO: 540181 - DNA, 407 bp, Homo sapiens
atagtgatcttatgcgagcaatatagtcactcttcactccccggcaagtagaagtagactcaacggcgattacaatttggttgctggcagccattctgggtttcttgatctcagtactccaagagaatatggtggtctcatggcgctagctgaccactacagaggggcgccttaaaagggaatcacttatcagtctccaagcataggatgcattaagaactatcaacggataactgacatcgtctcgttcagaagttcactgtatcatagctcactactgccagagcggccctggatgtacaacgaaagagcatgaaaaatacacacagttattaagccacctgattaaaagaaaaccaatatttaaaggcatttaatagcatatcaagtataactttgcaggagaa

SEQ ID NO: 540182 - DNA, 2019 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggttatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540183 - DNA, 181 bp, Homo sapiens
  misc_feature (103)..(103): n is a, c, g, or t
  misc_feature (158)..(158): n is a, c, g, or t
  misc_feature (166)..(166): n is a, c, g, or t
ccgccaacaccaacagagggcttagtttaacatgtcttactttcacagcatgtgacttacagcttttgtaatgaaaaccaataatcaattctaaaaaaaaaangacaacaggttcatcaagttcagggctttggtcagtttccaccggtgttccctcngccttggngtgggggataacata

SEQ ID NO: 540184 - DNA, 176 bp, Homo sapiens
ctctagacggactcccgaatacctaattacggaagctagttggacagggtatgccatagaggcatatagggcttcacctattatataacttcgacaaagttatgtaatattttactaattacctcgattaatcgaggaaagacatagtgggttatgaacggtgggctggaaaccag

SEQ ID NO: 540185 - DNA, 361 bp, Homo sapiens
cattaaagcatagcttttaaaaatcgattacctcaattattttgccctattttatttgttgtagttgaaaaaacattacatttatcatcctaacaatttttaagcatatagttcaatagtgttaaatatattcatgttgttgtatagcagatctctagaactttttcatcttgcaaaactgaaactctatacccattgagcgttaatttcctctctctcttccaccagctcttggcaaccacctttctactttctatgattttgactactttagatacttcatgtgagtggaatcatagagtatttatatttttgtacctggcttattttacttagcataatgtccttgaggttcattcgt

SEQ ID NO: 540186 - DNA, 2101 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgtatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540187 - DNA, 1994 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (1935)..(1935): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgtatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcaggtgataaagaatgatgttttgaagagcatttttgtcccgtatcagaatttctttttcttcactagtcattcccttaaaagcatcattggttggcacaaataatgtccagtctccaggttgtgtcaaangaactttcaagtctgcagcttcaagtaggctgagagggtttcttagcgatagtttggct

SEQ ID NO: 540188 - DNA, 825 bp, Homo sapiens
  misc_feature (428)..(428): n is a, c, g, or t
ggaaaggcccctagctgggtctgggtgcttggaggtggcggcattcctccccgctcgttctccccgggcccagaggcactctcggacttcagtcatgactgagcagagtatggaagcacctgactatgaagtgctatccgtgcgagaacagctattccacgagagagatccggcggagttgtattatatcaacacttctgtttggcaacagctgtacagtcctgctgctcacatgcttgcctgagcccgcgttcaaggaagcctgcgtggagttcaccgacagtggcatgatgaagatgccgatcggtcaacaagattgcgctcgagtctgtgcagctttacccgtggaaatgtggtcctgggtgcatgtcctgactcctgcccgttctccatcatcagtcaagtgaaggctgcctgcatcgtacccntgaccgttcggagacttagcttacagtcctagtggcgtcacacggactcccgtcatccatggccgtctggaaccgttgtttgactcttctccaacctgtccgcgtcatgttcctcatgccctttgcatatttcttcactgagtctgagggctttgcgtggctccagcaaagggtgtcctgggccgggtcgtatgagacagtggtgatgttgaatgctccgtcactctgctggtgctaggtatggtgtgcggtggcatcagccatagtggacagagaacatggccatgcagagagtcactcatatgactgttcgggagtactatctccacctaagctctactcatgcattctccgttccttggggttctggctgctcctggtgtgtactccgactggg

SEQ ID NO: 540189 - DNA, 417 bp, Homo sapiens
  misc_feature (319)..(319): n is a, c, g, or t
aaattttagcaacaacaaccacaaatagaaaatttaccagtagtcaaccatgtctgtacagttatggaggctacttcccagccctctttggttcttgcaggaagagtgtttgcaggcctgtcctgttggtattgtttgtcagctcagaaagaatcaggtggtacccaagtgcggggtcttcctaacgttgaaaaatgaaacgagaagctgtatcacagaaaatacaaaatgatgattctgagagaaatattttccttcatttcaaatgttctttactaatgatgaatttgaaagaatggcttttttccttttttctttnttttttcttttttttttttttggatgcttaaaatcagaatttttaatggattttttaagataactttaattagtttatatgaaatcagcagcaaaagg

SEQ ID NO: 540190 - DNA, 212 bp, Homo sapiens
gaagatcttttcccagaagctggggtacctgctcttccgagacttcggcctgatccacctggaggaggccaggcccttggtggaattctatgaggagatcaagaagtacgagaagctggagacggaggaggagcgtgtgtcccgcagccggtagatcttcgactcatacatcatgaaggagctgcttgcctgcttgcatcccgtgtaccgag

SEQ ID NO: 540191 - DNA, 316 bp, Homo sapiens
gctacagcctatgtaacgagcgcctccgtaactgagcgcttcctgtaacgacgcgcctccgtaactgagccctgtttgcactccaccttcttcccagaccctgcagggcgccaagaccaaaatgagtgccagcgaccccaacatcctccatcttcctcaccgacatggccaagcagatcaaaaccaaggtcaataagcatgcgttcactggagggagagacaccatcgaggagcacagccatgttgggggcaacctgtagatgtggacgtgtctttcatgtacctgaccttcttcctcgagaacgacgacaagctc

SEQ ID NO: 540192 - DNA, 955 bp, Homo sapiens
tccccggcttccagcctcctgagattgccaatggactggacaccttttcaggtttcaaggtggacatctggtcagctggggtcacactttacaacatcaccacgggcctgtacccatttgagggggacaatatctacaagctctttgagaacatgggagaggagacttcaccatcccttgtgactgcggcccaccactctctgacctactccgagggatgtggagtatgagccggccaagaggttctccatccgacagattaggcagcacagctggttccggaagaaacaccctctggctgaggcgctcgtacctatcccaccaagcccagacactaaggaccgctggcgcagtatgactgtagtgccctacctggaggacctgcatggccgtgcggaggaggaggaggaggaagacttgtttgacattgaggacggcattatctacacccaggacttcacagtgcctggtgtcgaggaggcggccgaggcagggcttagcgaggatgcatgcgacacatgcatgtggaagagccagggcgcaggccttcctggagaggagcccgaggaggggtttggggctttagtgtagctccctgtctgctgcccaccatgtcctccataaagctttgtccactgtgtctgcaggtggatgcttgccggattccctcctgtcactacctgaaaggctcccaaccggctttcgagaacatgctgggtcagggctgagctagtccccaggcgcgggggccagccaggtctggggccttgtcctggggcgatgcaagcccatagtccggcttcaaagtgggggcgggagactcgggacacggtcccggaaaggaggtaaaagccggggacgggggcacaggggggaccaggatggggccgcgcatgaaacctggaagaccgagcaaacagggcgaaagtgaaaaaccagagggaaggcgcaagca

SEQ ID NO: 540193 - DNA, 808 bp, Homo sapiens
atagcactaaatgccaacaagagaaagcaggaaagatctaaaattgacatcctaacatcacaattaaaagaactagagaagtacagcagcaaacaccattttcaaagctcagcagcacaggcaagcaacataacgtcaagcatccagcagcagcaactagcacaggcacacatcagcagcacacgaaaacacacacgcccttccaacaacaatccacatgcacatcccaggcagcataggtcatttatgcacacacacgatcgaaccaacacatctgcatcggcacgtgcatcagcaacagcacgtcacatcaacagcacagcaacacagcagcagcacagcaatccacacatcagcacgacaagtaacacaaaatgcatcacacagggggcatcatccacgcaccggcatcaccacgagcaaatcaccacacactcacccataccagcagaacatcacttataacaaacaccgtctcactgcaacatacaaactcagaacaaaatcgtcagcaagcaacatggcattacacatatccctgtgacaacatcacaacacctcccacaatgaactaaaaccccaggacagaacgtaggacatctactgaccatacgaaccacataaacacgggctactggacacattgacgtgcacagtcacgatcacaatacgttataccacagccacagaacaaacagtctagggaccccagatgggattcacagaggaccgacatttctacccaagagggatccacaggcacgagaagcctggtacccagattcctttcgtgaaacctattccaact

SEQ ID NO: 540194 - DNA, 446 bp, Homo sapiens
cctgaccccccgccccgcccacccccgagaggccaagcacgcaaacagcagtaaaacgagaagaggacggcgcgcaagaagagcagcacgacatgcacaacaacagacacgtaccgagaaacgcagaaaggtaacgacgagcgagcgaggacacaacaaggcaccgcacaactgcagtaaacacccacatacaacacacacctgaacacaccacaccgacagaccacacgacgctcactgaaacacgagaccaaccggagacagataacaacagatagcacacagaaaaaagagcacgcaggacccataagcaaactcaccccggacgagcagacgaccaataagagaagacccaacctctcgtcctctctccagtacgccaccaccccggaaagtgcgagacgaagcgacgcgagtgaccggagcgtgagtggcggacgcgagac

SEQ ID NO: 540195 - DNA, 947 bp, Homo sapiens
gctttactcgccacgggttagctgaccatgaaactacagggatgatacgtagaacaacatgacctcacttaaattgaccaatacaatggcgaccatgagataatatgattcatactcaatcttgatcgtcattagtacacgcgtgtattccgaggccaagtccatcagtactggtcatctgatctatccaagcggtggcattcgatgaactacgaaccatggcaacacaattcattgaggcaaggcagggctggcctgcataatgcgcgagatgggcctcccttatccagtaatgcccttgggcttctctgtgcattcaaatctgaaaaatgcctgacgcagttgaatcggtcgcgtatcaccctaattggattatactaccctctgctgggaaacactaattgacagactctaggcaaagttatctcattgctgaaatacctcaatttggattgccccccacgcgacgaccacgcagccaactcatcatcgaaagaaggttgaaattaagcccgggaaacattctctaagggctcgacgtgagcacttgttcacaccgactgtggtaggcacgccttagcttgtagggcccgcatttctcgactaacctggcgatatcgacccaccgtaaaagggatcacggacccagcgaacgcgagtcaatgccacccatttcagtggcactttcgcaacaacattgggcacgtttgtcacatgacctaaataaggtctagccggatacatccgctggctgggcgaatacccaccttgacatactggacccatgaccaagtggccaccaaagtagcatttctgaccggacaacaaggcattaccctgcacgtgtccgggacatcacacaattagagtgatacccctgtacagcaacacactcgcgaccaccagcaccgagccgagctgacgacaatacgtgtctgggcacgctg

SEQ ID NO: 540196 - DNA, 425 bp, Homo sapiens
  misc_feature (126)..(126): n is a, c, g, or t
  misc_feature (138)..(138): n is a, c, g, or t
  misc_feature (141)..(141): n is a, c, g, or t
tttcccctattttcaggggcccccctaggcccaacctcggccaaaaaccatttcccttttatatttatgggggggaatttaactttttttcccccaccctttttgggcccatccggaaagccccgnggttttttgggntcncccgagggaaaccccccaaaaaacatcctatcattgggaggggccttcctttttctaaccccgggaaaattaaaaattttcttgattttaaaagccttcgcttcgaagggaaaagtcctaaaaggaaaagacccccccctaaaccgggggggggtaaaggggggccccccccccccccccccctttgaagaacccgggtacataaaatttagacaaaaaaggaagggatcggccccccccaaggggggttcaagcccccccccgggcccccctggcttttttta

SEQ ID NO: 540197 - DNA, 159 bp, Homo sapiens
ccccctgcactcggttaagtaccctgaggcctctcttaggatgtccagtgtgcccaggcccgcgggcacagccagcgccacaaccttgggtccctggaagagtccatcgtgacctcatcttgagtaccgaggctcgaacttctgtaatacgtcggtcag

SEQ ID NO: 540198 - DNA, 494 bp, Homo sapiens
  misc_feature (252)..(252): n is a, c, g, or t
  misc_feature (305)..(305): n is a, c, g, or t
  misc_feature (320)..(320): n is a, c, g, or t
  misc_feature (322)..(322): n is a, c, g, or t
  misc_feature (325)..(325): n is a, c, g, or t
  misc_feature (353)..(353): n is a, c, g, or t
  misc_feature (363)..(363): n is a, c, g, or t
  misc_feature (388)..(388): n is a, c, g, or t
  misc_feature (422)..(422): n is a, c, g, or t
  misc_feature (477)..(477): n is a, c, g, or t
agagaaggaaggaattcacacggcaaatacagtgatataggtaatgctctagttcagcagtgtccagtagatctttttgcaacagtggaaatgttccatatcggtgctgttcagtatagtagctaccagctttctgtggctattgagcactccagagagtggcttgtgtgactgaggaactgaatttttaattctcttaagtttaagcgggcacatatggctagtaactcataatgggatagtgcattctanttctagtggcaaatagacctatgtttattgttaggcatgaaaattacacgtangttaaaatagtctangnaanatccaaatgcagcataatcctaaaaagncatttaaacntaagcttcagaactcctttggtaanatagttcgctgctccgtaggtctcagcatgaccngttagtccccagccagcacagcagggataaataaccctctttattaggcctcagntaccaggcatcaggacc

SEQ ID NO: 540199 - DNA, 814 bp, Homo sapiens
  misc_feature (392)..(392): n is a, c, g, or t
ggccgccattatggatcggcaggtacatgagtccgtggttctggagacatgctggagactatgtggtggtgactgataataactgttaccagagtgaaagctattttgctaactatcttctccagcggagatggccacattgtgcttcgtaatcgaggagccagatctggtttcctattctcccaggatttcgctctttagcttaaatagggttgtcatattcccagagtgcctgttcgacgtgctaggatcatatcaaggcttcaggcatcgagtcttcgatagctggcatgcttgccatcgtctccagtatatatgcggtcgtcgaactgagtgctggccatcgatggaagacataatcgggcacacctgttggtagccgtcaagtatcnagcagtgcttcccagcgttacctgcgggaaacatatggtatgtgtgattgatcaccatcgagatgtggactgacttcaacacgtaagtaaagagcctgagttcatgaaaattgttgccgtgatgtctcatagcagaattccattttatcaagctgaaacgacgatgaagtctcgtcgatggctacaagtatgtggaatgtgaattgcgagggtaatagattgcccctgttgagacatgaaattgacagtgcagaaacttgactttggaagtgccagaggtagagtgtgcaatacaaatgtgtccagaattgttgcgacacgattgtgaagcactgttgcaggaaagtagctcatggggaaactaggtgattctgagtgtaagagggataaactaggaatgatatgactggtttggagtgcag

SEQ ID NO: 540200 - DNA, 248 bp, Homo sapiens
actgagaaagggcaggatagaacccgcaacctcatggtcctagtcggatacattaactactgcgccatgacgggaactcctagactttttttttaaatttaacctgcctatatacagttgtttagtgatttccagtggtgtgttgagcacggaatgttgatattcaacacaggatcatgtccaggaccctggtaatagacagcatattcctttcagacagggatttacaatttggtcaccaacttcaa

SEQ ID NO: 540201 - DNA, 247 bp, Homo sapiens
cagtgagacgagatcgcaccattgcactccagcctgggtgacagagagagactctgtctcaaaaaaaaaaaaaaaaactttacctctaaacatttgggaaggggctggacatcccaaaagcgaaggggcggaggggttcaaccttatgccaccccttaccgtgctgggtgggtgcctttttgcatccccgggactttgcatagacaccaggctgcccgtaatcagagcctggccctggaccgttgcc

SEQ ID NO: 540202 - DNA, 335 bp, Homo sapiens
attatggacattccacgtgcttatttcgcccgattccagtaggttaatagtggtgggtaaggccaggttagcgatggaggtatgattggtgctgtgggtcaaagagcatgatggggtggcggttgcgtgaaactttaatagtgcctgaagctgaatactttatgaaggagaggccccatggttcgattccggaggatcctattgacgcgcgggctttgtctgatcatgggcgttgattaataatacattactggttgctcattgaaagttggtgcctatatcgaaatcgcaattgctccgagcaataggctatgtgattaggacctggggtacca

SEQ ID NO: 540203 - DNA, 517 bp, Homo sapiens
ggtggcgatctagaggatccctcacgcccatgtcacaaaagaaaattacataaagcaaataaatttcttctcacggatatgaattcaaagtaaaaatttatattttacttaccttgggtagagagacttagaatacagacgggatacagtcaaagagtgaaaaacaagatggtaaataacaaaagacaacaagttggtcttcttccatacagcacaatgttacaagcctatgagaaagctcctagaatttgaatttctgaggagagtttcttcgtgaaaagttttagctgggcacagtggctcatgcctgtaatctcagcacttggggaggccgaggcgggtggatggcctgagcccaggagtttgaaaccagcccaggcaacatgaggaaacttcgtctctaccaaaaatacaaaaatgggctgggcatggtggtgcacacctatagtcccagttattagtgagtctaaggtgggaggatggcttgagcctgggaggttgaggctgcagtgagctg

SEQ ID NO: 540204 - DNA, 364 bp, Homo sapiens
acctctaccccacgaccaggtgaacttgcgggatgagctcctccagctctactcagattctgatgaggaggatgaggatgaagaggaggaggaagaaaaggaggcagaagaggaacaggaagaagaagaagcagaggaagacctgcagtgtgctcatccctgtgatgcccctaagctgtgagttcctgcctttgcacctgcaagtcctttctctgagcctcaatttcctcatttgttaagagggacacaggtgatgtgcttgccggcagggttgctggaactaattgagaacactgcccttagccctggtgggctgggaactgggaagccccactccctgcaccctgactcccattcctccctc

SEQ ID NO: 540205 - DNA, 120 bp, Homo sapiens
  misc_feature (90)..(90): n is a, c, g, or t
  misc_feature (99)..(99): n is a, c, g, or t
gatattcagatttaaaaggttttcaaagaattactttctcccatgtccaaagctagatttccctaaacacatgtatcacattcatatatntcgttcttnggccccactgccaaaggaagt

SEQ ID NO: 540206 - DNA, 2013 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggttatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgagggtctcactctgtcacccaggctggaatgcagtgacacaatcatagctcactgcagcctcaaacttctagcctcaagtgatcttcctgcatcaaccttccaaagtgttgacattacaggtgtgaggccaaggcaggcggatcacctgaggtcgggagttcaagatcagcctgaccaacatggagaaaccccctctctactaaaaatacaaaattagccgggcatggtggcgcatgcctgcaatcccagctactcgggaggctgagg

SEQ ID NO: 540207 - DNA, 463 bp, Homo sapiens
tgtgatggatctagaggatcccggcatgagctcttacacatgatcccatatctcgacctcatggaaatgggaagagcaacagctaactccacatgtgtcagaaaatagttaacattcaaaaaacttgtttcacatggaccaaaatgatgtgccatctaaacatacaaagcctcttgtcatcaacagccgtgaccactttaaaatgacccagttcatggcatgcttgaagcgacatggtgggtcacataacaccagtttctggcatagcgctattggtagtcactttggcttactcggcagagactgcagatcactcagatgtaaacattcaaccacctcgtgactacaatttaacttccatttagatatagctttactcagcatgcactgtcgataaggatcgccgccaaccactccttggcgcttactgaccatttaaaaaaatacttcaccacggcctccc

SEQ ID NO: 540208 - DNA, 1935 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggttatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540209 - DNA, 271 bp, Homo sapiens
  misc_feature (248)..(248): n is a, c, g, or t
cttgacctcaggtgactcgcccacctcagcctcccaaagtgctgggattacaggtgtgagccaccgcgcccagcttttcctttgctttttactctcaggcagtctctctccagggtggtggcagacatggttccagcatctccagtttcttaattctccagtttagtgcttttgggagcattaagctgggagagaaaggcctaagatttctctggggattttgttgcacaccctggggaagcaaagantattggtcagttgccatctttga

SEQ ID NO: 540210 - DNA, 446 bp, Homo sapiens
gataatcataacacttttggtcacatgttttctcctgcagcctgaaagttcttaaagaaaaagatatcaaatgcctgctgctaccacccttttaaattgctatctttagaaaagcaccggtatgtgttttagattcatttccctgttttagggaaatgacaggcagtagtttcagttctgatggcaaaacaaataaaaacatgtttctaaaagttgtatcttgaaacactggtgttcaacagctaagcagctaaagtaattcaacccatgcattgctagtgtcacagcctttggttatgtctagtagctgtttctgaagtattttcatttatcttttgtcaaatttaaccctgtttgaattctctcctttcctcaaggagacacttatgttcaaagtgttgattctttgccttaggtgcatagagagtagacagtttggagatgga

SEQ ID NO: 540211 - DNA, 2017 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgtatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540212 - DNA, 232 bp, Homo sapiens
acgccctcacgctaagtcaatcctaagccaaaagaacaaagctggaggcatcacactacccgacttcaaactatactacaaggctacagtaaccaaaacagcatggtactggtaccaaaacaaagatatagatcaatggaacagaacagagccctcagaaatagcggtgagggcgtgcgccctcaccggtgtactaatggagccatctagtagcgtggtccctccgaagttt

SEQ ID NO: 540213 - DNA, 775 bp, Homo sapiens
  misc_feature (9)..(9): n is a, c, g, or t
  misc_feature (126)..(126): n is a, c, g, or t
  misc_feature (434)..(434): n is a, c, g, or t
  misc_feature (457)..(458): n is a, c, g, or t
  misc_feature (468)..(469): n is a, c, g, or t
  misc_feature (527)..(528): n is a, c, g, or t
  misc_feature (557)..(557): n is a, c, g, or t
  misc_feature (564)..(565): n is a, c, g, or t
  misc_feature (641)..(643): n is a, c, g, or t
  misc_feature (650)..(650): n is a, c, g, or t
  misc_feature (652)..(652): n is a, c, g, or t
cttgagacnagaatcagtgttaaagtcattttattcttattaaggaaatactttgcatagattaatcagccccagagtgctttagaaattctcttaaataaaaataatagactcgctagtcagtanagatatttgaatatgtatcgtgccccctccggtgtctttgatcaggatgacatgtgccatttttcagaggacgtgcagacaggctggcattctagattacttttcttactctgaaacatggcctgtttgggagtgcgggattcaaaggtggtcccaccgctgcccctactgcaaatggcagttttaatcttatcttttggcttctgcagatggttgcaattgatccttaaccaataatggtcagtcctcatctctgtcctgcttcataggtgcccaccttgtgtgttttaaaagaaagggaaagcttntgtacctttagaagtgtaggtgnnaaatgaatgnnaatgcgcttggaaggtgcactagagacacacgcatattgattctcttcgctttggggnnaaaaaaagaaatgatcgcatatgaaactntggtggnngtgggtggtatttagaagaaagaataactcatgtgcgttattgctcacaataggagcgtagatatttgtaataaannnaaccccnanaatatcacaccgcataatgaaaagtgcgtgggcgcacaggttgtactctttttatcttgatgtgttctcctcacacacctcaaaaattaagatgataattaaatttttatattaaattttcta

SEQ ID NO: 540214 - DNA, 1910 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (1851)..(1851): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaccttctttaatcagtctgaattcaggttcaccttcaattttgacttttgttagtgtgggtccttcagttttgataataggctgaagactgccttcaatcactttaatttttggttccacaactttggttataattttagttgtatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcaggtgataaagaatgatgttttgaagagcatttttgtcccgtatcagaatttctttttcttcactagtcattcccttaaaagcatcattggttggcacaaataatgtccagtctccaggttgtgtcaaangaactttcaagtctgcagcttcaagtaggctgagagggtttcttagcgatagtttggct

SEQ ID NO: 540215 - DNA, 1848 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctcttatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcagctcgtgccgaattcggcacgaggcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatga

SEQ ID NO: 540216 - DNA, 340 bp, Homo sapiens
aattgtaatgtccgcatatgggccctgtatggatgtaacacaggtggtttgagggtgtcctcttacaacatggctaggggttcttatcaacaagagtgtcgtgtctgtgcatacgctattattagcccacgcagttattccctgtaaccgcccggggctctcggtaatggttctacataatcacactgggttgtactcccgttttagccactgtgcgaggataccgccacgctaaagcggagggttagcctttgctcccacaagcccctggttcgcctccattaatgttatcaaatccccagtgcgtccaacccccacaacccccccgggccgacaatca

SEQ ID NO: 540217 - DNA, 272 bp, Homo sapiens
tcgtgtgtctgttaatagtgtgaaattgtcatgggggaaaaaaaaaacaggacccaaaggcgaccttgggcatatatgggaagctgaaaatcttcaaggctactgaggggggcccccttaatcttgcctttgattgctgcgggcagggaaaggtgcccccgtctgttcatgctgttttggggggggggggggtatttgcaagaatactcattttgacataataggtcctcttgtcagagatcctctaccacagacattaatagctgagcggg

SEQ ID NO: 540218 - DNA, 314 bp, Homo sapiens
tctcgctacacattatagtgtcttctacacatgcggttgaacccgtaaagtcacccacaatggttgaaacaacttcttccaaactcttgtaacactgctatttttatctccttccctgaatcatgaatgctgttaatggcatctggatggtgaatcatttccagaagactttccattcattttgcccaggtccatctgaggaatcattatctatggcagctgaagccttacgaaacgtatttcttaaatagtaagaacttgaaagttaaagtcactcctttgatccatgagctacagaagggacactatgttag

SEQ ID NO: 540219 - DNA, 2857 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (2559)..(2559): n is a, c, g, or t
  misc_feature (2656)..(2656): n is a, c, g, or t
  misc_feature (2705)..(2705): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctccatggatcacttcagttattgtttcaactgctggaaatacttaataaattaatcaaatacatccaaattaagtttgttcgtggtagcaccttcaaagaaatccccgtgactgtctatagacccacactaacaaaagtcaaaattgaaggtgaacctgaattcagactgattaaagaaggtgaaacaataactgaagtgatccatggaggtgcgttccttatgttacctggggccgactaccttcgctgtgattattttgaaatagtgttggtttagaaatattgaacatctgatattttctcttagttcttattttataaaaattgtgggaattatttcctcagctatgagttcttattagctggtcagaaataaaacatagttagcttttaatggatctagttggaattaatttatctattaagtcactgggcccaacaaaatgtcatgatttttgcatatacaagtgaggattgtggaataaaattgtaacattaatgtcagtataaaaggaaatattagaaacagtaggaaaaaatgaccattgtataagtctctgtctaataagccactccactactaggatttatgatagggctcccattccaatgatatagaactccctggattctcactaagtatttattccacatccagaaaacaagtatggcatggagagttaggatgtcaaatggccctctctctcaaccaagattcaggacatagctattaccttttagatccctattgatatgatttttgggggatatgttctaaaaatgtttatgattgaatcttaaatggtaatatttgtagaaatatagttaatcattacaatgtctagcttatggatgtatagtcacaatatgagggtaaatcaaatgcatttgtattcccctgcttttagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagagaattgaaaacatgtatataatagaaaaaactggacttcatgctgagtatagatgatacatataaaagangtcaaaatttggagaaaaaatttaaaaagataagtagaaaaatgaagtaactgtagaaaccatacttactctttgatctcaaatgcccaaaaactgnatgaaaatgtgaatttaggccgaccaggtagtcttgtcaataaactaanagaaaaacaggaaaattgagaaatatgttacaactataacaacacaaaacagcatagttttgaaacacttgcagttcttaaatataaaagcttttattagttaattttttaaaaggatctcataggagtgacactgaatcaggttgggagag

SEQ ID NO: 540220 - DNA, 619 bp, Homo sapiens
  misc_feature (159)..(159): n is a, c, g, or t
  misc_feature (197)..(197): n is a, c, g, or t
gattgcgacctcgtcgatgccggagtcagagaggaacgtggctacgaaagcctcggagtgaagttcccagaccctacgccccgctgtcaggcagcccgccgatcagatggaggagaacgaggtggagagcagcagctgactgctggcccctgtggcctngcctggcccgaggatgccctctgagagctgtgccttgngttgttgggcacctcatgaatgcctgtgtcctgcctgacatgcatgctgactgcctgctgtggcctgcccctgtgtggcatgtgcatgatgtgcctggattgacttcttgtgctgttggtgtgcaaatgcttcgtgacctgctgtgcatgcctgttctcagtgaggaggtatctgagagcagctctgagctgcagaccccctgcctaatagctacctccctgattcatctgtctgtgtctcattgtggccatgtggcatggggtgacatgtgcgtgtcccccatgcacttgtgcactctagtgcactcccagaccccaacatgctggtgtccgacatgcacagcttcctcctcggacctgggctcggccatcgacaagatcatacgagtccaccatcgggcccgacctcatccagaactgca

SEQ ID NO: 540221 - DNA, 371 bp, Homo sapiens
aatgagaggcggttttcaatattactttaattttattttagagatggagtctcgctcttgcccagccagagtgcagttgcgggatctcagctcactgcaacctccacctcccgggttcaagcaattctcctgcctcagcctcctgagtagctgggattacaggcgcgtgctaccaagcccgtgtaatttttgtatttttagtagaaacggggtttcaccatgttggtcaggctggtctcaaactcctgacctcgtgatccgcccgcctcggcctcccaaagtgctgggattacaggcgtgagccaccgtgcctggcctccaacctttttttttttctataccaccttcagggtgagtttggaatggatgga

SEQ ID NO: 540222 - DNA, 1825 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (1766)..(1766): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctcttatagacagtcacggggatttctttgaaggtgctaccacgaacaaacttaatttggatgtatttgattaatttattaagtatttccagcagttgatcatttccaacaggtgtgtctgctggatagaggagtttatctacaacatgaattacaccatttgttgtcatgatgtcagattcttttgatttcaattcattcaccagaagtgtatcatttacttctttcagaaagattttgcttccttgtgtggtctttaaaatgttagtaacaccaggttcaaatccttttccaatgaaaactcctggtgtcaggtgataaagaatgatgttttgaagagcatttttgtcccgtatcagaatttctttttcttcactagtcattcccttaaaagcatcattggttggcacaaataatgtccagtctccaggttgtgtcaaangaactttcaagtctgcagcttcaagtaggctgagagggtttcttagcgatagtttggct

SEQ ID NO: 540223 - DNA, 380 bp, Homo sapiens
gctcgacgttcacattcatagttccacatacatgtgtgtactgaatatctgggtctccagcaattacttgtgctgtcaaagacttcaataatagcaggttctcattcatatgcttaaaaagtcaatctcatggaggaagaaagtagagtgatgattcccagaggctgagaagggtggaaggacagggatgagaggttggttaataggtacaaaaatacagttacagatggaataagtgctagtgtttgatagcacagtagagtgactactgttaacaataattcattgtatatttcaaaatagctagaagagaagaaccggaaagttcccaaaacaaagacatgataaatgtttgaggtgatggatattctaattaccct

SEQ ID NO: 540224 - DNA, 1473 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (1406)..(1406): n is a, c, g, or t
  misc_feature (1457)..(1457): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtctccctgaagcagtcttttaatttcttcatcttcaaataaatgaccatcaccaccttcaatgaatttggtgaccttggtgacctcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctaaaagcaggggaatacaaatgctttgatttaccctcatattgtgactatacatccataagctagacattgtaatgatnaactatatttctacaaatattaccatttaagattcaatcataaacattttngacatatcgtaaatca

SEQ ID NO: 540225 - DNA, 1389 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
  misc_feature (1322)..(1322): n is a, c, g, or t
  misc_feature (1373)..(1373): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccttgaacttttttgttggcttgcaacttcctcacgggtgtgtcttcttgtaacaatttcttcagagtttcttctgtttctccacctccagtagaaatcctagtgtattttatttcaggacctgtaatgattcgttcttctcgtgtctctttttcagttatttccacaggcactccatcaatgattttggtgtattttttaataattggctctaaaagcaggggaatacaaatgctttgatttaccctcatattgtgactatacatccataagctagacattgtaatgatnaactatatttctacaaatattaccatttaagattcaatcataaacattttngacatatcgtaaatca

SEQ ID NO: 540226 - DNA, 124 bp, Homo sapiens
cagtgatgcccaaatggcaaaattcatattttaatgtgatttacaagactagatgacagaaggattctgaagactttaaaaggtgttacagtgatgcccaacatggcagtgatgcccaacatgg

SEQ ID NO: 540227 - DNA, 718 bp, Homo sapiens
ttcagtgcgtaatggatctatgctataaatgcctgtctcgtaggctgagtcatgaagtgtgagcgaggatgtgctcagtcgccaaaagacatgtctggtacctgtgtggttaaaatgtaaggtagctcgtcttcaatgtggcgtcgctgatgtctgataaggtatgtcagtgtgcaaaaggctttaccttcagaatggtttatttatagcaaaggtaagtgtgaaaattttagacaaagtctctgtgggtggatgtaattaagtgtcagtgttgtggccgcgagagccatgggttttttttaaccccaaggttatccacatggtgtgtatgatgaattcttgagaactcgttaaggttttttgtgagaaaaggagggtgaattcaagagacaagtaaggcactgtgtgggtgcactagatagagttctgacagatgttgtgattcgtgtataggatttttaataatgacaagattcacaaaggtttattaactttttaaaagggtaacatgcctagttaactggttgcagtgatataccagaaatatatgggttcgtaagtactaaaatgcaaagcaagagtgcaagttttaaaatctagaaggttagggggttgaggggggaaaaaaatgggatggtctttaacctatgcaggttacggggaatttggtgcctagaactcgcgttgtgacatgaattgaaacagggcccggattaaa

SEQ ID NO: 540228 - DNA, 1329 bp, Homo sapiens
  misc_feature (230)..(230): n is a, c, g, or t
  misc_feature (232)..(232): n is a, c, g, or t
  misc_feature (234)..(234): n is a, c, g, or t
  misc_feature (240)..(240): n is a, c, g, or t
  misc_feature (244)..(245): n is a, c, g, or t
tctcttcctccctgtgttctttgtttctttgttctgtgtttcttgcttttttgcttttcgtcccttctattctgtcctggtgtgatagtgcttgactctcgccacccgtgttaagccgtcccggtttttgggggacccaccgttgcccgtgttctgtgacccttgccacttacatacaatggcgcgccccaccgaaggtttaaatttttgtggccaagccgcacacattntntngtgttntttnnttttacttcaatttcctttaatgagtacttgttacagtaaaagaggtataaagtcctgttcccaagtccaaaccactttttaacttaaatcttgagtttttctgaattactcaatttgaagtaattctctttatatctgaaaaatggttttattgaaacgtttgagattaaaaaatatgcattgcaagaagcatatgacaaacattctgagagtacaaaattagttgtaaaaaataacataatttaccagtaaacccactcatatagaaatgtgcaaagccttttgatataaaaagttttgtacaccaagcacctatttttataacttagcttcccatggagagataatggcttgcgtgcattttatgtatccataacatacatacaaggctcggtcttttcaatgggataacagttcacaactcttcgatttgaattgtaatgaatctggtgacaaggatttttctctaatggattccaaagttagccagaacttttaatgtcaagatgaaaaagggtgtaaggtgttatattttcttcaattcctttaccacaggaggctaactccacaatttccctcatgtttctcattcagaaaaaaaaatattaaatttgtgttcagaattatttgatgattgcttctttgtgctgatgtttcagttcctgaagtcaacttggctctcacaattttctaaggtcaggttattgacttagggttgtataaacatttttttctggtttttggattttcactgagaacgaccttcccttaatcgtcttctagatccgtaatgtagaaagaaacggagaatgtatagagctgtaaactgttaggaaatgtttaaaatttacagaatatattattgctctggtatgatgctatgcagaggccattgatttttgtgtgaataaaccttgagattatgttttgcttgaatgatgcttgcaacttatggtgaagcaaatgattatattttggatgcaaaagtatataaaataataatttgaaatgttaatgaattttaactctttagaaaatttgtgtcaatttggatatttacatagatttactgacacattcttt

SEQ ID NO: 540229 - DNA, 508 bp, Homo sapiens
  misc_feature (235)..(235): n is a, c, g, or t
  misc_feature (440)..(440): n is a, c, g, or t
cctctgtgagtctggatgaagtgagtctgctgtcctctgtcttcgacagtgtgtgctcataatgttgactcttggtctctagaagcgtttgaaagactaggctattttttaagaaattattttcccacattgcctcaaagctaaatatattatgttttcattctctaaaaactgataatcccaatatgtatggtaattttgaattattaggctatttagtctccatgctggttanaatgggaaactcctgtccctgtgacagaagttagttggaagttaaaacaactgttatagttgcttctattaaggatataattgacgctatgggaaatacactgcttagctttggtgcagagcctgaatgatcaatttgccaaaagactgattcactgaagactgtcagccaaatatcttaaatagagctgggaaagttcttgggntgggggagggagtagcagatgcagatttaggagtctgtaaaagtatgagtccatacagccacaaaaaa

SEQ ID NO: 540230 - DNA, 1092 bp, Homo sapiens
agcgggcttggaacccgagcctccgcggaaggtagccgttccctgacctagccatggcacagaacactgaaaaccacgacctgtcggatccatcttaatccagatccatgaagacctttatcagttaaaggacgcaaattagcaagaattctcacctgcaggaacaacggatgagactcctagacattcagagtcttgaaacagcaatcaaacaggactgaagtggggtaaaggaactacacatttgagacgtaatttaaactgcttgtaaacgcagacatgtactcaacgcacttctgtacaaattgatgacgagccttatatactcccccaggcttccaaacatggctatacttcccaactgtaaatagactcagaaatcagtctataatgcccactcaagggaactcttgcagagcgttaccactacttgcgaaaaccgcaaataggaccagcacaaggttacaatcctacttgcccattggtctatcccaaggaacgcaataagcggacagagaatcacgggggttggaacttgaacaaaaagtctttgccacgggatccctggacaacagccagttagtcaaccaagaatgaaaggctggcctctgggtagaagattggcctgaacacctaagtgcgaaagtccacgaaacgaggcgccacgtaaggtacataaacatccagaacgaaaaaaaggcaattgcttagtctacaccaggtttaacggcacacgataaacatacaaaagagggtacaaaaacaacgtaaatccaaagaacaatacacacagaggacaaccatgccacaaaatcacgcgaccttcgaatcatgtccacgcgatggaaatcgcgccgtaaagattgataccagcgttcccataaatacgcgcaaggttcagttgaaacagacagagcaggcaactgtcccagcaaagcaacagaaggaggagatacactgacgaggataagatgggaaaccagaaagcgcaaacggggccagcaacttacccaccacaaacagagagcaaacagagcagcgatacaagcacgcacagcgaacacatacacgccaccgaacagcaaaaacagc

SEQ ID NO: 540231 - DNA, 339 bp, Homo sapiens
tggtcgacctagagatccccgtcagcccactggtgatgcgttgtgcatgattgccaagtaactgtcagatataccttttcccctttaggcagttgtactgaagctatttgaatagggaactaagaagacatatcgttcaagagcaatattggacctcttagaatacatcagaaggaggaggaaacagtgggttccagtctccactgttatatatgccatttgatcagatgagtgggaagatacaaggactatcttgtctacaagaagaaggggccaagaggtccttgttcatcagctccttcggaaaaggcaggatttcatgtcatgatacaggacttg

SEQ ID NO: 540232 - DNA, 1334 bp, Homo sapiens
gaaaacaccaaatggcggatgacgccggtgcagcggggtgggccctgggggccctggtggccctgggatggggaacctgcggtggcttccgcggagtgtttcggcagtgtgcatccgggggcctggggtcgcgtgccgtggactgtgggcctgggtgcctgaggcctgctggagctctgcgtgaggcaaggcctgatggataatgtgatgtggattgccactgtcaccaatgttgggccggcttggtcaaagggacattgaaggaatcaaggtccctgtaatggagatctatactacttcctcccatgacccatttacagtgacatcaggagatcatttgcatttcttccttggtggtgccgtctctcaaaggcattgacgggtaatgagacagaattatagccaagtgcagcaaagcaggacccgtgccggcacaggcgcaaaccagaggttacaaggccattattgtcatgcatatcgcggggacatacaatttgtgacaacgtcagagtacttgggattgtataaagttgctcccaatggacagtgtggtctcacacgtgcatccggctggggtagacgatcattccgtgagccaaatggctcttccatccggtcacccgatgcacgcaagcaagagcttacttggagggaaccaacgattcggtcaaagccccacacaacatgttcccctttgacatagggttgacagggacctgctatgcagggctcctggtgctaggttacaggcactcatacccttgtcacccacaaggggtgcacctggggcattcggtcctccgtgcaacccttgttggccctatagaacgcttgcttctaatcgcagttggggcgtgggttattcaggactgaactttgcattaacacaccttccagtagccccgtggggggcgattgcaacattgacccacgcccgttggtaggccaaatctttccgacctaagtggcccacaggcgttattgacataggccccagttattaccattaaaaggaaaacccttaaccagtggtgtatacgcctttgaaacaccgccaccgtgaaacgccatcactgggggaaaagagggaagcaaaccgtggattattttcccagacgcgaaaagtgatgtctatcaccctaatctcacgtgggtagtgttatcacaggtgacacacaagcctattcggttacacaatgaaacgccgagacaacagacagaaagagtttcattccagtgtgcacagggagtggaacatcaccgtggcctatccaatgacactagtattggggtatagccgacaacagataagcgggagtatttctacatcttac

SEQ ID NO: 540233 - DNA, 457 bp, Homo sapiens
tgtatgctcagtgaagagctgaagaccccgtgtggtggtggggaggaggctctgtggattcttgtgcttggcaggtcagcatacagtacgacaaacagcacgtctgtggagggagcattctggacccccactgggtcctcacgggaggccactgcttcaggaaacataccgatgtgttcaacttggaaagtgcgggcaggctcagacaaaattggggaggtttccattacctgggtgtggggcagatcatcatcatttgagattcaacccctgttacccaaagaaaatgacattgacctcatttaagacttggagtttcccactccatttctcaggcaccagtcagtggcccatctgtattgccctctttgatgaggaggtcactccaggcaacccactctgtatcatatggatggggctttacgaagcagaatggagggcagatgtctgacatact

SEQ ID NO: 540234 - DNA, 129 bp, Homo sapiens
acagcatccgcaggacattgtccgggacaccctacaccacctcgcctttggagttcctgaccaccatcaccagctgggcctcactggtgatgatcagcaccagcccctgctccatcatcttgctgcatg

SEQ ID NO: 540235 - DNA, 224 bp, Homo sapiens
catcacaggaagtaggtaacatgcggctggaatagccaggagtagtctggaaaagtagaataatgaggtagggcttcccttcgctatttggaagtgcagataacactatgtaaaaccattaggaactgtcacgtgactagacagatcaatagttaatagcagtattagccagaatgtggggtcaggacgataggctaactagccctgtcctcattacatgccat

SEQ ID NO: 540236 - DNA, 353 bp, Homo sapiens
  misc_feature (277)..(277): n is a, c, g, or t
gtacttgccgtgtgctcttaaaactaggcggctatggtataatacgcctcacactcattctcaagcccctgacaaaacagcatagcctaccccttccttgtactatccctatgaggcataattataacaacgctccatcgtgcctacgacaaagcagacctaaacatcgctcagttgcatactctatcaatacagccacgatagccctcggtagtaacatgccattctacatccaaagccccctgtaagcttcaccgcgcgcagtcattctcataantcgcccacggatcttacatcctcagttactattctggcctagcaaactcaaactacgaaaacggcatcttcatcgg

SEQ ID NO: 540237 - DNA, 224 bp, Homo sapiens
tccaggcatgattcctgacgcagctggggaggattgcgtacttactcacagacaatgacaggcactcttatccagaactgagatgattttcaagacggctccatctcggaacagtagcctacggtctcgagtcaatggacgaagtacaaatgccacattttcatgcatttacacccagcaaagaaccacacgaagaaccacaggccagcagcaagaaccacacg

SEQ ID NO: 540238 - DNA, 214 bp, Homo sapiens
cgagctgtttgtttccccgcctggaaaaaatgttttaggcaggttccttaatttttcaggtctgtctcagataataaaaagctctttgtatgagcctcaaaactgttttttcagtgaatgaaattcccagtccttatacgaaggggctttaaaaaatttgtggaaatcctgaagtaaaaaatgataaaaaaataaaaactttattttttggcca

SEQ ID NO: 540239 - DNA, 312 bp, Homo sapiens
  misc_feature (92)..(92): n is a, c, g, or t
ctgcaagaacatgaactcatgatttttcatggctgcgtaacattccatggtgtactctaattcgtacatgtacaaattagaactacaggatnaagaaactcacttgaaaccacacaattatatggaaattgaacaacctgcccctgaatgactactgggtaaataacgaaattaaggcagaaataacaaagttgtttgaaaccagtgagaactaagagacaacgtaccagaatctctgagacacagctgaaatagtgttaccagggaaatttatagcactaaatgcccacgacagaaagctggaaagatcga

SEQ ID NO: 540240 - DNA, 250 bp, Homo sapiens
cgtactacatacatttcgtcactagtagaaacctcctggcggtggagatggaaggaaaataggtgacatcaaaatattaaaacaacttaacaacaaatataaatcagagtaagaagcatctaccagtgtacatagcaagggtaggaaagcaaaggcacacacgggtacaaggaccctcaccccacacacaggggggaacaacactggggagaaatactctactgcagaagaccagctcaatacatgtgga

SEQ ID NO: 540241 - DNA, 727 bp, Homo sapiens
atattatccaggagaacttccccaacctagcaagacaggccaacactcaaatttgggaaatatggagaacactgcaaagatactccttgagaagagcaaccccaagacacctaatcatcagattctccaaggttgaaatgaaggaaaaaatgttaagggcagccatagagaaaggtcaggttacctacaaaaggaagcccatcagaccaatagcagatctctctgcagaaaccctacaagccagaagagagtgggggccattattcaacattcttaaagaaaagaattttcaacccagaatttcatatccagccaaactaagcttcataagctaaggagaaataaaatccttttcagagaaggaaatgctgagggattttgtcaccaccaggcctgccttacaagagctcctgaaggaagcactaaatgtggaaaggaaaaagtggtactagccactgcacaaacacaccaaaatataaagaccaatgacactatgaagaaactgcttcaattagtgtgtaaaataacctgctaacatcatgatgacaggatcaaattcatgtataataatattaaccttagctgtacatggcctaaatgccccaactaaatactaccgtatggccaccataattacccccatactccttacactattcctcatcacgcaataaaaatattagacacaaactacagctaactcctcacaaagccataaaaaaaaaaa

SEQ ID NO: 540242 - DNA, 285 bp, Homo sapiens
  misc_feature (249)..(249): n is a, c, g, or t
gcgtcgaccctgtagtcccggcactctggggggccttgcagaaggatcgcttgggctcaggagttcgagaccagtctgggcagcatggccaaaccctgtctctacaggaaatgcaggaatgagccaggcgtggtggcgtgcacctgtggtcccggctgcttgggaggctgaggtaggaggatggcttgggcctaggaggcggaggttgcagtgagctgagatcatgccactgtactccagcctgggcgncagagccagaccctgtctcgaaaagaaaagtcgacg

SEQ ID NO: 540243 - DNA, 275 bp, Homo sapiens
aaagcaggcaggaagaatttgaataaggctgcagagtctgatgtgtccacagccattgagctttacagacaagccggcctacggcaatcatcatctctggaagtgagcggatgaccctcctggctacccctaaattctgtattcaaagatggaaaccctccaatagatgcccatacaaggaattagcttcggaaccacataattaaagaccagctggcctctaagtatctgtaccatggacagaccctggaaactctgggcggcaaaaaactgag

SEQ ID NO: 540244 - DNA, 385 bp, Homo sapiens
  misc_feature (31)..(31): n is a, c, g, or t
  misc_feature (310)..(310): n is a, c, g, or t
acaaaggaagcccaagaaaaaaaaaacaaanggaagcatgaaccatactggctaggccaggaatcaggacagaggagatgctgatggtcagtaaacatttttagtgccctagcacaggggtcctcaatccctgggccatggaccggtacgggtccgtggcctgttaggaaccgggcggcactgcaggaggtgagcagcagggagcgagcattaccgcctgagctccatctcctgacagatcagcagctggattcgattctcataggagggcgaaccctcttgtgaacagcgcatgtgagggatctaggtngcacggctccttattgagaaatctaaccaaatgcagggccaaggtgcgggtgggcttcacgccctggcaaatccc

SEQ ID NO: 540245 - DNA, 204 bp, Homo sapiens
gtcatgctccagctgccatgatacaactatcttgtacacaagtgacatcacagtaactctttccccagagaggaaacaaagtcctggggtgatgttcacccttcttgagcacctgtgcctgccttcatgccatgtgaaactacaagaagtctgcaactcccaagaaggtctttgccagaagctaaccttgctggaaccctgatc

SEQ ID NO: 540246 - DNA, 952 bp, Homo sapiens
gggagaccgttcaccctgatcagggagtatcggctgcgggtgcgcaagggtccaggagtgacctgcggttgtggaaagcgacccgtgactggtgtacagagtaccacctaggatgatttcgggtgactagatcagagatcatagatgagctcagtcggtatatcagtcgtcggatttagcagtaaaagtaaatagggttggggtggtcaaccggggttaccatgatttctcaagttctctattcagaaacttaggaaactcttactctaaagggaacacaagggggtttcaagtctttggcaaagttaaagaagcacgaaaggattgtgctctttactgaagaagttgaaaggattttgtgccatgacggtagtggaaattgattggaactcatacaaaattgtttggaatgaattcgaatggcaaggcataaagagttttcttgggaagcatcgtgtggtgagatgaagtgcatagattaacaacagtgttcttaagaagcgtcagacttggggaaccagggcctgggttctataccagaatggatggctaaagagatatttgtcccgaggttcaagtggagttgcacacacttactgaggtcaagggtggggactattgacatattgggtctctaagactgccgtttcttattagaaatacttggctatcagaaaattatttacgaaccagagcaagtgttttgaatggtatgagttgggatggatgaacggaggattaggaaacaggtgaggctaaggatgaaagtacacgggttcgagggtggacagttgggaaggagcgtgtaataattctcaccaggaaaggtggagtttaaaaaaaccggcaagggtaggtggattggtatgaagttgtaagggcagaaggtatacacgggagtgatgtcgtaagaggggggataataggacgacatatagggaaaggataggaa

SEQ ID NO: 540247 - DNA, 221 bp, Homo sapiens
acctcttgctggaccctctctgcctggaccctctcttcaaagctctcttccccacaaaagttcaaggtccagacaggccgtgtgagcctggaccccgagtgcctggcagaaaaataacaggatgaggaggtgactgctaggatcctggcgctccccagtcttctgcggttccgccaaatcctctgccaaattcaactgatgagaaacaccttccaaagcgg

SEQ ID NO: 540248 - DNA, 1496 bp, Homo sapiens
  misc_feature (619)..(619): n is a, c, g, or t
tctcccccccccctttttttcccttggggggcccggggacccctttttcccgggggggcgcgtgcctcccctctcccctcgtgatgtgctcccccctcgtggggacccctccccacatacgtgtgtgtgtggccccactatttccaatattttataaattacgcgcgtgttctccccgcgcggggcgcggggtgtgtgggaaagagtctccctcctctcaaaaaagagatgaaacgtccccgctgtgtgtgtgccgcctgtgtctctctctctctctctctcgcgagagagtatctccttgtgtgggcgcgccgagagacaccccccctgcgctgtggtggtctctctctcttgagagagagagagtctctctctctctctctcttatatatctctctctcgcgcgagagagagcctctctcgcgacgagggtggcgctgtgcgcgagtctgatgatgggagagaacacacactctctctctcaagcgcgatggagagagagatatcacagcagcaggtgtgtgtctctccccctctctctacatgatgagtgcgccgccctctctctctctcgagagagccgctcgcgtgatggtgtgtgtgagatgttctctctctncccgcgcgcgcgcgcgagagagaacacacgcgcggtgtctctctatatatagcgcgcgcgtggtgtctccacacccgcgcgcggcggtgtgtctctctctcgacaaatatgtggcgcgccgcgcacacgagacgagagagaaacaccgtctgttgtggcgccgcgagagatctctctcactatagagagagcgcgtgtgtggagcgcacacacagagggggtctccccccacaaagaacaggcgacaacaaaaaattatcgcgcggagagcctgctgtagaaaacaccccgtgtggtagtagaaaccacaacacgagaacacttgtgcaggcgacacaaaaaagagagaggagacacccgccgtggtgttttccacccaagagaaatatatacaactcccgccgaggggggaaaaataagtgtcaacacaccacaaggagggggggggagcgacctttacacaacaccacgccacaaataaagatgtgcggcccacggacgtatgaggaggagaaaagtccacacccatcaataaatgaggggggaggaagaaccaaccaactttggtagcagcaagagagaagaaagaaaaacactatgctcctctcccttcaaaaagcagactcaacagggcgcggcgcacgccgggcgctcttggttgggcacctgcggtggggccagcttgcgcgtgtggggggccccgcccaccaccaatattgtgggtggccccccccgcactgtgtttacccacacgcgggcgctgcggcgcaccatagtatggtggttgtttgcgtgctgcccaccctcttcttgtctttgctgttggcggcactcgtgtagcaaaaaacggtcgcgcacattgtggggggcgcgccca

SEQ ID NO: 540249 - DNA, 420 bp, Homo sapiens
tctacattgatgcatcattattcgcctgcccgcagtccatggtttacattcaggttcactcttgttgtacattctgagggtttggataaatgtatgacatgtatccaccattaattaagttgcataaagagtagtttcactgtcttataaaatgctctgtgctctgcctattcatgcaaccctctctaaaacccctagcaaccactgatcttttaactttcttgatagttttgccttttccagagtgtcatataattggaatcataaaatgtgcagccttttcaggatggcttcttccacttggtaatatgcatttaaggttcctccatgtctttttatggcttgatagctcatttctttttagcactgaataatattctactgtctggatgtgccacagtttatccatttgtcgacgcg

SEQ ID NO: 540250 - DNA, 377 bp, Homo sapiens
  misc_feature (351)..(351): n is a, c, g, or t
taaaggctttacattggatacacactatggaaaatcaatttaaaaaatagcttcccagtaatatatttaaagtaatatatttttaaatatttgtaaaaagggacaggtggaagaactttgaatttctcatatagtaggtatgtttggatgtaggcacctcacgtgttagggcacaaattatttcaaaaggaagtaactctaaagacactcagattatttcagaaaaaatgcaatagggggaatagtttgggggttaattttttattttaaaaagaaatttgacttatttaccacaagctatttttttccccttcgtggcgtgtaaaggtttgggtacaggacgaggtttgngctaaatgtgtctaaacacaaaacac

SEQ ID NO: 540251 - DNA, 150 bp, Homo sapiens
gaattgagggaaaaacaaatagagaagaaagaaatcagaaccttacggtagtattcaattcaaaatcaacgatatcatgaccaatttattattttggtttttttcccccagttccctcaaagttcagtattcaatttctcatccggggag

SEQ ID NO: 540252 - DNA, 544 bp, Homo sapiens
  misc_feature (416)..(416): n is a, c, g, or t
  misc_feature (422)..(422): n is a, c, g, or t
  misc_feature (447)..(447): n is a, c, g, or t
  misc_feature (460)..(461): n is a, c, g, or t
agatggtttctctcaaggactactgcaccagaatgaaggagaaccagaaacatatctattatatcacaggtgagaccaagggaccaggtagctaaacttccaaggccccttttgtgttggggaaaccggttctttccggggaaacatggcttagaagtgatctatatgattgaggccccaatttgggaatggaggtactgtgtcccaacagctgaaggaatttgaggggaagactttaggtgtcagtcaaccaaaaagaaaggcctggaacttccagaggatgaagaagagaaaaagaagcagcgaaaggagaaaaaaacaaagtttgagaacctctgcaaaatcatgaaagacatattggagaaaaaagttgaaacaggtggttgtgtcaaaccgattggtgacatctccaatgncttggntatttgctccaaccaaaggccaccnattattggctggnnacagcaaacatggagagaatcatgaaagctcaagccctaagagacaactcaacaatgggttacatggcagcaaagaaacacct

SEQ ID NO: 540253 - DNA, 154 bp, Homo sapiens
catgatctctggacggattctttggatatgtattctattgaggtgctcgcggattctccgtttccttctcgtgctgctggtgttcggggggccctcgcgcgtatcgggcggcggggatagtgttacggcaatcttggcgggttcttatgatttg

SEQ ID NO: 540254 - DNA, 541 bp, Homo sapiens
cagtacggattattggggagtaggtttggttatccaaggagcagtgtgagctccttgctattgggatatgggatgctggtgatttccagtaagtgacctcgaaaattactcaagctacacatactgttgattgtgatgaaatgccagttgaagcacctgtcctgcgagcttaggggtgctacaagttgaccactgcagcagtaaagatgactctgaagaatggcatgggatggatcctttcgaatgcacttgagcagcggtctccaaccacagggccacagagctggagctggatctaccatgaaagacctctgaatccaggaagagagattgactgagcaacatgtaattcgggagatggggtctcagcctgtcacccaggcttgactacagtaagtgctatcacagctcactgcagccttgaactcctgggctaaggatctccttactgagcctcctgagtagctaggattgttcctctgtgtccaggcggaggtagtagtgtatcaagtgatgagctcaactccggtgagggtctccc

SEQ ID NO: 540255 - DNA, 1510 bp, Homo sapiens
ggcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540256 - DNA, 220 bp, Homo sapiens
tccctgccaattgtgccactccgtccccctaagagcccgatgcctctgaaggtgctgggacaccagtctgccgctgcactatcttcttggcttacctggtgctgcctatcggtggtgagcgaatcccccattactaaatggactctctccactaccccgactatccctgcacagtaactccgatattttttttttttttttttttttttttttttttttt

SEQ ID NO: 540257 - DNA, 510 bp, Homo sapiens
  misc_feature (12)..(12): n is a, c, g, or t
tcactattcaanatgtcttcgtattatcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540258 - DNA, 261 bp, Homo sapiens
tttaggttgagtgtatttattgatttattttcaggcagggtctcgatctgttgctcaaactggagttctgtggcgcgatctcagtttactccagcctccacctccccggctcaagcagtcctcccacttcatcctcccaagtagcttaaactacaggtgcatgccaccacatctggctttttttttgtattttttttttgtagaaatggggctttgtcgtgtggcccaggctggtgaaacccagtcactactaaaattcca

SEQ ID NO: 540259 - DNA, 373 bp, Homo sapiens
  misc_feature (224)..(224): n is a, c, g, or t
  misc_feature (297)..(297): n is a, c, g, or t
acacccccctcgggggttttttatatagcagggtacgcgatttgggatattcgacaccgtcgctgtgtcgctctcgccaacaagcaggcaaacccctatcatcggtctcctgtggctgggacaagctggtcaaaggtatggactggctaactgcaagctgaaagaccaaaccacatttggccacacaggctatctgaacacggtgactgtctctccagatgganttcccccttcctgattgccttatccttgggaacggcgccaaaacgggaacttggggcccaaaggggccccaantggttatacttggcggcgaattcgttcaaaaccgaaaaggggccaaaacaaccctttgtaacaaccgccttaggat

SEQ ID NO: 540260 - DNA, 1184 bp, Homo sapiens
cagcgcgcaagctcgcctctgccctcaccaaacgcatggcggccccgcgcgccgctcgcccaccctctcgctaaccaactggcaaccgcggccgctcgcgcccgacttctcgccagcacgcccatcagactctacgcctcctcctgcactgcacacgccgcgcacactcgcgcgaaacccgccgcgctgccacgctcggcacgctcactaacgcacgcgcgctcgcgctgcctctgccacctctgctgctcccttgcgagcgcctgcaccacccggccccaccctgcccccgccactgcctgcctacaccctgccacgctcctcctgcacccgcacagcgcgcaagcgactgcccaccgggccacactggcaccccccacacgcgccaccccaaccccacctctcacaccaccccacgcgccctccaagcgccctccgcactgcaccccctcacgccaaccccaaccccactcccccctcacccactcccaccgctcaccctccccccaccaccccgcccccaccgcaccaccgctgcgcccctgctccactctcctccaccctcccccgcccgcacccacaccctcccacccccccctcctcgccccctacgcgccacaccaccacccaaaccagccgcacctccccgcgcccaccccccaacccccccccccaccccacctccctcccacccacccccaccacccccccacacccctgccacaccaaccccccctcaaccactcacccacctcccacccctcactcccaacctccctccccacccccccccacccctcctctccccccccttcccctgcctcccccccccactctcccccccccaccccacctccccccccccccgcccccccccccccccccccccccccccccccccccaccccccctcccccccccccccccccccccccccccccccccccccccccccccccccccccctccgccccgccacccccaccccccgcccaaccccaccacccccaccccacccccacaccctaccccccgccccccgccccccccctccccgccaccccgacctcccccctcccaccacaccccccacctccccacactcccacacacctctcaccccactaccacactctccccacccctcctcctcccctctcccctccctccccccccctccctct

SEQ ID NO: 540261 - DNA, 325 bp, Homo sapiens
  misc_feature (5)..(5): n is a, c, g, or t
cgtantacacttccacaagctctcaagaaaaagcagacggataactgatgtgaatcggacagtttctatggcttttccttttttccatcccttcccgaccatcaaaagcatacctgctctaattaaaaaaaaaaaaaaaaaaaaatccaagtccagcggattggtgggtaagccgcactagaagggtatacatagtaaggtatatttatttacatacggaagtcctaaatttatattagaaaatggtaaataatcggggggtaaacatttttggaagatttatccttttgggtggtgggctgggagcgtgacgggggtaccgagc

SEQ ID NO: 540262 - DNA, 343 bp, Homo sapiens
tttccgagggaatataaggtgtcctgtgcgcacatcaaaagctgacctaggaccctatctcagacaaactgctacctccagtctcgatactttaaacacctctgcctaagttcttcccgcgattgtgcaccataaggtggtgaactccgatagctgttcttagatagctccagtgattccagggttcttagcttcggcgctcctgcacacgtgtctacgagttaatctcgcatctttccgcgggtctaattaatgcgtgagctctcaagtcctatcgcttatccgcaatacaggtttatcgttgggataaggctgtctgacactaagtcagagtgggcttgcg

SEQ ID NO: 540263 - DNA, 995 bp, Homo sapiens
gcctcatacgcatccgattcgggactcgaaggcgggcatgctaaggtgagcctgcagccccaggatgtgcccttaacgacactgctggaaccggattcattcgcaattgaagtaggcggacatatttccaggcgccagaagctcccctggagcgatagggagggacccgttcggaggggcctgtcccgtcgcctgacgtggtcaatctatgtgcgtgtctaccttaccccatgcgtcgcatgcaaggcgaaccggtcgttcatgtcaagatctcaactgcctacagggggcctcgtgggaaggggatggtgaaactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540264 - DNA, 301 bp, Homo sapiens
caatcccaaaaaccccaatttaaaaaaattttttaattcccccctatgaaaaatttttttttttaacccaaaaaatggcttaaaagggtttcccaaaattaaaaaaaaaaagacccccccggccccaaatttttaaattcccaaccctgggttttgttggggggccggggaaagggattttccccctggaccccccccctttaaatttgcccatttaaattttagggggcttttttttttttcccccttgaggcccaattttaaagtctttttaaaaaaaccccctttattaaacccttta

SEQ ID NO: 540265 - DNA, 1305 bp, Homo sapiens
ctgaatcatgcgccgtgtggaaggaatgtgctggcaggcgcagatcgccggctgagtgttccactgaaattaaactcaagtgctgacttctcgttttttacctccccaccccttccctcaaggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540266 - DNA, 502 bp, Homo sapiens
  misc_feature (66)..(66): n is a, c, g, or t
gacaaaatacaccccactcgcacctagtgagagccaccaacatcagtgcacagcctgtgtggctgnctcaggccaccgccaccacacacagatgtggacaccgctcaccattgacctcagtgggcttggcacagacgcttgacaggcctgcagccgccatccaggcagaaaccccctacttccacctcccctgcacagccttggactgtgttcctccagactcagggggaagcccccaagtagtcacagttagctcctccctattggtggggctgccatgcacctgtcccgggggtggggtgggtagagaatgacttgctttgtctgtggctcatataacatctctcaacatatggggtcaatgcaggactggagggcaccttccctaccggtaacctgtcctggacccaagacccgagatgagcgtgggtgagagcagctgccctcctgttggcttactgtggatggcgtggccctgcacgggtgggcttttgaatgccct

SEQ ID NO: 540267 - DNA, 476 bp, Homo sapiens
ggttaaagtctctcttcagcctgccgtcatgtctaaattctcagagtctcctaaagagctcgaagaggtgaggaagctcttcattggagggttgagctttgaaacaactgatgacgagcctggagggagccatcttttgagcaatggggaagcgctcacggactgtgtgtgtaactgatgagatccaatagcaccaaacgctccaggggctcttggggtctagtcagcatatgccactgtggaggagcgtggtagtgcgagctgagtgaaatgcaagggcgagcacggaaggatgggcatggggagaggaagtttgctggggaaagcacaagaaaattaaccggacggcctgggtgcttccgagcacgatacgcatgtcttcactgaccaggtgcccacttaaactgctgcatatacagactatcggtgggtggcttccacggaaggacctgaataacatgcagctaggagatgat

SEQ ID NO: 540268 - DNA, 613 bp, Homo sapiens
acacagtttaaagtgtcttggacatgtctcaagcccctccccagagagcaagcacaaggtggattccatatggtgggtaactcacgctccacctggtttttccacctcggtgcggtggtaatatttttgacaagggagggtgaaagtttttggttttccccatccccccaaagggggttgaaccccagcccccggaagcctgagaatgaatcctgaggggtttagcccagggtttgtccccggctttttggggggggccctcctgggaccagtgaaattgaagccccttactcaaagggggtgtttttttggttttgagggccggggtcccccgttcatttttttccgggaggaaaaaccccttttttacatccccgccccaaagagtctctccctttcagacatcctgggaagaaagaatttggcttttttttttttttttttttttggccatctgttttccctcttaggcttttaacccaaagttattgcttttacccccctccgattttaaaaactgagagcgatggggctaaattgaatttttgtatgccctgagaactgagctatgaaaagggttttattaaactgcgggtctgcctttatggattga

SEQ ID NO: 540269 - DNA, 1457 bp, Homo sapiens
gccatggaagctgctgattgttcttgaatttaaagtggagaataagggaccacaaattgcagggtttgagcattccatgtttttcttaaatgagcctgtctgcattttcaaaacgtgtgctttcaaaagagagctgtattttctgaatccagctgtgaatgtggagaccagccgtcctccaagggcatgtgagaacacaccgttgagatccaggctgcttctgctcggagagtggcttgctcggcggctccccagccactctttttctggaagggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540270 - DNA, 369 bp, Homo sapiens
tacgagagtacctcctgcctagtgctgaaggagcttcatttgatagtgcgaggagagaggaataacaggcacaggagactgcgggacagaggcctagaagaataggcaaaggcgtacttcattctaaaggaacgtgagacatttggtttggccaaaactttaaggagttgagaagagacagggctttaaaaataagcaacagggccaggcgcggtggctcacgcctgtaatcccagcacctgggaggccaaggcaggcggatcacaaggtcaggagatcaaaaccatcctggccaacatggtgaaaccccgtctcttataaaatgcaaaaaattagccgggtgtggtggcgcatgcctgtagtcccacc

SEQ ID NO: 540271 - DNA, 465 bp, Homo sapiens
tttgtaagtcttaacccggaaattttggctttaattttgaaacccccttaagcctaaccaaaaaaaaaaaaggatgggtttttacccccgtttcccaaaaaaactctttttaagcaaggaggcaaggttttttccttcaaaaaaaaagtcaggagggggttcccccaccgcaaaagccatctcctttaagttaggagccctttaaacaaccctttaggtaaaaagaagtggggttcccccccccccaaaggggccgtggggggccggtcccccccaatgtaaccaaggatttttttgaaaaaaaggggcggcgcccaaagcctccccccaaaaaaaaaaaaagggtaaaattttaaaaattgttttttaaaaaggaaaccgggggggttttttttgaacaaccccaagtttggggccctttttcccccaaaaaaaaaaagccctttttaacccggaatttgggga

SEQ ID NO: 540272 - DNA, 1668 bp, Homo sapiens
ggcgtcgtgtttattttgcctgagctgatggataatttccgagatttaatccctttctctggtttcctgacatttccacttagagttactcttgtgtttatggccagaatgaaaggcatgtttactagtgtttgaagtttcaaaagtgggtctggcgttcttgctgactgctgcgggtactgctggacaaggccgtgcagaggccagcgcgcccggggcaaggagcgacctgcccgggtctggggcccccagccgcccccgcggcgagtgggaggcagcaggaggcgggctggattccgccctcggggagggccgggggtcctgggaccagagccaggcctcctgccctcgacgtcctgccggttgtgagccagagcctcggtacccccaccccctgcaacggctgcttcgtgggatctgaagctgggccgccccctgggcagggcagggatcggcggaggcaaggagctgaggagcgctggcaggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagctgcattactaactgcccagtgattcggtgaaagctttttactgaaaaagttaacatttctagtcatcccaatcaactggcttttttcaaccaaaattttatatcattctttgtctatcagatacgagaggaaggaagataatacgaagacatgttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540273 - DNA, 1181 bp, Homo sapiens
  misc_feature (1102)..(1102): n is a, c, g, or t
  misc_feature (1113)..(1113): n is a, c, g, or t
  misc_feature (1117)..(1117): n is a, c, g, or t
ggcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctcaatatgctctgcagcttttcttgctgtttaaacctctcgcctcagctttatttatttgtaagnggttctaatgncagngtcgggaaggtttacggaaagtaacattcagtatcacaggttttcccaaattttccttgttcga

SEQ ID NO: 540274 - DNA, 1293 bp, Homo sapiens
ggcagcggggcaggcgcgtggccgggccgcggcgcgatgagtggggcccgggcggcgcccggggccgcgggcaacggcgcggtccgggggctgcgggtggacgggctgcccccgctgccaaagagcttgagcgggctgctgcactcggcgtcgggcggcggcgcgtctgggggctggcggcacctggagcggctgtacgcgcagaagtcgcgcatccaggacgagctgagccgcgggggcccgggcggcggcggggcccgggcggcagcgctgcccgccaagcctcccaacctggacgccgctctggcgctgctccgcaaagagatggttggtctccgccagctggacatgtccttgctctgccaactgtacagcctctacgagtcgattcaggagtacaagggggcatgccaggcagcctccagcccagactgcacttacgctctggagaacggcttcttcgatgaagaggaggaatatttccaggagcagaactccctgcacgacaggagggaccgaggccctcctcgggacttgtcactgcctgtctcctccctctccagcagcgactggattctggagtccatctagagggtcttgggagggatgtgactgttgggaagcccttcctactggacacgctgtcatcatttgctgcttctcttgcaagaaagcacctccgttgtggacggtcctcgggcacaggggatgagcgctaccagtttcatttgtaggcagggagttctccgcggatgcatggtggcagtctgctttgatggcagcagtttctgcttaggtgacctagaggtcctcagcagtatcctccacacctatttattgaggtgcacctgctggggattcataatgagaatataacaagaggatctcggtgaaaggccttagtgggtgttttgtgtgaggtggcttgtagctagctacttccttacagatggtagagtattccaatcctctttgtgttagggttcttgcttccagtttgggatgtattaaaaccaccatttcactgcttcccttcctttgaatagtgaaaaaaaaaaaaaagaacacaaaaactggggcaagccaatgtgatgtatcactcactgtaagatggcaaatgttttcatttttaagattccgaatgtaaactagtgtgctagaaagcaaaccacccgccactcaaaccagtaattaccttaagccttaatatatttattaaaatactttatgagaacattacactttgtaggttaaaaatgaggataaaatgctaaactatcaaacctcgtgccg

SEQ ID NO: 540275 - DNA, 81 bp, Homo sapiens
gcggccgcctactactactactgctcgaattcaagcttctaacgatgtacagggacatggtttctaataaaggattcaaac

SEQ ID NO: 540276 - DNA, 846 bp, Homo sapiens
agcggatgtgttttccaggctggtctcaaactcctggccacaagtgatcttcctgccttggactctcaaactgctgggattacaggtatgagccactgtcagcctggccctttcctaatctgtgcggtattgcatcttttcttgttgcctttccgggtcattctgcacggttctttggagagtatttcctgcgtctgttgttcattcccctcagggagcatgagttggcccttcagtattagactattgtagggtctcgagcacgaatagaccaagtgcttcgcgatcgctatatagtaggggacctccttgagctaacactttgtagatgaggtgtccattcgttctcctttggatagctttgttatctgcgtcatttctcttccagccatagagttgcgtatatacgttatccataggttgggactcgctatgtatcaagttgccattgtagttagactcagcaatggcaagtggactacacacgcctaatctgcatggctagtgtcctaggcgccaggaacaggtagggaacggcggcttaacgatagccagtcttagtggcttccataagtcgacgggctcgtctgactttttgttgctggatggcagcggactggatgtgcgtttaccgtgcagtactaaagtttttgctctctcggggaggactgcctggtgacgcaagtgccgcataaactcctatatgccgtgctatcgttattcccagaagtaggcaggaattgtcgtcgtgatcagtccccattgctcatctgaaccggttcttaggcttccagggtttgctcatatacggtgtcacctctgatctgtggcctgagggatgcccct

SEQ ID NO: 540277 - DNA, 730 bp, Homo sapiens
  misc_feature (157)..(157): n is a, c, g, or t
  misc_feature (168)..(168): n is a, c, g, or t
  misc_feature (199)..(199): n is a, c, g, or t
  misc_feature (201)..(201): n is a, c, g, or t
  misc_feature (203)..(203): n is a, c, g, or t
  misc_feature (208)..(208): n is a, c, g, or t
  misc_feature (216)..(217): n is a, c, g, or t
  misc_feature (250)..(250): n is a, c, g, or t
  misc_feature (265)..(265): n is a, c, g, or t
  misc_feature (302)..(302): n is a, c, g, or t
  misc_feature (366)..(366): n is a, c, g, or t
  misc_feature (382)..(382): n is a, c, g, or t
  misc_feature (400)..(400): n is a, c, g, or t
  misc_feature (403)..(403): n is a, c, g, or t
  misc_feature (416)..(416): n is a, c, g, or t
  misc_feature (425)..(425): n is a, c, g, or t
  misc_feature (432)..(433): n is a, c, g, or t
  misc_feature (463)..(463): n is a, c, g, or t
  misc_feature (468)..(468): n is a, c, g, or t
  misc_feature (508)..(508): n is a, c, g, or t
  misc_feature (513)..(513): n is a, c, g, or t
  misc_feature (515)..(515): n is a, c, g, or t
  misc_feature (530)..(530): n is a, c, g, or t
ggagtcagccaggagtagcaataggttggcttggactcccttaggtggagaaatcatgtcgtggaggcgagtcgaatggatggcgagggccagttaactctgaccggccagctcggggacgtgatgaaggagtccgcccacctcgctatcagctggntccgcagcaangcaaagaagtaccagctgaccaatgcttatngnangtttngctcttcnntgacaacacagacatccatctgcacttcccagntggagcttgtcacanaaagatggaccatctgctggagttaccatagtaaccntgtctcgcctcactttttagtgggcggctggtacgttcagatgtagccatgactggagaaattncactgagaggtctgtncttccagtgggtggaatnacngacaaagtgctgncggcacacngagcggnnactgaagcaagtcattattcctcggagaantgaanaagaccttgagggaatcccaggcaacgtacgacaggattnaggtntngtcacagcaagctgnctgatgaggttcttaagtgcagctattgatgggtggtttacttgacaagaccagacatgggtctgttaaatagcacaactgtaggtaccaaatctcaagttttatagacatttaagttatgaagtgctcaaaggtactgagaagttgattttatacagacattaggggtatgcagatgtcctgatagtaaacatatcaca

SEQ ID NO: 540278 - DNA, 1017 bp, Homo sapiens
gatatcgtcgaccacgcagtcggggattgaagggtcctgccggatagtttaccctgtccggcccagtgccactgccccccgaggctgctagacgtaggtgttaggcatgtccacccacaccgcgcatcccacggcactcggggacacccaagctgcagaaaagagaagactactagatacagtaaaaaggcgagtgagtgcaaaagacacgaagaaaagggttttacagtaagacacgggggatctggcttggactactgagcatgaataagcaatcatatagtgacagtagcatggatagagacccacacagagaactgatccagccaagccacagactcatcaggcaacatgtggatcccagacaaacagaagcccagaaaacacacgaaagatccaacagcgagagagcagggaagacaccacaagccatacaagacgtgcgtgacaccaacatcaaaacagcaataggcataagacacacatgaagagagaggagacagagagacagaaacaaaaggaagacagagacaaataacaagacacacagaggaaccgaacaaaaccaacaaaaaccaccaggaaaagcatacgcagagaaaatggcaaccaaattacacagaaccaggaaacaaaaaaacagaaacgggatacgacaagaagagaacaagacagaaaacaacagaccaagacaaacacaaccagagaaaaacacacaaaaaacaaaaagacaacaataaaaaccaaagaaaaagaaacaagaacaaacagagcagaaaaaaacagaacagaaagaaacaagacaaaagaagagaggaaagagaaagcgaacaaacagacgaaggaaagagaagacaaacaaaacatacaacaaaagaaaagaaaaagaaacgaagaaaagaaaggaaacagacagagaacaacacgaaaagcacaagagagaaagcaaaagacaagaaaagaaaaaaagaagagaaaagaagaaaaagcaagcagaacaagaaagaaaagaaagaa

SEQ ID NO: 540279 - DNA, 908 bp, Homo sapiens
  misc_feature (908)..(908): n is a, c, g, or t
catctttgcagagcacggtcatcacagcgctaagctcgcactgatcctttacctgaattaggtgctataaataaagatgcgagctttgattccagtgctaaccaaaaagataaagcctcgttgccagagatagctgtcgcatcatagtatttcttcacgcaagcaagcgaatccataatcacattctaatagctatccttcttcaataatatacgtctgcctgagtacaggatgaacgctataaacactaatacgtgaccgaatcaatttcaattcattcattgaataatcataatgggctatatgcatagtaaatactaggaatagcctcgcgctttctacttctgagtcccgaggaatgttgaccctggggagccctcgggacatccgggcgtgagtgtaatgtcctcagcatggacagaatcatgtagtgcgcccgcattctcagttcaatataacgcaaattcttcgccgcatcattaaaaacgttaatgtctggcctacctgcaactgctcattcgaagtgcattaatccatctagtagtcagggcagtgtttgatgcggtggacttacagaacaaagcccagcataagtcctcaaatcttaggcaatatctcctcaaatatagccacatagtggtgaataattagcacgcatctacgcggtacgaagcgctaagataaccagttcttgaatgttaactatgtataattagtcctagagtacgtgagcgcaatttcgctactactcgaattagagtcgagaaagcaggaacctactaatagttcggacttggagcatgtaatactgagtaaaaccgttagttcatcaacctcgctgccctagaggcgcccggtaaccgggttttggcccatgggcgatgcgagaatccccaaagaaaggcgcn

SEQ ID NO: 540280 - DNA, 743 bp, Homo sapiens
gaagaggctgcagaactcagccagttagtaaagctttcgaattgcccccttctccaagaaattgtggccagtgcagaccgattcctctccaacccctgaaatagtattatataaatatccaaagcaatgaggatctcctctcctggtttacccccttattgaaagcataaggagccagatggagaagaccatgcaccttagctgacctcctgtggaggcccaccacataccaggctccttggaggtacccacagtgatcagctgaagagtggcttgtctcctagccagaactgccccttccgggcagaatggtgaccctctagcatctcctgagatgagagcataaggctgagcaccactgtagttatattgtgagttttcctaacatttcgggtagcccccaacctccccaggtcttctctcctctgctgccttcatttcttccttctgtccttccatctcttactcctggcatctgcccttgacatgaaccccaagcccacctgtgatgattgatcaaatctggttgtatattcggctttagaaaggtacttaggacatgagtcatccccttgagaaattataccccaggagggagattggcagttggggaaggtagcttaaggaggtgctgggaagggccaggactgggcccaagccgcgttgcttctgggtgcactaaactggtgtcaaactctgcgcaactgggcaaaagggggcccggttcaagcgtctaaagccag

SEQ ID NO: 540281 - DNA, 104 bp, Homo sapiens
gcattgtggtaagttacagctcccgaggttcaccaggttctgcagaccctcgatcttggtcagccggttgctctgataactgaggactgtcaggttggtgagcg

SEQ ID NO: 540282 - DNA, 205 bp, Homo sapiens
gctgtatcttctggtgattctagaggatcccggacagcacgcgctaacaattaatactataccctccatatatggagtaaggtttagaagaaatcccctgaggtccccattactaaacccacactcaacagaaacaatgcatacattattattcttgcacggactacaagtacgatcattgatatgattaaccattcgttgtatt

SEQ ID NO: 540283 - DNA, 146 bp, Homo sapiens
tacctccagatatacacaccctctactgtgtcccagccagcatgtacctgctcttccaggagtctggacacaacgaaggggagcttatctggagcgcagtgagcgccgaacgatcgacattaactaacgacaagaaaaatgacctg

SEQ ID NO: 540284 - DNA, 512 bp, Homo sapiens
tggctccggcacggggtctcttctgaggctgtggccaagatgtcagtggggctgtgggcatcaaaggcatgaccgcccctagaggatgcactctgagaaagcttgttcatgtggctggcaagttcgcactagctgctggcaggaaacaacaaatccctgccatgtagatctctccacagggttgcttgagtatcctcgcagcatggcaactggcttctccagagcaaataattccagagagggcaaggtggaagcctcattgtcttttttatttttgagatggagtctcactgtgtcgcccaggctggagtgcagtggcgtaatatcggctcactgcaacctccgcctccctggttcaagtgattttcctgcctcaaccacccaagtagctgggattaccgaggtgtgccatcacgcccagctaatttttgtatttttagtagagacagggtttcaccatgttggccaggctggtctcaaactcctgacctcaggtgatccaccagccttgg

SEQ ID NO: 540285 - DNA, 1202 bp, Homo sapiens
  misc_feature (44)..(45): n is a, c, g, or t
  misc_feature (76)..(76): n is a, c, g, or t
ttccttttagaaaagcaggtttattggtcgggctgccccaggannagcaacgtgagaggttccccaagcccacagnaaactgcatctgcccacagctcaggccccttcaggccatcagcaccaagggaccttgtcccactaatccccaacctccctctggcagaggggtcttcagccattcagaggagagaagagaaccgagaaagggaacaggaagaaaaaaaaaaaaaagcaaagcttgtgctattgttataacgggtttcgtgctccccaggctcccttcccccaatccctttaaaacaagtgacctgcagtctcttaaaaagccagggccagtagcaaggtctaaggaagccaggttggggggaaaggaagcgaagcctctcggggcccttccctttcaggccttatgaactggggaagcaagggcgctgatccttatgcttctagacaaaccccccttttaattggcggaggaaccaagggagactcgatgttcctggcagaaccctggatcgctgttctttgagaaccccagttccgagacagaattcaggcctcttggaactgggagccaatcattcccttttaccccgcaaagaatttcgggaaaacgcaccccaaagggacaaggcaaaccatttgaggctcatgggcctagcctcttgagagctttataggatacttagcctctagggaacggattcttccctttcttttaaagcagcgttctcactcttgtagaccttaggaatggagccacagaggcaccccttcaatagctcacttgcagccttaaagctcctgggcaactggcggatacttacccgcgtttagccttcaccaagtatctgagaaccacaggcccgtgccaccgagtgctccctcggaacgcgagcttggcacggatctgccggagttgacccgggcttggccgctcttgatgtttcttccacatccgctcagctctcaattggtgtgcgggcggacctgtttccccttattcccgcctgtttgagcccccttttgggaccctaattttcctgacttagaattgccttcccgtggggtccccacaacccttaggaaccgaggcgcggatcccggtggaatacacccaggctgtcttgacgtattacggccgataacctcttaacatggctaactcggtccccttttatgagtccgcacacaacacacaa

SEQ ID NO: 540286 - DNA, 411 bp, Homo sapiens
  misc_feature (71)..(71): n is a, c, g, or t
  misc_feature (89)..(89): n is a, c, g, or t
  misc_feature (209)..(209): n is a, c, g, or t
  misc_feature (217)..(217): n is a, c, g, or t
tccttttaagtaaggttagtaattgtgccttccttttaaaaccaaaattacatataactgaaaatcctaantcctacagttcaataatnggaattttaagagctcaaaagctgcttccttagtcaggtgcagtggctcatgtctataatccccagcactttgggaggccgaggtgggtggatcacttgagtgcaggagttcgagaccanccctgganaacgtggtgaaaccccatctctacaaaaaaatcgttaaaaattagctgggcatggtagtgtgcgcctgtagtcccagctacttgggaggctgagatgggaggattgcttgggcccaggagatcaaggtgacagtgaaccttggcatgcgactgtactccagcatgggcaatagagtgaaaccctcctcaaaaaa

SEQ ID NO: 540287 - DNA, 437 bp, Homo sapiens
  misc_feature (5)..(5): n is a, c, g, or t
  misc_feature (68)..(68): n is a, c, g, or t
  misc_feature (117)..(117): n is a, c, g, or t
  misc_feature (128)..(128): n is a, c, g, or t
tgaanttcaaaagtggttatctttctgaaaatgtgctggttgccttgggcagtttgatagcggagccntactccatcaagcatgaggggccaaaactggtcaatgacttggtaccgnatccggaggcngtaggcgagtataccggcaacggttcggacctggagttggacctgcacaccgaaaatgcctttcaggcttatactcccgtgaacacctgccgctggctcttctgcttctcggcgttcgcggtgaccctgccggggtgggcccgaaaacctgggtggccgatgcgagggaagcccttcaggttctggaacaggccgatattgaaatcctatatggcaaacatttcatcattcgtcagccctaccgctggaggaacagtgccgcaggcgcgaaagaaactcatgtgtacccaattctgagcggcccgctga

SEQ ID NO: 540288 - DNA, 316 bp, Homo sapiens
ggtctaccagcgcacttcaagtctaccaataatctcaaggtctcccagataatcctgcagcttccagaaaatcccacatcttccagacaatccatgccttcccggacaatccatgtcttccaagcaagctccaagatcttcccagtagcatcaaagtctacacagcaaatcccagtctacccagcaatatactggtcttcacaccaaatcccagcatcttccaggcgcaatcccacgtacttcccaggcaacatcccatgtacttcccaataacatttccaaggatcttccatccaaataccagcatcttcccagc

SEQ ID NO: 540289 - DNA, 204 bp, Homo sapiens
tcggatcaagcggggaaccagccccaccccggccgggtccaggtttatgagaagtgatagtgtagtagatatttgggagagcataggggctaaaaataaagcttcagtggagcttccggttcctgggtggattacttttacatgtacatgtcaatcttttccctttcagtcttcccagctggctcagaggggtacggagctcga

SEQ ID NO: 540290 - DNA, 1386 bp, Homo sapiens
  misc_feature (307)..(307): n is a, c, g, or t
tccccgggttctttccccctccccgcgcccccccccccccccggcccctttccccccccggggcgggggggcccccccgcacgtgtgtggggccgcggggggctgcgggagggtctctcacacagcgcgcgcctccgccccgggtgttcactacaacggggttctacacgacggggcgcgggcgggcggggaggggtgctttccccttccgcgccccggtgtggggcccgtgtgtgctttcttgcgcggggggcacacacaccttgccgcgggtgtctccccacgcgggggggccctctcgcgcccncggggggggcttctccccccggtgttctcacacacgtgtgttcttctcttttctcaccgcgcgcgtggggcacacaccggtggcgcctccacactttgtctcaacatttaccacgccggggttgtatctcccactctccacacctccaccacatatatctcatcacactcgccccgcgcgctggtactctcacacccccgcgtgtgtgtggggaccgcggcggggactcttctcgggcgcacatgtgcgacatcccgcgcatatacaccgcgcggcggggggggccctgtggcacacatcgggcggggggccgcgcgcccattatcccccccccgcgtgtgtgtcactcctatctcacacgtgtggttttgtgtggcgccaccccctttttcatatcattttggtcccacactgtgtttggtttgtcccacccactacgtatttcttgtgggcaccaaccagccctctctgcgcgcttcctctctctctgagagacgatgtccgcccaccaaccgtggggcccgccggtgcatcttaccgacggcgggggggcgcccaacctcccttctgtggggtcctttggtgtgcctccgggaggcgcccccctatatattctcgcgcgtgtcatcccccccactcctctcgtggtctgggggggcgccccctatcccatgcgggtggttgcgcccccccttttggttttcttactctcgtcggggacttttgtggcgcacttacatgggggggccaccacttctcaagcaaccacgtttcccgcgggtgatgtccccctcatactaagagaggacactccatgtgagacgacaactgaaacagagtaggggcgccccccaccactacaccttgttgtcatatccctcctcataaaaagaagaggaccacgggcaccacatgtgtgtccccccaaagagagagtactaccacacttgcgggggggaaaccaccaaaccgggagggagcgcgaaacaataaaacccatctgggggagggggaaacaacaatagagtatgtaaccatcacttgtagaaagaaagaacgcccgccggttttttaacacc

SEQ ID NO: 540291 - DNA, 280 bp, Homo sapiens
tggagtcaagcacggggcaggggctcatgagtccagttctttacatgatgatagtgagatttctttgaggcatctgagaggagagatcaaatgagccatttggtggtgtttgactctcagaagagaagtctattcgtgattgtgagtgtgggaaccatcagagtagttacgtggtcatcaggaccagctctgagatcccttaaggagagcagattgagggagacatgaggtggttctatggctggactttgaagaaagccagcatttaaggacggctaac

SEQ ID NO: 540292 - DNA, 836 bp, Homo sapiens
  misc_feature (824)..(824): n is a, c, g, or t
agcggggtgacgccatctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaagtccaggaccctccagctccgtctcaggacacttcctaagaatatgcctgacagcttttgaaagcgctattaatttagnggagacagaaag

SEQ ID NO: 540293 - DNA, 2333 bp, Homo sapiens
  misc_feature (1659)..(1659): n is a, c, g, or t
  misc_feature (1830)..(1830): n is a, c, g, or t
agcggggtgacgccatctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaagtccaggaccctccagctccgtctcaggacacttcctaagaatatgcctgacagcttttgaaagcgctatttaatttttggtgaagaaatggattcggttacataagagtgcagtttcagattgaagataagccaagttcatcactgagctcaagatttccacctcgaccatgagcagtgaccagattgaaagggaagcaagttcgccagagagaaagttgaccgtggtacccccctgcattgcgctgccatttggccagcctttccaagggcatgacaccaagcacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgagaagttcagacattaggtataaggaaactcatttgcagactctctgtccaagaatgcttcctgtcttgcaggggctagtgagtcttgggtgtgtttatgttatgctcacatttgtgttttatttgaaaagtggatggtcaataaatggcttatctttcaactgcaacaacaaaaaagaaatgcagatttacatccttttcctctttaagctccgtcagttttctgatatttctagaaggtcagacacctggcatggtttatgaggcccgngataatggggcccctggtcacctctgctgccccgtacactgtcatttctcatatgacaaccatgcccatgactatcctggacaccctgtgttccctctgctcactgtgaagggaatgccctcaaccactcctaccctcctttaagactcagctcctgaggagccacacatngtctaagcaggagtgacagactccttcctctgtgctcccatagatctcataagggatgaccacacttaactaatagtagctaaggtctaaacgaagcacttggctctaatgctctacagcttggcagtgttactaaacgcttaacttcgctttaccgtagtaagtcctcatgatctaattgacgaaatcggatcttattcccatttaatacccatttattaatgttgaaaccaaagctctcgacactggctaagtggagagggatggggctgaggccggtattggagccagaagccctcacttatgagacccagtttaagccatgcgtgtgaagacaaaacaaacagtcaaccaaagtgaaacaggcactagggcgtaacagaatctggtaaacccgacttaaagtggggaggtgccaaccaaggacaaggaataagataaggaacaaatccattaccataaaccccaggacctaccgcaattacaaggagaccacacaaacg

SEQ ID NO: 540294 - DNA, 1553 bp, Homo sapiens
agcggggtgacgccatctggagcgcgcttggaatccagcaggcggttgctgccgcgtcttccacaacctccgcggtctggagctggcctcccccaccgccgccccaaccaccggccccgccgccatcaccaccaccgtcacctccgccgctgcctccttggggccctcctccttcaccgcccccttagccacctctacacattctaggctttctgtcctggagaagaagctataatcggtttccttgtgggcccggtgcgcagccatggcggacggtggcggcggcggcagcggcggtgcgggcccggcctcgacccgggccagcgggggcggcggccccatcaacccggcctcgttgccccctggcgaccctcagctcatcgctatcatcgtggggcagctcaagagcaggggcctttttgacagcttccgccgggactgcaaggctgacgtggacaccaagccagcttaccaaaacctgagccagaaagcggataattttgtgtcgacacatctggacaagcaggaatggaatcctccagcaaacgacaaccaactgcacgatggtctgaggcagagtgtggttcagtcagggaggtcagaagctggagtggacaggattagttctcaggtggtggatccaaaactaaaccacatcttcaggccacaaatagaacaaataattcatgaattcctggtggcccagaaagaagcagctgtgccagcactccctccagagccagaagtccaggaccctccagctccgtctcaggacacttcctaagaatatgcctgacagcttttgaaagcgctatttaatttttggtgaagaaatggattcggttacataagagtgcagtttcagattgaagataagccaagttcatcactgagctcaagatttccacctcgaccatgagcagtgaccagattgaaagggaagcaagttcgccagagagaaagttgaccgtggtacccccctgcattgcgctgccatttggccagcctttccaagggcatgacaccaagcacacactacagagagggaaacactaccgcgacccaggattgtcctgaaacagacatctatacttgaacatggagactgcacatggattttagggtttgtgctctgagataaacgaaagctacagcgagagaacataaccaatcccaaagacaatttcaaagaacaatgacagtaaaggttaactgggaggaatatttgacagtacttatttgatattgtctctcagagttgcaaactagattgtacacaacattagtgtcagatagctttgaagttgtgaccttcttgtacatgaatcttctagccagtttcctttcctttgtaagagataacaaagcatgaaaccctagaatgagtgagaagttcagacattaggtataaggaaactcatttgcagactctctgtccaagaatgcttcctgtcttgcaggggctagtgagtcttgggtgtgtttatgttatgctcacatttgtgttttatttgaaaagtggatggtcaataaatggcttatctttcaactgc

SEQ ID NO: 540295 - DNA, 589 bp, Homo sapiens
  misc_feature (139)..(139): n is a, c, g, or t
  misc_feature (205)..(205): n is a, c, g, or t
  misc_feature (273)..(273): n is a, c, g, or t
  misc_feature (293)..(293): n is a, c, g, or t
  misc_feature (331)..(331): n is a, c, g, or t
  misc_feature (341)..(342): n is a, c, g, or t
  misc_feature (348)..(348): n is a, c, g, or t
  misc_feature (359)..(359): n is a, c, g, or t
  misc_feature (361)..(361): n is a, c, g, or t
  misc_feature (383)..(383): n is a, c, g, or t
  misc_feature (390)..(392): n is a, c, g, or t
  misc_feature (397)..(397): n is a, c, g, or t
  misc_feature (403)..(403): n is a, c, g, or t
  misc_feature (412)..(412): n is a, c, g, or t
  misc_feature (447)..(447): n is a, c, g, or t
  misc_feature (457)..(457): n is a, c, g, or t
  misc_feature (491)..(491): n is a, c, g, or t
  misc_feature (540)..(540): n is a, c, g, or t
  misc_feature (588)..(588): n is a, c, g, or t
tccattaaagagtgttcgcagacaaagtttctgaaagattagagaaggatcccccccaagattgccccaacactgaactacagactaacactatgttagttaaataaggagacagctttcgagaagtatacattctctnataaaaatagtttattattttgaatgatttaatggttttctacacaatttacatcacaacatgtanattttagcagtaacatctgattctaacagacatcatgctattcctttcatagagccttcagagattcnatgctaacaaatttccttanttggcatcaaggcctgatcactttagaggcttttaagnaattatttanngatgcnaatgctctgantnaaggtactatcccatcactgancccacannnacaantctacnatttaaaangctcgatggaaaaattctcaatcctgaatccctanggaagggcangagaaagtgccatggtgtattaagactcacagtntttagccttatcctacatgcatctgagatgcaggtaacttattgtacantgctgtgttctgtccagataatgagcacttttgtacggaactgttggnc

SEQ ID NO: 540296 - DNA, 203 bp, Homo sapiens
tgattttagagttatatgtgaaagttccatggcatatatacatacccataaaacataggtaatttcaaatgctatcagttacttttactaaaataccgtattactattaccatgaatgtttatttcatctcttgtggaaattgtcatttcagtgacaaagattttgggggtagtttgtgtccactctgtaatctccgaacata

SEQ ID NO: 540297 - DNA, 286 bp, Homo sapiens
gctcgacacagtgatgccctaatatcatcaaatgagcagtatatatttagctttccccaaatgtgcccaaaacattaattataaatattcttttaaactaggatctcattaaggagtatacattgcaattggtcattatgtctcataaatctcttatctagaatagcaacccctccacttttcttcatgacatcaactttttgaagtccagttctcttatacaatgtgtcattttttggatttgcataactgtttcttcatagtctcatttaacccgtcgacgcgg

SEQ ID NO: 540298 - DNA, 201 bp, Homo sapiens
  misc_feature (38)..(38): n is a, c, g, or t
  misc_feature (77)..(77): n is a, c, g, or t
  misc_feature (91)..(91): n is a, c, g, or t
  misc_feature (103)..(103): n is a, c, g, or t
ccaagtgtgcgtgcgctggtgctgcaggagcttgcgantctcgcgaaagcctttccgcactcggcgcaggggaaggnttctcgctgctgtngtgcgcctggtntgccgcagccccgccacacgcacgaagccttgccgcagtcgggacaggcgtgtgccgtgcgcccgcgtggatcttcaggtgctcggccaggttggagc

SEQ ID NO: 540299 - DNA, 655 bp, Homo sapiens
gacttggatgtcaagggaatggaagctgaacctggtgaggctggaaatatgcccatagcatggacctcctcctgacgtgtctgtccgtcgtgtcatcgtgagaactcgtgctgtcctagacaacaattcacgagtaccatcatgtaatacaaagcctctcctggttgtgcaaggacccttcatgggacacctctaccttcgccaacacagagcataagcaagaaatgccatatagcgagaacattataccacgtcccgagacttgctgttagcgtagacccatgataaaactcatagctcgggggcgccacttatctaggtaaccaaccttggctgccaattaggtgtgaaaacccgactacccttacacacagtgcaccgaccttccacaaaagagtttgacggcgccaactccactagggtgggagaccatgggcggtgtttatcgacggaagaaccgccccaattggagacttcttacgagacagccatacattacacgcccttagtgtggtgtgtgaccgaacaccaaaacgttgactcatactacacaagcaactcgatgcgcaaagcggtcgagcatagcgtgagctccccaaagctaacagtctttccccataggggaatcgagcgtaaggccaacaccgtagtccaa

SEQ ID NO: 540300 - DNA, 142 bp, Homo sapiens
ggaacaaaaaatatcacctctcatatggctgtcttctctttcctgtggacactattatagccacaaatcccaggtgatgacctaacaatcatttctaggcactaactgctgataattaacctacctatttcacgatctccgc

SEQ ID NO: 540301 - DNA, 711 bp, Homo sapiens
gcctcacccatatgtgtgcacgtgcgaccgccggagctcccccatgccgtcactgccccggcacctcgagcatcttcccgggtttactctttcctaatggaatccgatgcggaaggctcgctaacgtgggaatcggtgcataacggaggactttctgctggcacgcgctagggatcatacgcggtgagatgcgatctccgagcgtctgacatgcgcacagtcccatgaacggtcggacttgtggcactgaaacagctgtgactacatccgcgagtacgaacagtgcctgaaagtgctggatgcgggagtctccagcagtgtagccgcagtcctgggctgtggtgaccgaggccctgagccgctctgccttgctgcccccaggtgggccgccaccccttgacctgcctgggtccaaagatctgagccctgctggcaggacttcaagtatgaagccccactacaggggattttgctcctagagtaaggctcatctggtcctcggcccccgcacctggtggccgtgtccttgaggtgagccccatgttcactctgggccactgtcaggaccacctgtgggagtgtcatccttacaataccacagcatgcccggctcctcccagaatccagtcccagcctgggaggatcaaggcatgactcccgggccgttatctatctggaggctgcaggtcgttgtaagtcagggcacaaccc

SEQ ID NO: 540302 - DNA, 105 bp, Homo sapiens
caaaaaacagccccgctttttttttttgcggttccaaagggaatttcctttttggtgtcaaacaaaggggcccaaatatgatcccataaattgttttgaaaacca

SEQ ID NO: 540303 - DNA, 394 bp, Homo sapiens
aaatacatgcctccatagctttgttgtaacagatcaaataaaataacagatatgaaatatttttatagcctataaggtgctgtgaaaattttaagatggggctaggcgcagtggctcatgcctgtaatcacagcactttgggaaggccacagcgggccgattgcctgagctcaggagttagagaccagtctgggcaacatagcgaaaccccatctctagagaaaatacaaaaaaaaaaaaattagccaggcatggtggcacacgcctgtagtcccgggagggactgaggcaggaggattgcttgagcccaggaggtaaagcccagtgagccatattcatgccactgcactccagcctgggtgacagagccagaccccatctctaagaaaaaaaa

SEQ ID NO: 540304 - DNA, 108 bp, Homo sapiens
gggggggaggagcccctcccccaccccccccccccttcctctttatttttccccccttgtcttggtaaaaaaaaacttgggaattaaaatgttgattgaagtttggga

SEQ ID NO: 540305 - DNA, 291 bp, Homo sapiens
  misc_feature (220)..(220): n is a, c, g, or t
  misc_feature (236)..(236): n is a, c, g, or t
  misc_feature (272)..(272): n is a, c, g, or t
atttgttggctgcttgagctgggatattcatctttctcctgatcttggacatcagaactcctgattctcaagcctttgggtttggactggaggcaccagctttcctgggcctccagcttgcagatggcatatcatggaacttcctcagcctccaaatttcataactctaaatacaccagtacaaatggaaagatttcctaaatttcaaaagccagaaggnttggggttccctgttnccaaccctgccttttaacctttctgtgtggttcctnatgaagacacttcaatgct

SEQ ID NO: 540306 - DNA, 452 bp, Homo sapiens
caagagtaatatctgtcccctctgccccgcctcaaaaaaaaagttgaaggttaaaccccagtactcagactatggccttatttggagatagtctttacagaggtaatcaagttaaaatgtggtcattaaggtcagccctaatctaatataactcctgtccttatgaaaaggggaaatttggccgggtgcggtggcggctcatgtctgtaatcccaggactttgggaggccaagggggcggatcacaaggtcaggagtttgagaccagcctgtccaatatggtgaaaccccatttctactaaaaatacaaaaattagccaggtgtaggggcacgcgtctgtagtcccagctacttgggaggctgaggcagaagaacccgggaggcagaggttgcagtgagccgagattgagccactgcattccagcctgggtgacagagtgagactccttctc

SEQ ID NO: 540307 - DNA, 833 bp, Homo sapiens
  misc_feature (22)..(22): n is a, c, g, or t
  misc_feature (601)..(601): n is a, c, g, or t
  misc_feature (698)..(698): n is a, c, g, or t
  misc_feature (762)..(762): n is a, c, g, or t
aagagtggtatcaacgcagagngcccattacggccgggggccgccatcttggggctgctgggactcgcgtcggttggcgactcccggacgtaggtagtttgtgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgtgtaaagtaacagatgatttagttgtgttggtgtataaaacagaccaagctcaagatgtaaagaagatgtgagaaattccacagtcaactaatgcgacttatggtagccaaaggaagccccgcaatgttaccatggaaaactggagtgaatggtttgaaatgaagactttgtcggtgtacttaggaagtaaatatctttggaattagagaaagtgttggggacagaaagtactttatgtaactaaggtgggctgttcagaagcttagaggtcattttggtaaatttcttttaatttactttagagagctagggatgcaaatgtttcagtnagaaagcctttatttactttggggaacttgacaagaaatgcatctgtcttagaaactggggattattgatgttaggtaacacatgtaatggttctcntggcaattgtgtctcagtatttggaaatgggatttaggaaaaccatttttaaattagtcatttnttaaagacattcatgtgcctttggcggatcatttttggggctaaatgtgttgggtgcaaataaatgggctg

SEQ ID NO: 540308 - DNA, 969 bp, Homo sapiens
  misc_feature (22)..(22): n is a, c, g, or t
  misc_feature (737)..(737): n is a, c, g, or t
  misc_feature (834)..(834): n is a, c, g, or t
  misc_feature (898)..(898): n is a, c, g, or t
aagagtggtatcaacgcagagngcccattacggccgggggccgccatcttggggctgctgggactcgcgtcggttggcgactcccggacgtaggtagtttgtgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgtgtaaagtaacagatgatttagttagacagtgtctttgctctatgtgctcaggctgcagtgcaggtggcttgatccatagctcactgaatcctcgacctcctgggctcaaagcgggtcctctgtgcttcagcctcctgaatagcagagactacagtgttggtgttggtgtataaaacagaccaagctcaagatgtaaagaagatgtgagaaattccacagtcaactaatgcgacttatggtagccaaaggaagccccgcaatgttaccatggaaaactggagtgaatggtttgaaatgaagactttgtcggtgtacttaggaagtaaatatctttggaattagagaaagtgttggggacagaaagtactttatgtaactaaggtgggctgttcagaagcttagaggtcattttggtaaatttcttttaatttactttagagagctagggatgcaaatgtttcagtnagaaagcctttatttactttggggaacttgacaagaaatgcatctgtcttagaaactggggattattgatgttaggtaacacatgtaatggttctcntggcaattgtgtctcagtatttggaaatgggatttaggaaaaccatttttaaattagtcatttnttaaagacattcatgtgcctttggcggatcatttttggggctaaatgtgttgggtgcaaataaatgggctg

SEQ ID NO: 540309 - DNA, 601 bp, Homo sapiens
  misc_feature (398)..(398): n is a, c, g, or t
  misc_feature (452)..(452): n is a, c, g, or t
cctgagtatatggtgggaataacctgtcagagaccataacaacccggctaattagctggtaaaaagatacaaaaccttggcctgctttaacaagtccccagtaatagcattcttggtcaaatgatagtctgtgtgaaatgcttctattgtcagagagctcatagctgcttgtaaacttccataaaccttggcccgggtaaacttgatagagtgccgaacaccattattatcttcttggagtgggcttcattctaattcctcttggtcagttgttgggctctggtaagcactgtacttcttccttttcatggtactttgaatgctttagagaaattaaaatctccctggaaaagatcagggatccttggccaacactcccttcctctcatttaaagttngattaaccatttagagatcaaagccaataaactaacagcagagatctttctcanactagaacgcttgtcattctttgaccagcctgatgatgggagtttctttctgacctgttcatctcaggatgggaagaggcctgcttcttgttggcttgagaatttgctgccttccacctgcaggtataaacagagctggaggtcgacgc

SEQ ID NO: 540310 - DNA, 124 bp, Homo sapiens
cctaagcgctggacatatgaacctctttgcatttcttagctttcgaatttgaagaagtacttttgaagactcccattttaagaacctggcagattttgctaccaaaagtctacaccactgtgta

SEQ ID NO: 540311 - DNA, 324 bp, Homo sapiens
  misc_feature (59)..(59): n is a, c, g, or t
ggtaggggcggcaggcatgctgaggccactgcgcggctcacgtgtttgcaagccagagncactgaggtctccccaacaaagggaccttgcttgtaatggaggactctgcccaggagatcgccacctgcaacagccggaacgggaacccggcccccaagatcacgtggtatcgcaacgggcagcgcctggaggtgcccgtagagatgaacccagagggctacatgaccagccgcacggtccgggaggcctcgggcctgctctccctcaccagcaccctctacctgcggctccgcaaggatgaccgagacgccagcttccactgtg

SEQ ID NO: 540312 - DNA, 245 bp, Homo sapiens
cgtcccttcatcatacctaccaaagtaaggggtttctgggataaacaacctaatgattcttgctgaagatggccagagataatcagagtaattaatttggggaatggtgaaggataaggaacctgatcagatatcaagggtggggatactcttgctaaactgactcagtagggttcttgctaaacactggtttttacaaagagagagcacaggtaggtatgatgaggtaggtatgatgaaggacg

SEQ ID NO: 540313 - DNA, 278 bp, Homo sapiens
aaacctgggggggccccccccccccccggaaattgaaaacccccgaaagccggaaaggtttgggccccctttttccccgggggcccccctttttttccccttttgggggggggggaaaattttttttcccccccccccttttttttttttccccacccccaaaattttttgggggggaaagggtttttttttttttttttgggggttaaaacccccccccccccccccgggttttttcccctttcctttttcgggttttgggaatgggggggggggga

SEQ ID NO: 540314 - DNA, 816 bp, Homo sapiens
cctcccactgtctcttgtataagcatcaatggaagcgagaaaaagataagcaccctgagaatggagacaggtgtttgaagatgatggatgaacgaaagcacaggaggagtttcatcattcgataagaagaaatagtccttggccatgagaactccatctaagacttgtccttttagcattatctgtactcaacgtgtatctctactgatggtgaggtatgcctattggttatatacattgttggaaatttaatcgaaaagctgaatgagcacattctggatgtcattataccagtcagctgtgagttattgtgcggggcaattcccggatcaaagttatcgctgagtgtatttacagaacaagagagttgaggagaaataagggcatgcattgacgtgttattaggcacatacttcttttaggacctatggtgaggtgtatgcacacgcatgtagaagattaccatgaaatggttgaataaatcttgaaagcaggagaaggaagagactcaaggattagcatcaacgataaggagaataagcacgagtgctcggaaaagggacggattgcgattctccaatccgggataactttccatgcagacagaatggctttcaagtacaatgtcagttgattcaggcttactcggtactgttccaccaattaattcttgcagaatgtactatcagatctcactatacgaagaattgggctttgaatagagcattgctgatgacatttttcccgtggtcatcagttacttatggggccaatcgtgcgaatatactggccatcccagatcagcaatgatgaata

SEQ ID NO: 540315 - DNA, 212 bp, Homo sapiens
cacgatcccttaaggctgaggtcaaatatactgctgagtaaaggccacaccaatcaaaatttgtttattaagacggagtctcactctgtaacccaggctggaatgcagtggcgtaatctcagctcactcactgcaacctccacctcccaggttcaacgcgactctcctagcctcagcttcctgaagtagtctgtgaccacatggcacacaac

SEQ ID NO: 540316 - DNA, 539 bp, Homo sapiens
tataatccaatctttatttaaaaatctaatctgccagtttagggttttccaccaactcggggagcggaaactttcacagggttcacaatcttttgcttaggtgctgcccttgtaggggccttagcagcagccattgcagtctttttaaatgcctggttaaccctttttgcttccttagcagccctgatagcttgttcccgttgagcctttttaacttcagggttctgattcctcttggcccttatatcagcaaaagatgccccagtaatggccctctggaatttgactgcccggcgggttcttttcttttgaattttttccgactgtccccttttgggcttccttctgtaaaggacagtccagtttatttgcccaggattccccttggaaaggaaaaccgactcgcattttgcattaaaaaactggaaaaccttcccgtcggtcctggggtagggcctcccgtgtccggggtaaatcttggacccgctaaaactgcccaggtcgaccttcatggggacagctccccggaaaggccaaag

SEQ ID NO: 540317 - DNA, 148 bp, Homo sapiens
tgttacggttgtgcatcccccagtgtgtgtatgacactggcagatctgcctggagacccttcgacaacagcagcctgcccagacaggtggtggctggagcaccgcaaggcgcaagtggctgaaagaatggcatccctgccgctggaca

SEQ ID NO: 540318 - DNA, 90 bp, Homo sapiens
gctagcagcagagtgagctcaccgggaggcaaggtgccctgattctgagctgccggactaagatgttctggactctgagtcacctggaca

SEQ ID NO: 540319 - DNA, 859 bp, Homo sapiens
  misc_feature (752)..(752): n is a, c, g, or t
gggcatggacgctttcatgggtggttacgcgacagttgccatgaccgagggcgaaaccgtggctgcaaggcattgtggagacattggaggacttggaatatgcgctagaaggctcaatccaatgcccagtatggtaagaggaagacgtacggcagtcgagagtacagctgatccggagtcgggagtcggtcgcttgtcgccaggtggccctacacctcttcccagaaggcattggtccgtctgtgggggcacgccccctgccgaggcggactaggtgctgtccgtctagtggacctgggtaggctgcggtggccgtagattccgtcgctggcgtcccgttgcgctttcatccctggccggtgtggaccgccggggatttggcgtgggatacaacctgctcgaccacaccctgtcctccctgtacttgcgcctgtgttgaccacattactgttctactgtgttgtgggctacgcgatcagatacggtatggctagttggtttgggaagtggggaggccctgtataagattgttaaacggttattactgtatatatgctctaacagagcttgcctgggggtgcgcttccagggaagcgtggcgccaaatctcatggccgggagacggacgagcgcgtcctggtgcgcagggcgtgctgccagggaattactatgggtcgtgggcctgattggtgcgaaacgttactaccagcaattccacccaaggcttagccaggccatttgcggcgaaaggngtgcgggaataggggggacaagcccaagaacgcctaaagggcccaagaaaataggggccgcctttgggaccccaggaatgggatgccatgggtggtgaacttggtcc

SEQ ID NO: 540320 - DNA, 144 bp, Homo sapiens
cgagaatccccatacagagtacacagtatcagtgagtgcctatttagagttatgagctatgctacgtcctggggcatacaatttttaaaaatgatgcctgtactttcaaagaagctgacatgcccggggaagccaacgttcact

SEQ ID NO: 540321 - DNA, 106 bp, Homo sapiens
tgatatgctgtctatggtttcgtgaaagctgctgatctcattagtttcagaaatgattgcatggctaggcagtgactctcgggtagatcagcgctgactgggtgcc

SEQ ID NO: 540322 - DNA, 338 bp, Homo sapiens
ccggtttacagttcctgattagtggctgtggcgtgcacatgactgtgtgccgtggccgtggccactgtgatcttggtcacatgtggtcttagggggtgccctccccgatggctggcttatggtgtgtggccagtgccctcgtcaccctcgtgcatcttctcgtgggaggtccaggttagcctcgccatcagcatgatgaactcctcgaatctcaggtgcttgtctgcatttgtgtccaggtcctccatgtatgtgttctatgaccttttcattcttattctccttcttgagagaattgtgctgatcttctcgcagcagctctttgacttccccctggt

SEQ ID NO: 540323 - DNA, 246 bp, Homo sapiens
  misc_feature (10)..(10): n is a, c, g, or t
ttttttaacnaaaaattgggccattttttaggctccttcccaggcttggccccctttttttatttttattttttcccttggccgaagggatcccctcccgggtccttcctttccccctgggttttaaccttagggttaccttcccctggtttttggcttagccggggcccccaaaaccaaaaaccaatgggcccccccccccttcccctttactgaaaagccttaaataaatttttggattttgga

SEQ ID NO: 540324 - DNA, 663 bp, Homo sapiens
  misc_feature (543)..(543): n is a, c, g, or t
ggtgtccttgatctgggtcggttggtgtagacagtgatgctccactccggtgcctcggattgcaactcgctggctagtctatcgctcgtgagctgcttctccgctttctgcggccattctgcatggcacatacccatccgatggtgagccgcatcattgaatctggacgcgctgtgagctcatgtctcttccttctggccactgtgagccgctggtggctctgccggctgctgccgcgcagtctgtaggctgtccgctgcgtcagtgcgtcgaggcgttccggtgagctctagccgtctcgggctcagaggttggacgtgcctctgcgacgtcgccgtacggtgtctggttgtctggccgcccgtcccctctgacccttcgacctgcacccgtctccgagaacgtcgagtccacgtggctgaagatatgagacgcccacgtacgggtagaagcagcccggttatcctggagagccaattggacacgcaggaggcgccgacagtgcgaggagaccatccgcctgctgtgcccctgcgcccctgntccaaagtcgagcgctgctaaactgacgcagcgagcatgcctgagctgacggcggggacgctggactggtcccgagcaagaaagcccgtctggaagaaaaggaagaagagggagggtagc

SEQ ID NO: 540325 - DNA, 492 bp, Homo sapiens
tgtggttcctcaccctggttcagattgctgccctctgcctgtctgaaggagcaagcccacccagtacacgaggctgccttcaaaggcccctactggtttaatagctgctgagatggattgtcttgtcctgccgccctttgctgtgtgggcagtactctgaagcaggcaaatgggtcttaggatccctcccagaaacctgctctgacccagacccatcacccagcttggggatggcaccacgttctactgcccctccaactctggcctggcaaaggcctgaaggtgagcaggaaggagcaagaggacagaagcaaaactatgaacctggggggttacctagggcttgaccccgccctcctgggaaggcatgcctcagcctggggtagaggtaggatgactgactggttttggctggcctctgctgccctcatcctgggctaggcagctgggagccaaagttgaaatacaaataaagttgttttgggccttgaa

SEQ ID NO: 540326 - DNA, 515 bp, Homo sapiens
  misc_feature (134)..(134): n is a, c, g, or t
  misc_feature (152)..(152): n is a, c, g, or t
  misc_feature (324)..(324): n is a, c, g, or t
  misc_feature (359)..(359): n is a, c, g, or t
  misc_feature (362)..(362): n is a, c, g, or t
  misc_feature (390)..(390): n is a, c, g, or t
  misc_feature (405)..(405): n is a, c, g, or t
  misc_feature (418)..(418): n is a, c, g, or t
  misc_feature (426)..(426): n is a, c, g, or t
agttcaatggtgtcatctcggctcactgcaacctccacctcccaggttcaagcaattctcctgtctcagcctcccaagtagctagaattacaggcgcctgctaccacgcccggcttcccctgcttttgagcaanaatgtccttactggttancctgtgcctgcctctaccactgcacactgggagtgtggagatgacctgtctctttagctcacaggtctgcagataggaaatgcacttaagggctggatgcggtgctcacgcctgtaatcccaacactttgggaggccaaggcaagtggatcacctgaggtcaggagttaaanacgagcctggccaacatggtgaaatcccgtctctnctnttagctgggatggtggtgcatgcctgtngtcccagctacttgngatgctgaggcangagaatcncttgaacctgggaggcagagttttcagtgaggtgagatggtggtggctctgcacttcagcttgggaaacagagcaagactccatttcaa

SEQ ID NO: 540327 - DNA, 293 bp, Homo sapiens
tcggctcggtacccctagttagaagtttcaatagcacattgctgcctggggtagtaaaatgggcaggtaagggtgtgattccattggtatctgggctgctgtgggatgctgttgattcctcactacggcctgaggttgtggagctctcaggaaagtgtgttgttgcaattgagcccgggctgctgtagtagctggtaggttcttcaacaagggcagatgtggtgctaggaggtgaagatattgtgtgtgttgtgctgctattgaaacttctaaaactaggggtaccagctcga

SEQ ID NO: 540328 - DNA, 147 bp, Homo sapiens
ggggtgatttaagcctttccctccaactgtagtccgtttgctttattaatatttatttatttatttttgagacagagtctgcctttttcacccaggctggactgcagcggcacaatcatggctcactgtaacctcagcctccagggc

SEQ ID NO: 540329 - DNA, 395 bp, Homo sapiens
  misc_feature (68)..(68): n is a, c, g, or t
  misc_feature (73)..(73): n is a, c, g, or t
  misc_feature (341)..(341): n is a, c, g, or t
  misc_feature (352)..(352): n is a, c, g, or t
  misc_feature (355)..(355): n is a, c, g, or t
  misc_feature (358)..(358): n is a, c, g, or t
gccttcagtagaatttatgattcacagaaaccctttaaaaaaacctcagtttgggccccaggccgtgngttgncacgccctatattccccagctctttgggaggccgaggcaggtggatcaccctgaggttgggagttcaagaccagcctgaacaacatggagaaactccatctctactaaaaatactaaattagctgggtatggtggctcatgcctgtaatcccagctactcaggaggcagaggcaggaaaattgcttgaaccctggaggcggaggttgcagtgagccaagattgcgccattgcactacagactggacaacaagagcgaaactcagtctnaaaaaaaaacnaanacnaaaacaaacaaaccaacaaaagaactcagttttccag

SEQ ID NO: 540330 - DNA, 739 bp, Homo sapiens
ggacgcgtgggaaccactatgaggtgatactaatattcctgttttatagatcaagcaactgaaattcacaagtaatttgcatagggctttgcctatgaacttgtgcaaggcagaacctgaacacaggtttttcatattctttgattatacttcttccactgtatcaaaggttattcttcattccaagtttcatatttataaaagttgtaattttgatgggaattatttttcatatgcattccagaatataaatcaagtgaatctgtgtctctgttacaaaaatagaaggagaaaaagaacagaaaataattgagaaacaaaatcagaaaaagagcttgtctgtctactaatatcaatatcctttaaaatgacagggtataaattaaacaggaatctgacttggaattccggtcgaatgtcaataaaacttgaattaacagatgtgttctgttttacaggtgcctgatgaaaatggttcagaaagatctgtcaatcaagcagtagtgtgaaaaaagcactataagagaatgcatcatcagtttgctatttccctgatggccttaatttaaagagtggtctaggattactaaagataaagagaaagcacattttctagaatgaactcacagagatgtgctgcatgcgactcaacggattttaaactcccaaagtaacagtttccagaaaacaatttaccgtaatgatgataaaagcagcgttcagttgttatagaacgttg

SEQ ID NO: 540331 - DNA, 873 bp, Homo sapiens
ccacgcgtcggatgcaggcttggcgactcggtgcgccaaagctcgagccgactcggccgcgaggggtagcgcatgaaggggaggctggggtcgccatgaggcgagatggtgtcacctccgtcggtacctggggatatcggggcaggctccgtgaacagcacagtcaggccgcatgtcgccgagtggggctggaaacagacccggcgcccagcggtagccctccttgcgcctccgattcccaggtgagggagaggaggagcgggatgcaggggacccgccgtgctcgcggcgggatggaaagcctttcggaagcctctcgctcctccccctgcgctgtcctcctccagccgcgcagcctctgccctcccgacatggaaggtctttaatgtaactttaaatggttcaccaaaggatgctctaatggatgacagcgatactcctacatattatctgcaaatagaaccacaagatggatgtcatcctgtgtgacagcgtggaaaggagtgtgacctgttcttgccttctgcatcagattgaaaactgaaatcagcttgacggggacgggcatgagcatctgaccagcagtgacagtgcgatgggaaaagccccaagtgtctgagcaggacagtctcaataatgtaatgaaagctgacattgagctggcgaggtggtgcaggtgaagaactcggaaaacaccctttgtgaagctcagagatgacagggcttcttgggaacggccaaaaattctggaaaaagaagtccaggaagcaaacaggactggtagaagatacccaggaattttcaggagaatggctttatggagaaagactaggccggccattgctgtgtataaaacggcagtaaggtagaaca

SEQ ID NO: 540332 - DNA, 677 bp, Homo sapiens
ttgccaaacagaccccccaccccctgcgattttccttcctccctccatcccttgacggttctggccttacccaaactgcttttgatcttttgattcctcttgggctgaagcagaccaagttccccccaggcaccccagttgtgggggagcctgtatttttttctaacaacatccccattccccacctggtacctccccctatacccatgctagccaacttctaaccgcaatagtgacttctagtagcttgtactagtaatagtatctagtagtataaaatggaatgttagtaggagatgacccctccctgtgccaggcatggttacctctcccttatacccactgagtcacggactactcatggaagacaggaccagataagggacctatcgattaaaaaaaaaaaagcaactcaaaaaaaacaaatcaacacaaaaacaaacaacaggaaccaagcacacactagcacatagtcgcggcacgcctgcatcactccggcacactcgcagaagaaaaaaacgcgcagataataactgcacgcaccagcaccaaaagaagacaccaagcccacaccgccttaaggtgaccagtcgagaatacaaaagagggaagacacaaccaggagaggaaactataatactcacgagcgcgagcgacaccaggcataaaaagacaaa

SEQ ID NO: 540333 - DNA, 1057 bp, Homo sapiens
  misc_feature (10)..(10): n is a, c, g, or t
  misc_feature (23)..(23): n is a, c, g, or t
  misc_feature (60)..(60): n is a, c, g, or t
  misc_feature (70)..(70): n is a, c, g, or t
  misc_feature (86)..(86): n is a, c, g, or t
  misc_feature (219)..(219): n is a, c, g, or t
  misc_feature (246)..(246): n is a, c, g, or t
  misc_feature (258)..(259): n is a, c, g, or t
  misc_feature (456)..(456): n is a, c, g, or t
  misc_feature (500)..(500): n is a, c, g, or t
  misc_feature (510)..(510): n is a, c, g, or t
  misc_feature (599)..(599): n is a, c, g, or t
  misc_feature (652)..(652): n is a, c, g, or t
  misc_feature (654)..(654): n is a, c, g, or t
  misc_feature (672)..(672): n is a, c, g, or t
  misc_feature (674)..(674): n is a, c, g, or t
  misc_feature (680)..(680): n is a, c, g, or t
  misc_feature (708)..(708): n is a, c, g, or t
  misc_feature (710)..(710): n is a, c, g, or t
  misc_feature (719)..(719): n is a, c, g, or t
  misc_feature (721)..(721): n is a, c, g, or t
  misc_feature (725)..(725): n is a, c, g, or t
  misc_feature (730)..(730): n is a, c, g, or t
  misc_feature (755)..(755): n is a, c, g, or t
  misc_feature (761)..(761): n is a, c, g, or t
  misc_feature (776)..(776): n is a, c, g, or t
  misc_feature (796)..(796): n is a, c, g, or t
  misc_feature (799)..(799): n is a, c, g, or t
  misc_feature (828)..(828): n is a, c, g, or t
  misc_feature (830)..(830): n is a, c, g, or t
  misc_feature (837)..(837): n is a, c, g, or t
  misc_feature (854)..(854): n is a, c, g, or t
  misc_feature (865)..(865): n is a, c, g, or t
  misc_feature (870)..(870): n is a, c, g, or t
  misc_feature (885)..(885): n is a, c, g, or t
  misc_feature (889)..(889): n is a, c, g, or t
  misc_feature (897)..(897): n is a, c, g, or t
  misc_feature (906)..(906): n is a, c, g, or t
  misc_feature (911)..(911): n is a, c, g, or t
  misc_feature (917)..(917): n is a, c, g, or t
  misc_feature (926)..(926): n is a, c, g, or t
  misc_feature (933)..(933): n is a, c, g, or t
  misc_feature (988)..(988): n is a, c, g, or t
  misc_feature (991)..(992): n is a, c, g, or t
  misc_feature (1026)..(1026): n is a, c, g, or t
actcattgtnataaagtaataanctgggaaactgggtcagaaggcatagaaacaactgtnatcgcccatnctccctttctgtggangaggcgggacaaggccggccccctggctggggcctgggacgcgagggctctcagagcttggagaaggtgacggttttcagttccttgttctcagttgtggcctggaccgacttcacgaggtcttgggtctgcngcttgctcatgttccaggacgccacgnagttgaggctcnnggccaccgaatggtcgcgggaatacagcaggttgaccttggtgctctgcacgccacggggctcttgctggaaatctcggccgccagcgctaaggcagcatccagcatgacctctttgtctgggaacacccggctgatcagcccactgcccagggcctcgtcagccatcatcttgcgggcggtgaaggccagcacgtngaccaggctctggttcccgatgaccttgggcaggcgctgcagtnttcctacatnggcagctaaacccacgttcaccttcttcacctggaagaaagcatcctgggcacagtaccggatgttacaggcggtgacaaggtccacanctccgccaatacagctcccatggacggcagctattacgggctttgggcacctntngatgacgtagaaggtctncnggtatnaagtaaaaaaaaaaaaaaaaaaacaacngncccgggccncncccnctccnttgggctgccggatgttcgacgccntgttcnttaggtcaatacctnctgttaacatttttcctgcnccngacaccaccaccgcccgacagttagcgtntnttgaaancttgttgaagcactttnccacctctctncagangaccttgtacatggnattnctcttgtngggccggtngagcnggacangcagaacangtttttncgcagacgttacaagaagggacttaaagctgttgtctggggcttcaccgagggcnacnncggaagccgcctcttgttccgaggagcaagttangtgaagctaaaactgagttccgggtagttgg

SEQ ID NO: 540334 - DNA, 279 bp, Homo sapiens
tgtcatattgaatgaagctaaagagtaacataaagtacttcagcttttatctcagcaatgcagacatgaatactacacattagtgtgcaaacaacacacaacaacaaacacacaaacacaaacaaaacaaacaaacacaaaaatccccaccaatcttcatggtgtaaacttatcctgctacagggcatgtaacgctgactcatagaccactctcgcggattcctgcgcgatagcacagacacaatgatcatacctgaagatcatgccaacatatcatga

SEQ ID NO: 540335 - DNA, 939 bp, Homo sapiens
gagcttgctgagctccggggcccgcgtagctcgcgcaggctctgggaaaggacgaggagtgtaccgggagcagtgctccattgtgcctcgaggccccgattcgggctaggccgcgagcggcctccttcccttcactttcctctcgtgggaggatacggcggcgggacgagtgactgcggccaaccccttaggaaaggggaatctcgctgattacaaagattgacccaaggagaagaaaccttttttccccaggaggggttccggacttgaggtgacacacacagactttcacaagtttattggcaagaaggattggaggtataattcctaaagcatgggaaaccacatttgtggacggcttttgttgtacaacgtttgggaggggggcaagctaacaagaagaattttaaactgttaagggattgtaacgctggggctaaagagaagatgtctagaaaggaaaaaaattaaagaggacaacaaaaaagagagggatgttttggaaaggccggggaaaaaacaattgctttggaaaggggagaataagcaacccagggggaacaaagatgagtgccaaaggcagttggtcattaaactccaacattccagtaacccttcaaaggacaagtcccaaggaaatgacggagggtgttttgggcccaaatcgtgggatgacatcacaccaattgtgatttaggacccccaagggggattcaaccgtttgtgttttcccctaaacaattgttgaccatgtgcgtgccacgtggaacaacagacttaaaaggcaccacagctgttggaaccacggccccaaaatatgtgaacattggggtggacttggaaaatttaacgcccttggatagcgttacacaaatttaaatatctcccccaaggaaaacaattccctaggaagagccacataagagaaaaacgtggggg

SEQ ID NO: 540336 - DNA, 160 bp, Homo sapiens
aaatgagctggatgggatcccgttgatcctggacaactgctacatgagtgacagggacccctttctgacccagagggtgatatatgccgtccgagaccttaccgaagacaacagccaaaaccgacatttgtttgcaaagatggaggaacaggggctggct

SEQ ID NO: 540337 - DNA, 172 bp, Homo sapiens
tactcgctcgtaccgactcttgctcccctcacggactcggtactttccacttagcccacgctgcccaactccactaccttgctggtcctttcaccccaattcaccatgccacttctcccatatggtggccaggggcactgtggtgcactctggctgctgggacgccgcctgg

SEQ ID NO: 540338 - DNA, 368 bp, Homo sapiens
caaacctgtcatcaacaccctgtcatcaaaccctatcatcgtctcctgtggctggtgacaagctggtccacggtatcgaacctggctactgccagctgatgaccaaccatccttggccacacagcgctatctgaacacggtgactgtctctccagattgatccctctgtgcttctggaggccaggatggccaggccatgttcctgggatctcaacgaaggccaacacctttacacgctagatggtggggacatcatccacgccctgtgcttcagccctgaccgctactggctgtgtgctgccccaggccccagcatcaagatctgggatttagagcgttatgagggtttcgatgaccgggtaccgagc

SEQ ID NO: 540339 - DNA, 290 bp, Homo sapiens
  misc_feature (27)..(27): n is a, c, g, or t
  misc_feature (105)..(105): n is a, c, g, or t
tttctggtgggcatgggggctcacccnccttttttaccagcacttggggagcgaaggcggttggatccccccctgggtagaagttgagatcaacccctgccgaanctagtgaacccttgttttactaaaaatacaaaaattagctgggcatggtggcggcccctgtaatgccagctcctccaaggctgaggcaggaaaattgcttgaacccagtaggtggaggttgcagtaagccacagttgcgccattgcactccagcctgggcaatgagtgaaactctgtctcaaata

SEQ ID NO: 540340 - DNA, 687 bp, Homo sapiens
ctgaaggctggagggcggcgccgccgaggcccagatgcgccaggaaattgagaggctgacgtgagcgactagaagaaacaagagagggagatgcagcagctgctgagccagccccaacacgagcgagagaaggaagtcgtcctgctacggaggagcatgggcagaaggggagcgcagccctgggccgccagtgacgtcctgtgccgctccttggccaacagagacccatcagctgcggaggacgctgaccgcacaaccgcccacatgtgtcagacatctggccaagtgtctggatgaacgacaggcatgcacaaagggaattgtgcggggagagaagtcctgaccagatcggaacacacagatgggcacaccctctgtccaagagatgtcaattgagacaagttgcaggaagaaacatcgacctgttaacaaccagaaggtgactcacgtgaaagacctcaatgccaaagtggcagcgcataaaaacgccagcaggggacgaatacgtgagggggctccatgcgcaagctcagggaggctgcaagatcccccaagagacccgagctgatgaggaagggagatctcccgggtcaacaagaccagtgggacagagaacgataaatgacctgtgcccgaagtgaaagcaggaagctggcgcgctccaggaaggcccgggaatgcctgcgt

SEQ ID NO: 540341 - DNA, 299 bp, Homo sapiens
cgtagggggctctaagatgtttgtcaaacttcatcttaagaacactttgctggccgggcacagtggctcatgcctgtaatcccagcactttgggaggcagaggtgggtggatcatttgaggtcaggagttcaaaaccagcctggccaacatggtgaaacctcgtctctactaaaaatacaaaaattagctgggcgtggtggcacgtgcctgcaatcccaaccacttgggaggctgaggcaggagaattgcttgagcccatgaggcagaggttgcagcgagccaagatcacaccactgca

SEQ ID NO: 540342 - DNA, 138 bp, Homo sapiens
tctatcattatcatagaattattatattactgctgttagagaaattaattatcctacagatgatagatgtttcactgtggtgtatgcataggggtactccgagtaatcgtcggggcattccggataggccgagaaagt

SEQ ID NO: 540343 - DNA, 299 bp, Homo sapiens
ctcgatgcaggattgtatcaagtcagtgtttctgtctctggctatatttataaacatagatttattgtgtactcatcaccagcacctcttaaagacttcctgctgcctgctgtcgctttaatatctgaaaacattcctgaagtttgggtttttgtctaaaaccatgagcatatgtggcctgcattgatatttatgatctttacaaatttccatgggtgagatgtaacaccacttccaagtgggattagagtgtttcctggtcactttcatgacccaacaagagaacgagaaaatttatt

SEQ ID NO: 540344 - DNA, 330 bp, Homo sapiens
ggaaaggataaaaatggaagttataaataaaaagaagatgtattgggaaagaaaaatacaaaattttaaaaaggaatggcacatgtttacatcaatttaacacaggcacacatttcacaattcaaactaagacatttgggggtggcatcatcattgtaattaatctgtgttggcaaagaatgtcatggaacatggacattggcggtcagtaacactgtaacagagctacaactaggaaaattagagtggtagtagtcacttatttaagaattcattcaggtaaacagctgcacccatctgtaccccttaagtggcaaagaagctgttata

SEQ ID NO: 540345 - DNA, 616 bp, Homo sapiens
cgcggggacaggtggtcctttttatttcgagtgtagaaggacccattgttgggggttggcgagccacagtgtccaataagagcgggaacaattcacgaacggataacccccccggcccagttttatatttacaagaggggcaattctcttgagccttggcccaaaatccagcaaggccccagagcctgcctttcaaaattattaagtaaagtgaacccctttccctccgccacaaaacattgaccaacgcgcagatttgtttcccaaggagtatccaatttctttcacaaccacgtttacactgttcacaccaagtacctatggtccataaggctaaacatagcgcgcttgtatcagtcggcaccagttttgatttatcttcagttttcagaaaagcttcacctaactctaggctggtgccaaatattaataaatgtaagtcgttagtctgaaaacctcacactaagtatgctccaaaagatctcgcattacgacccatttcctttggacaatacttgatttacgcaggagtattaataaagggggcatgccgctttgaaaacaaaattgaatcgttttagatgaagagaaattggacattttctcaggaacatgt

SEQ ID NO: 540346 - DNA, 292 bp, Homo sapiens
cgttctcattgtgcgctctgtcctgtcttgtgtcctctgtcttgattgccatacccttgaggtgggctggcgaagtccctttggtccgtgtgacaggagatgctgctgccatggttacaatcctcagacgttatattatcaactgtttccaaagatgcattcctcttgactaatcccttccacatttagttaaggacaaagttgcgtggatcgttggatgccgcatggctttcagataaggacacggagaaaatccaaatgagcacaagagctgtgcacatcttgtgggtga

SEQ ID NO: 540347 - DNA, 252 bp, Homo sapiens
  misc_feature (249)..(249): n is a, c, g, or t
ggcacgaggcaggattcaaagaggtaaatgacttaatcaaaaatcacacagtgccgggcgtacacagtggctcacacttgtaatcccagcactttgggaggctgaggcaggtggatcacctgaggtcaggagtttgagactagcctggccaacatggtgaagccctgtctctactaaaaatacaaaaattagccgggtgtggtggtgggcatctgtaatcccagctactccgtaggctgaggcaggatnaaa

SEQ ID NO: 540348 - DNA, 119 bp, Homo sapiens
ccacacaggtctgcaaactaacacccattacccaccaagggccctctgggccaggtatactaaatcctgggttcctcacagtctcccaccattaatcatacattactgggcatccaggg

SEQ ID NO: 540349 - DNA, 149 bp, Homo sapiens
caaacataagaataaaaaaatcaaaaaaaggttaggtatgtcatgaatgcttagaatatttttcgatactagtttaagtctgggattattcacttattttttttttcaataaggttcccagtcatcattaggctattagcatttaagtt

SEQ ID NO: 540350 - DNA, 376 bp, Homo sapiens
taagggggggtctcgctcggtcgcctaaactaaacgggagtgcaggggcctgatctcggctcacgggaacctcgtgcctcccggagtttcggggcgggttctccgtggcctcagcctcctgtggagtgtggcgtgggactgtgcagggcgtccgcgtaccacaacgtggcgtgattttgggcattttataggtggagacgggggatatgtgctagtgttgtggccaggcgtggtctcaagcttcgtgacctcgagggtgatgtgccgtgcctcgggcctcccagaaggtgcgtgggaattacggggtggtaagttcacgtggtacccagtcccaaaagcgagggtttaacaaaaaaacaaaaaaacagaggggcgg

SEQ ID NO: 540351 - DNA, 166 bp, Homo sapiens
cctgcagttatcagtgtctgactctagaggacccccctgtgtaaggctgccagcacacacacacacagactgcccctgcacacagacacacagagacctgctcctgcacacacacagagactgcccctgcacacacacacatgagacttgccctctgcacacacac

SEQ ID NO: 540352 - DNA, 434 bp, Homo sapiens
  misc_feature (19)..(19): n is a, c, g, or t
  misc_feature (54)..(54): n is a, c, g, or t
  misc_feature (72)..(72): n is a, c, g, or t
  misc_feature (97)..(97): n is a, c, g, or t
  misc_feature (102)..(102): n is a, c, g, or t
  misc_feature (192)..(192): n is a, c, g, or t
atggggttcaccctgaaanaaacttttcctttgaatctgagtaccaaacttctnaccctaggtcactggganccctggacctacggcactgctcccngcagncctggttatccctgcttgaggcagcaatcctcttgagccctagtgaaatgcaactggctgtacctcaatgatgttgccctgagattctgnccagtcgaggtattacttcaatctcctgagaccagcctctacctccagatccagggaggtcagtgcacatataaatggactagctttattaaaggggatatctgggccaggcgtgcgtgtcacgcctgtaatcccaatactttgggaggccgaggagggcagatcacctggggtcgggaattagagaccagcctggttaacatggtgaaacgaagtctctactaaaaatacaaaaaaaaaaa

SEQ ID NO: 540353 - DNA, 246 bp, Homo sapiens
gacagcagcctgccccaaaaccagccctttgtcttttcccttggcacaggcctggtcatcaagggctgggaccatgggctgctggggatgtgtgagggggaaacccgcaagctgctgatcccatacactctctggtgtcgtgagcggggatctcccccggagactccaggcggggctgccctgatgctcaacgagctccttttcataatggagtgtctaactgtcctgtcaccctactgggtgatg

SEQ ID NO: 540354 - DNA, 483 bp, Homo sapiens
aatcggaggctcggcgaaccttcagttccgcggaaagaccggcgcgatgtcgccattcaggcagaacgtccgagccgagcgtggtatttcgccgcctcgcggcgcatccgagcctcttccggcgacacgtagatcgacgtcgtgccgagcaacgcgtggccgagtgtgcgctgcacgaccttgagcgcgacgccggcggccagcatctgcctgccgaccgtgtgccggaacgcgtgcggcgaggtactggacagcttgcgccgctcggcctcgctcaggtcccgcatcacctcgagcagctgcgcgatcgcccactgagtgagcccgcgcgcgccgcgcaccgaatagccgttcgttgtcgtgcctacggccggttcgccgacatctgagggttcgccaaatttttcgcgagcccgcggcggcgtcgggatgaccagcggcgccaccagcggcaacccgggggggcttcgccgcggcggccgc

SEQ ID NO: 540355 - DNA, 809 bp, Homo sapiens
  misc_feature (702)..(702): n is a, c, g, or t
ctgaagatcttcctatacttttctagggggaatggggtcgagtgagagcaacctcctatggttgtttgtgagaattaaatagagatgaagcctcacagcaggatctgtgcataccaagcaggtgatacaagcaaactgttttgtgtgacaaagtgtgtttgaaccgggtcaagaccctatccacaccccctactatgcgattgtctatacactgtgctatatattatatcctatccaaacaaggcacctacccagcgcaaagacctatggtaacacagggggctactcaccatggcgattcaagtgccattgttggtggccgctggttcccgggcttgggggtccccggttgaaagcaaccttggctgcatttggaagacttagctggcaaagcaggcgccgtagcatgtgggtggccgaatccatatcccgtggaaccccaaagttctattcttcccttgagcggaggcctctcggttctccctatcccttggtatttgggctgggaagccccttaaacttgggaaaggcctaacgttggtgaaaggggaccttcgcaattgttggtgaccccccagtacccgtacttccacgcttcgaacatacccgtccacgatggccactgggggacaacccctggcagccttatttccccacgtgggacacggctgtggaccccagagaactctaggaaccccgggnggcttcccccttttgattaagagaacccgcggctctatacatgtacgtgagccccgctttctctgtgggtatcccctggtgggtttgggaccccttagcacccccgg

SEQ ID NO: 540356 - DNA, 419 bp, Homo sapiens
tagagagcactggcgtgatactttttcctcttttgtaataatacttagcttaaaacacaaacacattgtacagctgtacaaaaatattttcttcatatatccttattccataagcctatttctactttaatttttattttattattttctaattttacttctaaaactcttttgttaaaaattgagacacaggctggggacagtggctcatgcctgtgatctcaccactttgggaggctgaggcaagaagattgcttgagcccagaagtttgagaccagcttggtcaaaatagtgagaccctgtctctaccaaaaatacaaaaattagctggatgtggtggcctgagcctgggaggttgaggctgcagtgagccatgatggcgctactttgctgagtgatggaacaagaccctgcctcc

SEQ ID NO: 540357 - DNA, 312 bp, Homo sapiens
gactccatcttcccacaggaaaatgaacgtcctctcggaaggcgcttacaggggctacatgggcttatacacggtgaacaccagccagagcttcttcatggtgaacaccagacagagtgtgtagccgacctccgggatcaacctgcgcattaacgcatgggttcttgcacgcagcgttcttgggccgctgtgccccgcatgctgctcaagctagtgctgaattatcaaatgaaggggtaatgcaaccatagacagcgaggaagaacgtgtacacgcaaacacagacaaaacgagcgcgtaagggccccgcag

SEQ ID NO: 540358 - DNA, 399 bp, Homo sapiens
  misc_feature (19)..(19): n is a, c, g, or t
  misc_feature (37)..(37): n is a, c, g, or t
  misc_feature (189)..(189): n is a, c, g, or t
  misc_feature (393)..(393): n is a, c, g, or t
  misc_feature (396)..(397): n is a, c, g, or t
tggaaaagcaggggcaaantcaggggctcacctgggncctccgccttccgggctcaggtgaccctcctgcctcggcctcccgggtagcctgggacctacagtgctctccctatcaaatctagaattggaagattgatggacagcaactgaggtgctccccaggatcccaaaaagtctgctggataaacnccatctctattctaatattatggagagatcaggatctcctgtgcccaaatcaaacctgttaatacactcagctgtcctcagtggtaacactgaggtcaacacacaactccaacatcaggaacaagtcataaccattttgcatctgaaacagtgcctgacacaaaggtgcttgatcaattttatttactaaataaacctatatanttnntt

SEQ ID NO: 540359 - DNA, 264 bp, Homo sapiens
tcggcgtagcgatatcgcagatcatctgcacgggcttgtcgaaggagccgaaaccttctttagtggtcgtgcgcgtagcgttgccgagcttcgaaaccacgtcgggcaatacgaacgtgagcgactcggtgagctcgcggccttcctggtacgagatcgtaaccgtttggcggccgtcgcggcccgcgtagaagtagccgacacgtccacgccgcggcgatccacggtggaggtgccggtgacggcgttgccgtcaaccttgaa

SEQ ID NO: 540360 - DNA, 700 bp, Homo sapiens
  misc_feature (55)..(55): n is a, c, g, or t
  misc_feature (128)..(128): n is a, c, g, or t
  misc_feature (147)..(147): n is a, c, g, or t
  misc_feature (154)..(154): n is a, c, g, or t
  misc_feature (166)..(166): n is a, c, g, or t
  misc_feature (171)..(171): n is a, c, g, or t
  misc_feature (174)..(174): n is a, c, g, or t
  misc_feature (204)..(204): n is a, c, g, or t
  misc_feature (211)..(211): n is a, c, g, or t
  misc_feature (214)..(217): n is a, c, g, or t
  misc_feature (260)..(260): n is a, c, g, or t
  misc_feature (263)..(263): n is a, c, g, or t
  misc_feature (271)..(271): n is a, c, g, or t
  misc_feature (293)..(293): n is a, c, g, or t
  misc_feature (298)..(298): n is a, c, g, or t
  misc_feature (304)..(304): n is a, c, g, or t
  misc_feature (321)..(321): n is a, c, g, or t
  misc_feature (335)..(335): n is a, c, g, or t
  misc_feature (344)..(344): n is a, c, g, or t
  misc_feature (353)..(353): n is a, c, g, or t
  misc_feature (356)..(356): n is a, c, g, or t
  misc_feature (372)..(372): n is a, c, g, or t
  misc_feature (378)..(378): n is a, c, g, or t
  misc_feature (385)..(385): n is a, c, g, or t
  misc_feature (393)..(393): n is a, c, g, or t
  misc_feature (401)..(401): n is a, c, g, or t
  misc_feature (405)..(405): n is a, c, g, or t
  misc_feature (411)..(411): n is a, c, g, or t
  misc_feature (429)..(429): n is a, c, g, or t
  misc_feature (455)..(455): n is a, c, g, or t
  misc_feature (498)..(498): n is a, c, g, or t
  misc_feature (505)..(505): n is a, c, g, or t
  misc_feature (524)..(524): n is a, c, g, or t
  misc_feature (533)..(533): n is a, c, g, or t
  misc_feature (549)..(549): n is a, c, g, or t
  misc_feature (555)..(555): n is a, c, g, or t
  misc_feature (565)..(565): n is a, c, g, or t
  misc_feature (615)..(615): n is a, c, g, or t
  misc_feature (684)..(684): n is a, c, g, or t
tataaatttttttggcaatttcatcttagtaacccgttttgtcctattgccattntcccaaccattgaaaaagtttacaataatttacatagataatattttcaaagtgcttaagaatagtgattgtnctctgggatatttacaganggcctanacaatgtatgtncaggnggnatgccctatagcacaagtttcactgctggnatatggnttnnnngggaaagtgcatatttgggcagagggggcaatagtgtctaganatngaagggtnacagaaactcggtaaccacatncaaanctgaantagaatgtggacaagantatttacaaaagtnatagaaaancggtcaagnccncaagcctgacccatcnccaagncatctcnacgttctnccagcccncacncccccnaacacactccatccgccngctcggttaccattccgacgggggtnttatttgtttagacctcaaaggtcaacatttgttacagaagtnaagccanaccatcatctgttccttcnacttaaatngccgggtacgtgtttnctacanaagcactgtntctaccaatgtctattgagaggtcctcttcagttgttttcaagtacacangatttttaaagttcatgcttttcatgtacttgtgttgccaattccgccacaacaagtagccacctactnctgctatcatttagag

SEQ ID NO: 540361 - DNA, 862 bp, Homo sapiens
agcggacaagcggctcgcacgctggaagatgatccttcccgccgatcagtctgtgcacacactcacaatggtaatctcggacgctctagtcctgtcgggctggtgctcctcctggttgtcttctgccattcaggtcatagtctgcaatgttacaactgtcctaagccaactgcctgacgtgccaaaacagccgctcgaagtgtgctctcagtctggagttcctatgaatgcgctgtcgtcagttaccgaaaagcgtgcgcgtcacaacgatgtataacagacgtgttggacactttgaggcattgcgcaatttctacgatcgtcaacaaacccgcgttgaagcaaccatgagcctaacgtactactgctgtgagacacggacctggtgtaacctttaacaaacatccttgcataattagtggatcgcggacgattccttagttcgaggaggaaaagcgagatttcttgcttgcctggtgactcgcacttatctgcggctacgtccgtgctggcagcgcttcgatcccttaagtcaagcaccctagcgagagactttcgtctccaaaactccccgtttacctgcggtcgatccgctttctcttgctgccaacatttctagaagggcttgatattttaccagtacttggatccttggttgcggcaaaagaaataggaaatgagccttggagtgccatgctggtctaaagatagacgggggctctggggaccacctgcgacagaaccagatcctgttatgctgtgcacagccccgacttgacaggaatgaaactctaacagtgaacctaaggtgtgaattgcaccgtacattgccatgctttcctacctttgctctgggaccgac

SEQ ID NO: 540362 - DNA, 221 bp, Homo sapiens
tatcaggccttcagccacagactgaagggctgcaccatctgcttgtctgcttttgaggttttgggactcagactggcttcctggcttctcagcttgcagactgtgggacttcaccttgtgattgtgtgagtcaattttcctaagaaactccccttcatatatacatcgattagttctgtccctataacggagctcaatacaccaccaaacaagtcaaaaaa

SEQ ID NO: 540363 - DNA, 137 bp, Homo sapiens
tagtcctagctcttcctgtttgaaatcctcggctaccttcaccgtccaaacttcggaaacctcttacagttttacagatccattactggaatatctttctagagttagggtaacccatatttctgtgcccatttcaa

SEQ ID NO: 540364 - DNA, 791 bp, Homo sapiens
ggacgcgtgggcagggcgaactgtgaccgctattgcttgtttgggatgtgcgctggaccacttataagaggattgggctataccgtgggcccagtcataggctcatggtcccagtccatatcactctggtgagtgcttttcacgatgtcgggtattcaacattcaaccatccggcggatggatgatggaccgtcatatatgacctgggccgggagggctcgaaccgtgaggaggtgagaacttgaaggaggctagggccataaggagggattgactagaagcagtaccctcaaggccttagtcctaatgagcatttgcctatgtgaaaaatcttcatttgtatctttctggggtgggcaggaaatgacagagcccagagccctgaacttccttccagacacctggccctctggtgggggaggtgcccactcctgccatggctcagtctgcacagggtcgaggtggggcctttgtgcctttaatgaacccagctgggaggacgtgcggggtccaggatcttcagactcttgtctaactcccccaggactcaatgtcgcacccagcatttggtaggatgcaaaactagagacacccatcacacagctcacacagctggaggaccaggggcagaggtgcaccctagagtcagtttgatcgtagccttggacataagagtctggccagtggcgtgcccatgggtgcaggagcaggaaagttggctgagggcttggaaacggggcaagaaaatggagtggagcggaatggggaaacaggaaggaagatatctagaa

SEQ ID NO: 540365 - DNA, 288 bp, Homo sapiens
tcacctctcagataggtcaagatcccataagcatctagtgtggctactgctctagcacaggaggaagagctcacgtggtcgtgcgagcataggggagcagctgtcacatgacagaagaagcttcgctcgcttgcctgccgccccctcctgctgtgtaggccagttcctaccaggccacaaaccacaacctatcaagaaacactggcttactaagacacataaaattgtttcgtcttccctatcgctttagtgcactatggtctaaatcgtataagaagtattgctagc

SEQ ID NO: 540366 - DNA, 97 bp, Homo sapiens
taatcccccccccccccggcggacgggttcctgagtggaacatggcgacttgcgccgaaatcctgcggagcgagttccccgaaattgacggacaggg

SEQ ID NO: 540367 - DNA, 532 bp, Homo sapiens
cgatggtgcacaagcagaaatgacaagcgggacgtagttaactgaagagcttctgcacagcaaactaaactatcaacagagtagcagacaacttacaggatgggagaaatatttgcaaattatgcatctgccaaaggtctaatatccagaatctataaggaacttcaatcagcaagcaaaaaacaaataaccctattaaaaactgagcaaaggacatgaacagacatttctcaaaagaagacattcacatggccaacaaacatatgaaaaagtgctcttcatcactaatcatcagagaaatgcaaatcacaaccacactgagataatatttcggcaccaatcactagcgataggtgccaaaaggttagaataagatcgaaaactagcattggagtaggctgaggagtaatagagctttgaaatccttttcgaggcttaatgtgctttcaaagaggatggcttctggccgaggagagtagtctttccataaaacatttacattgccaatatataaccaaagactgttccacct

SEQ ID NO: 540368 - DNA, 490 bp, Homo sapiens
  misc_feature (33)..(33): n is a, c, g, or t
  misc_feature (400)..(400): n is a, c, g, or t
  misc_feature (413)..(413): n is a, c, g, or t
  misc_feature (415)..(415): n is a, c, g, or t
  misc_feature (419)..(419): n is a, c, g, or t
aattgatggccaaactaactccctcaattgccnaattttgaatctgacaattcctaaaaaatgcctgtcccacgaacctctggccagagacaaatcccagcgaatcgttgcctcacattaggtgccatagtaggcccgggtgcggtggctcaggcctgtaatcccagcacttggaggcagaggcggtaggatcacgaggtcaggagatcgagagcatccctggcccaacatggtgaaaccctgtctcaactaaaaatacaaaaattagccgggcatggtggcgggcgcctgtagtcccagctactcgggaggctgaggcaagagaatcgcttgaacccaggaggcagaggttgcagtgagccgagatcgcgccactgcactccagccttggcaacagagncgagctgcgtctnanatanataaataaataaataaataaataaataaataaataaacaagtgcatagtaaaaatttgtaaaaaaaaaaaa

SEQ ID NO: 540369 - DNA, 277 bp, Homo sapiens
caaacccccccggtttgggggttttgtttcctcggttttttgcgccccaaaagggggggttttttttttgggggggcctgtcccccgaaaaataaaggggggggttgcggattttttttacctttgcccccagggttgtgggggggtttgggggggccccccgggccaatttggggggggggcggaattttttttttcgggggcttttttttttgggttgcggcccccccggaattggggtttttggggtcccaattaattcggtcggggtttggga

SEQ ID NO: 540370 - DNA, 341 bp, Homo sapiens
  misc_feature (211)..(211): n is a, c, g, or t
  misc_feature (256)..(256): n is a, c, g, or t
  misc_feature (271)..(271): n is a, c, g, or t
  misc_feature (286)..(286): n is a, c, g, or t
  misc_feature (325)..(325): n is a, c, g, or t
ggggtttcaccacgttggccaggatggtcatgatctcttgacctcgtgatctgcccgtctcggcctcccaaagtgctgagattacgggtgtgagccactgcacctggcttagtgttagtgtattttatgtgtggttcaagacagttcttccagtgtggtccaggggaaaccgaaaattgggacacccttgctccaagatctgggaatatgnacaaggatgcccactgttcaccactgttatttcaatggcagttantaggaagtcctaggntaggagcagttcagnacaaggacaagggtattaaagggtattccaggttttggnaagggaaggaagttca

SEQ ID NO: 540371 - DNA, 642 bp, Homo sapiens
gccgccctgagcatcctggctatcaaacgggtgcctggtcagaaggccagccgaccaccttcccgctttcctctttaactgaggagaagctgatccagctttccggtaaacaaaatccttttctcatttggggcagggtgggctaactacgctgacagtgctagtcaccttctatttaacactaggcaaaatcaggaaggcggcgaaataggctggcgacttcatgctcgaccgccctagaagggcacttttggagacagaccacacgacctcgtatcgctacgattcaacgtctgtaacgcaaacaccgcactctttctacacagctgtgggcttgccattccttacgccaacactcggccgtctgtgggaaacttggccagtaacaagcctacatgagcaacggcgtatgtgcaactatgtgtagtccaattaacgactatttcccccgtccgtttaagaacatgcctggccattgcccacaccaccagaacctacggggcctgaacccacatcaactttcataccccgtgtggccattattctaaccaacgaatccactcaccaaaccacctaccatcttacaagtaccgataaacccaggctttataggcgggccccaacttccactattggggcttt

SEQ ID NO: 540372 - DNA, 242 bp, Homo sapiens
cccttggagagctccttggagagctccccttggagagctccccttggaagagctcccttggcagaagctccccttgtgagagctccgcttgtattcgatgacttcaaggtaaatgttcttccaggggaacttcttctagtagcaaacccactacagttaccctgcaggtagggcccaatattccttgtggaagctcaggttgggaaacaggcatcactgacactagctctgccaaggtaccg

SEQ ID NO: 540373 - DNA, 165 bp, Homo sapiens
  misc_feature (30)..(30): n is a, c, g, or t
  misc_feature (99)..(99): n is a, c, g, or t
  misc_feature (156)..(156): n is a, c, g, or t
ggaattcggcacgacgtaattactgtccgncatcccatacattgggacagacctagttcaatgaatctgaggagggtactcagtagacaggcccacccncacacgattctttatctttcacttcatcttgcccttcattattggaggcctaggagngactccacc

SEQ ID NO: 540374 - DNA, 239 bp, Homo sapiens
  misc_feature (208)..(208): n is a, c, g, or t
  misc_feature (216)..(216): n is a, c, g, or t
aaagggaagcttagatttattgagcgcctactgtgtgccaggcagtgtgcaaggcgctttacatacattatcgcattaaatcctcacaacaaccctgcgaggtaggtgtttataaacccccatttgacagatgagaaaactgaggctcagggaggtgaagtgatgtggccaagttcacatggctaataaatggcagacagaggaggtntccaaggntcggagagaaaaaaaaaaagact

SEQ ID NO: 540375 - DNA, 131 bp, Homo sapiens
tccccccggcagcccccccgaaaaaatttccaaaaaactggcattaggagttaggttcttcccaaaaacaccccccctgccccccaccctttgccgttgcctttttcaaaaaaaccaaacggtctgaatta

SEQ ID NO: 540376 - DNA, 401 bp, Homo sapiens
ccggccttccttcccattgggttcccccggggaagcccggggttttttttctccgcccccaaaaaatgggaaaccccttttggttggggggggttttttttcgccccctttttggaaaaaaaagggcccttaaatggtaggggcccttttaaacccccgggggaagggccggttggggttttcctttaaaattggggggccccccaagggggggttcccgccccattttttttgcccttttgggaaaggaaccccctttttttttttggttaaaataaagggggattggggggaacccctttcccctttgggcctttttgggattaaaaccccgggggttttaaatttttggggtttgggggggccttggttttttttttaccctttttttccccgtttta

SEQ ID NO: 540377 - DNA, 1380 bp, Homo sapiens
  misc_feature (680)..(680): n is a, c, g, or t
gagagcgtgttcgcccggtcgagcacaggatacctcggcgcatttggctgatctcgctcgctgcgtgcaatacgcgtcgtaagtctctacatggattatgatatctgccgtcgtcctcgttcgatggtaggaacgaggtctgggtgttgctgcaataggccagagtgtctctgcgtggcgaacgtactgacctcgccctgggacccgatcgtgtcctcctacccactcgaattggggcagcactgcaggacgatgcaggggcagtcaatgggtggggcgagtggaactgcaacgacacgggacttaccatactgttggtgccagatggaggaacgcgcgacgacgtcgagaggaggacggcgattcctcagggggctgtgaatgtacggctcaatcgtagggcacacggcactcggtcacttcaaatgtggagatcgcacactgtggaggaaccataatctggcagcaatcattctatctacctgaatggaaggctgccgttgtagggcgtccccggaggggaagtgacctcgccgatgtacatgtatgtagcctgagatgggcgcactatagaaacaactcagaagggaaccggaagatgtcaaatgaagaggacttgaggttcgcatggagatcacctgggattttgacgggaacaccgttctcgagaagcttagccncccaaaggtggccaatagctgagcatgcttttgccatgagtgcctaagcgtactgggtgacataaatcaccccatggcttatacgggcgctttgcgtggggcacagcttagggctatctctggggcagatttccgatagcattggcgcactcgtctccgagattgggaaacaggcgggttttccatcgcagaagaaggtaatggttggagtcgcggaatcagggaacagggaaggcggaagaggtccatatggcgcacggttttccgttcgccgagagtgggtccaacaactgctccagttggccgggctcctttgggggatcttttatgcggacttagggcccttggtggaggaatccttgtgagaaccgcgtcggataatccataagaccctgcttcgcaaatgtggcaacgagtcacagttccccaattcgacaccatcgggaaattgcccaaggcccgcgtattgttaaacacgacgagcgtttgtctatgggacgatttgtggaatagcggggcctctcgcaaacttgcgggtgtagggaaaccacactaacgggggtaagcgggtttccaaactaccttatttatagcagcgcgacgtacaatgggcttgtgttggcatataacaaggcttatgcggacccgtatggttgcgagccgtttttcgccgacacgtacaaaagcggaatagaacatg

SEQ ID NO: 540378 - DNA, 114 bp, Homo sapiens
ggtggagacggggtctggctagtgcccaggctgggtctggaactggtgggctcaagcagtcctcccacattagccttcgaaagcacggggtttataggtgtgagcccccacacg

SEQ ID NO: 540379 - DNA, 1478 bp, Homo sapiens
ggggctctgggagatgctgatgcagctgagctggctggatctgccggagcgcgatgtgagtgtggagcctgagccgccctgcctgcctgccgcctccgcctcccctccgcgaacagtgagccctgggcctggggcccggcacgcctgccccatgtccctgtccctcgtgctgtccatgtgcctgccgagggtagctgctgctgcgagcgagcgaggggggacggggacgatgctgagctgatgctgcctgtgtgaggatgtgctgtgcctggaccctgtagctggtgcggccctgcgctgttgtggcgtgacggggcaagcctgcttgccccgggcgacaccattgcaacgaacaagaaagtcacgtgcacttcaatattccacacaaagcccatatcaccaatattctctatcatacttatcaacacatacatttacatacgtcatcataccaaaaacacgctactaatcaccacaacacactagcataacatcaaatagcacactgcaaatcaaaatatgtacactctcacaacaatactcccactcgcatcacacaacaccaacactaccaccactcgacacagctcaactacactcgcacacatcccgcctccactatcccactaatagcaagcagccgcacactcccccccacataccctccccacagcgtcccctccacgcctagtagaacatcacacaccaagccaaacaccaccatcatcaccacccatccacatctccctaccaaccacggcttactcccatagaaacaccaccacaacatagcacagcaacccccttctgcccgcaccgcacctcccacaccacaccacacgcatacagataaagcatatacacgcaacacgactgcaatcaaccgcacatccagatcaagtacacaaccctcctccacacactcgccgtccaaaccgctctacaagcattcgcgcacccacccatcccgtcagactattgtctcacaccacaatcccgtgatatacacagacggcggagagggagaccgggctagcgcgacacgccctctcgcaagctgagcgatgcgagcccgcacgctctggcgcgccagcggcgcgccgcagccctcgcgcaccgcggccgggacgcgcaaggatcgacacgccgtgcagcggtacgcaacgcgctaggcccgttggcgctcactcgggccttcatcccagtacacagccctaaccccgtacgtccgccgcaccaactcccctgcacgcaccacaccccatctacaccactctctcgctcacactacactctaaacacaccgtacccgccccatcactcctccacaccctccagctctggagtcaactaccactacacacatatacagctcaccacacccacacactaccaacctactcccacacttccactctctaccacctcaccacatcaccagccagcgcaccacatacacccaccatctcacacaacac

SEQ ID NO: 540380 - DNA, 432 bp, Homo sapiens
ggggccggcagtgtttgatgccttttttccatttacatgggtacatgccgaccgctcggggactgcagcaaggtaccatggtgaatcagatctagagcttgtactgctcatcaggaagccttgtacgctacatgtgatcaacgttgttatagatggctgcttagccacattgagtggaacttgcacatgtgaacaaacctttgtttcattacctctctgatgagtatacctgcgtgatattccatgaagcccatgttgctgactgtattgatgttgctacacagtgtgaagtcgcattccaacaagccagaatgttcagattgaacacattgtgcattaatatactcgagctaatttggtaaagcttgtaaccgccattgatgagttagagaaatcatgtattgtggcatcatcagccattgtctgttcccg

SEQ ID NO: 540381 - DNA, 86 bp, Homo sapiens
cccaggcaggcagcaggttgccagtcaagctgcagcatcgtgctactgcattcccaatctggtgtgacagagtgagactccgcctc

SEQ ID NO: 540382 - DNA, 206 bp, Homo sapiens
actactgattactatgtatccccctctattgacccccacctccaaatatctcatcaacaatccgactaatcaccacccagacaatgactaatcaaactaacctcaaaacaaatgatagccatacacaacactaaaggacgaaccttatctcttatactagtatccttaactccttttacttgggtgtaccgatgctcgaacttcgt

SEQ ID NO: 540383 - DNA, 237 bp, Homo sapiens
  misc_feature (3)..(5): n is a, c, g, or t
tcnnntttatcatccctaagatcaagttagttcccactaggatgatgggagtgttgggacagtggtgcgcacctcaggatacactagatgtgaagaaggaacagaggttgtgacacgctccttttacaggatgtccttcacctaaatcaacacccaggccggcggcactcatgccaagacacctaaccttcaggcaaggcctccccacggaggcttcaggtggttccccacccttca

SEQ ID NO: 540384 - DNA, 160 bp, Homo sapiens
gaagattaggatactagtataagagatcaggtcgtccttgatgttgtgtatggtatcattgatgaggttagttgataagtcattgtagggtggtgattagtcggatgtagatgagatatatggaggtggggatcaatagagggggaaatagaatgatcag

SEQ ID NO: 540385 - DNA, 255 bp, Homo sapiens
tacagaagtagacacgaagagactgctgttgactgcaggcacacgagcgcttggtggtggcattagttggatttggggcaaccagagttggagtactctgcgaggagttacttgaagttcagttgttgtttcactggaataaatctgcgtgcggtaggagcagtgccagcagcagcagtcccagcccgagcctggccacccattggtcgtgcccatgtccccctccgtctggtagcgcggcgcggtctagacagg

SEQ ID NO: 540386 - DNA, 322 bp, Homo sapiens
ttcaggcagggaagagtgaggagtacaggtttcacgtatgacaaatatatgatgttaaacaaacgaactcaggaccttcaaagatgtcttcgtcccaagcacacacattcgtaattggtgtccattggctattgcccttcttctataatcttcaaattatatagttatgcatggagttccctatgcatctcacccatctccttgatctcagccttctcatacttggccattctcttctttctggaaataaccagcacaacaattccagcaacaactgctatcaccacaaccacaataacagcaataacaccagctagagaca

SEQ ID NO: 540387 - DNA, 304 bp, Homo sapiens
  misc_feature (2)..(2): n is a, c, g, or t
  misc_feature (8)..(8): n is a, c, g, or t
  misc_feature (18)..(18): n is a, c, g, or t
  misc_feature (38)..(38): n is a, c, g, or t
  misc_feature (56)..(56): n is a, c, g, or t
  misc_feature (65)..(65): n is a, c, g, or t
  misc_feature (70)..(70): n is a, c, g, or t
  misc_feature (85)..(85): n is a, c, g, or t
  misc_feature (90)..(90): n is a, c, g, or t
  misc_feature (97)..(97): n is a, c, g, or t
  misc_feature (116)..(117): n is a, c, g, or t
  misc_feature (124)..(124): n is a, c, g, or t
  misc_feature (126)..(126): n is a, c, g, or t
  misc_feature (161)..(161): n is a, c, g, or t
  misc_feature (172)..(172): n is a, c, g, or t
  misc_feature (178)..(178): n is a, c, g, or t
  misc_feature (183)..(183): n is a, c, g, or t
  misc_feature (213)..(213): n is a, c, g, or t
  misc_feature (215)..(215): n is a, c, g, or t
  misc_feature (237)..(237): n is a, c, g, or t
  misc_feature (241)..(241): n is a, c, g, or t
  misc_feature (252)..(252): n is a, c, g, or t
  misc_feature (274)..(274): n is a, c, g, or t
  misc_feature (277)..(277): n is a, c, g, or t
  misc_feature (280)..(280): n is a, c, g, or t
  misc_feature (297)..(297): n is a, c, g, or t
  misc_feature (302)..(302): n is a, c, g, or t
tncagtcncgcgcgaganctatctgtcatctatcatcncgcggagtacaacgcgcnttcgagaangcgcncgcgagaacatgtcntgtanatccgtntccccccgtgcgttcaggnntcgctcncntgactcgtgtgacatcgtcacatgtgggcgatgtnccggccgtctnagcaantacangtgcgcttcaacgttctcaaggtcaccgangncttccggcaccgaagaagcagntccngaagttctgangctgaacatcggcccgctcccngcnatnaaataaagttatttctnattcngg

SEQ ID NO: 540388 - DNA, 1209 bp, Homo sapiens
cactccactcttgactgaccagacaaccttcatgccaacatccattgtacccaagataaagtatagtgcgatacacattgaaagcctggcgcaacagatatagtaccgctaaggcgaaatgatgaacaattcagtaacctaagcataatatagcaaggacgtaacccgcatataccttctgctataactgcaattaacgtagaacatacacttgtgcgagggaggagccaaagctaagacccccgaataccaggacggagctacgctaaggaacatgctaatagagagcacaccctgtcgtatagtaagcacatagatacgatgggagaggaattctactacgagtaccgacgtgccgagcaagagctctagccgagtccgtggctgtatcagcgtgggttgtccagagatagaatcttagttcaacgtttaaatttgcccacagtaaccctctaagatccccttgtcaaatttaactgttagtccaaagaggaacagctctttggacactaggaaaaaaccttgtacgagagagtaaagaatttaacacccatagtaggcctaacagcagccaccaattaagaaagcgttcaagctcagacacccaggtacctgaagaaaagtgccaaacatataactgaagctcgtcacacccaattggaccaagtctagtcaaacagaaagatcctggaaaggcccagagactggaacattgaaaggtcgaaaagagacccggaaacacagtagctgccaggagagcaccaaagacggagcgaccgaaatcctcgaacaaggacccacattaggcctcttaaacacaaacagcggagcccaaaacaggggaactagaaaaacagcgggcaaccgcggaagaaaaccccaacacggggggcgacaaaaagggacaccaccacaaaagaaaaacccccagggaaaaaaaactagcgataaaaacgtgcaacaaccataattctctcttaaaaaatatccccccgtcattaataaaatacatcacactactcatcaactcccaaccacacaccaatacacacaccaatcactaagaatcgtccatcacaaactaacactcactaccaaccataacacaaaccaaacctcctccaccagaacacaacactaaccaccacataatacacaaacagaccacaccaaaccacacacacatactatcactaaacaaacaacact

SEQ ID NO: 540389 - DNA, 167 bp, Homo sapiens
  misc_feature (14)..(14): n is a, c, g, or t
  misc_feature (88)..(88): n is a, c, g, or t
agctgaggggctgnggctggcgtgttgaagttggctttgcatgcccagcgatgcgcctccctgtggtatgtcatcaccctgggaccgngaggcccttgctcactgtgtctgctggttgatctaataattgtcctttcttctaaatcccaaccgaacttcttccaacc

SEQ ID NO: 540390 - DNA, 154 bp, Homo sapiens
agggtcaacacatctttattaaacacctgaagttactggtaggaggccatgatgctggacacacagtcaaagtcaatgttctccacaatgttcctgggtttaatgctctctttttggatacagatgaagatgtgcccccttctgtcgtcttctc

SEQ ID NO: 540391 - DNA, 392 bp, Homo sapiens
gctcgaagtaactttggaataaaaccagggtgggtaataaacctcctaatcctaaatttacatataagatctaataagcttgacacatcttgtcatcaaggactgaagacaggaagcagttcctgagtcagctggttcccaagctcgcacagaaggtgataagttaataatcaatgccagtggagaatcttcttatagaataacctgggcccaagtgattttagtacaaaacttgcccttctttggtttaattttctatgtgcttttaggtgtgaatccagatatgcggtcgggggggggggggggggggggggttcgtttagttactgtacactcttgtttgttcaataaactgcatatcaacttcccacaaaaaaaaaaagtcgacgcgg

SEQ ID NO: 540392 - DNA, 415 bp, Homo sapiens
cttcatagagaggtcctgccacatgttcgaattggaagctagaaaaaaaaaggtggcagcttcccagataggactcccttggtgcacatgctgtcattgcgaagtcacttcttactacctttatggcactgttttcaaagggtagcaagggtgaacatgcattgaggtctcaacagtcagctaagcctagaaagacgtgtgaatccagaattgggccaaatctcagcaggctttgtgtccttccttatttcatatcctaccttaacctgggccttgggccaaacttttcaaaattacacataaagaataaaaaagcaagcccatttctgacaatgggagatgtcagaacatctcagaatccattaccaacacactaaagactggattttacatcacaattagtgccggggcttcc

SEQ ID NO: 540393 - DNA, 312 bp, Homo sapiens
agcggctcatggcctgtaatcccagcactttgagaggccgagggaggtggatgacctgaggtcgggagtgcaaggacagtgtggcacaaatagtgggtagaaaccgctgtctatactaaatatacaaaaaaaaaaaaaattttctcgaggcgggtgatgtcgtgcgggcaaaggggggagagaatcttagagggggggggccgcggacccctttttgtggtgtcccctttgtaggagggggttatattcgagagcggtgggtattactgggtggtcataggtgtgttccgggtgtgtgtgagaatgtgtgtg

SEQ ID NO: 540394 - DNA, 98 bp, Homo sapiens
aaaaaattaatcaaagtaactaaatgattgcttcacccaaacagttataatgcagacccaccctccttttttttgcttggggctatttttccccctga

SEQ ID NO: 540395 - DNA, 163 bp, Homo sapiens
aggacacagtcttcgttccctctggaggactcagcaacaacacaccatattggaagcagagagcagtcctcaccagacacggaatctgccagtgccttgatcttggacttaccagcctccatacctgtgagaaataaatttctattgtctataagttaaaaaa

SEQ ID NO: 540396 - DNA, 119 bp, Homo sapiens
tggcgtttggcagttttaagttattagtttttaaaatcagtattttttaatggaaacaatttgaccaaaaatttgtgtcacagaattttgtgagacccatttaaaaaagttaaagtgag

SEQ ID NO: 540397 - DNA, 122 bp, Homo sapiens
cctgctctctctttattttaagagcacctattaaattagggttataattaaagttaaatgtgacctcatttaaccttaactatctctctaacagccttatctccaaaggcggccccggcgtt

SEQ ID NO: 540398 - DNA, 126 bp, Homo sapiens
aacacacaaacatacacacacatagacaagcatacacaaacacacaactgacaagcacacacaaacacactccccatttacatgtatgtgcaggatgggggttaggttctaagagttggtcgacgc

SEQ ID NO: 540399 - DNA, 428 bp, Homo sapiens
acaacaaaaaaatagcgtgggtggggtggctcactcctgtagttttgaggccaaggtgggaggattgcttgagcccaggaggttgataccagcctggccaacaaagcgatagcctgcctctcctaaaataaataaatatataaatatataaataaatggaaatataaaatgtgccggggcgaatggcgcaccccctctattcctggggccaagatgtaagcatcttctcgcccttagagattgtggccagcccgggcaacatatcgaaacctggttttttcttaatagaccgaaacaaaacaaaacaaaaaatagcttgggcagggtggtgcgtggctgcggtcctgaggcaggaggatcccttgagcccaggagcttgatgccggcctggccaacatagggaaacatggtttctactaaaaaaaaaa

SEQ ID NO: 540400 - DNA, 284 bp, Homo sapiens
  misc_feature (150)..(150): n is a, c, g, or t
tcacaggctcccctgcagcatttcagcaggctggcagcctttgggtgggggccgcagtgcacggggcaccatgttggggggcaaccgggggcatgtccagcccacagtcaggcaagcttctggccctttcccttcccagccccaggtccncccagtgtccttggcccccgtgttgggtccatctccttggctgggcccccaccttccccagtggcagcacagcctggcactggtcccttcccgggctccttcccccacagcgtcggggtcaccgcagctcgcac

SEQ ID NO: 540401 - DNA, 115 bp, Homo sapiens
caattgcatgtcggtggtggcggtagacaccgagtacggccgcaagcgccagatcgaccaatcttcctgcaacaaggacttcacctgcctcaacggtttctgcccgagttttgtc

SEQ ID NO: 540402 - DNA, 265 bp, Homo sapiens
gcggccgcctactactactaaattggcggcgctcgacatcagcttggacaatgtagtgagacctggtctttaccagaaaaaagaaaaaaaaaaattagctgggtgcgctggcatgtgcctgtggtcccagctactcaggaggctgaggcaggaggatcacttgagcacaggagtttgaggctgcagtgagcacatgggcaagagagtgagactccgttttgtgccactgcactccagccagggtgacagagtgagactctgtctc

SEQ ID NO: 540403 - DNA, 152 bp, Homo sapiens
tgtaatagagaccagaaccctgactgaggaaggtgttattaaagttaaaacagaggcttgcgataggcttttggctcatcgagtggaaccaaaatgaagggaataagtgaatgaggtctgatagatgcactgctatccaccagaggacgtag

SEQ ID NO: 540404 - DNA, 327 bp, Homo sapiens
aatctagtctctctaggtggtctccgctgtcaccattatcatggcttcctatttgtcttcatagcctttgactttatcccagttagggttttgagatgccaccttgtagcttcatttggttggaagtctagtcttcccatctggtattttgctttcattggtaggggattcctggtatatacttggtatttagtgtgttgctgtgtgtctatattttgggggattttcatatcattgagcctagaatctgttcctcatattcttatatcttagaattttttgattatgtttgagttttttttctccttttagcaaacaattaaaaaa

SEQ ID NO: 540405 - DNA, 111 bp, Homo sapiens
agattcgagtggagacgtccccaagattatgggacatcttttgtgattagtatggccgtgattggtacaagagccgtgcaaagtttgataggtccaatctgcttcacaacc

SEQ ID NO: 540406 - DNA, 118 bp, Homo sapiens
tgctccaccactacccagtgacacacgccttcatacatctcacgtagggggacaaaaaagggggaacgggggggcacgagaggctcagtcattcaaaagtagaacagaagtagcaaag

SEQ ID NO: 540407 - DNA, 129 bp, Homo sapiens
actgtgagccatgttgcgggaacggagggtgtgtagctgtagggtactacggaacactggtctcaggtggctcattgcaagtggtcccagctcagcgtgcagctctgctactcagagggcaggtcttct

SEQ ID NO: 540408 - DNA, 1119 bp, Homo sapiens
ccttgtttgtacgttgtcttgttcagttgatcataggaagaatgaggtgtatccagtattgataattctgcttcttgtaaacaggctgagtttttgaactgttttaactgtgatcgaaggctctaatagattggtctgtatgattatcaattctaatgtggtaatttgtctcctactaattccctgtttctggatcgcaggggaaattgttttcagatggtgttgagaatccctgtgggatccatgtcggtttgatctgtgtggaggggtaggaccgtgttacggtgaacgggatattcaggttgtctaatgctctgttgggctttccttttattccagtattggaacttttgacatcttgatcgagtcgtcagtcaacctcgttcagtacaaggtcagattggtctagcatggagatgatcacgtgtgtactcaatgcaaggcatcccaatttagtcgtagaccatatgacacagggtcgcctaatcgatcgaacgttaaggtatactttcctgagatatggctttctctctcctgactaaatctgtctctatgctggacaaactcctacccgagaggaaggaagtggaagagactgatgagatggaccaagtagaactggtggactttgatccaaatcaggaaagacggcgccactacaatggagtaagcatatgaggatgatgaacatcatcccatgaggtggtgttcagtgtcagacctcttaatgggccagtgaataacactcactgctggcatttaatgtgcagtagtgaactgagtgaaggacatgtaagtcataagtatgctcactacttgctcttgtttttgttttaataaactatagtagtgtgtttgaaacaagctctgatacactgcaagcatatacaacggcacaatagtagaaagcctctagagttgttgtccctgtagtgtatcgactgacttcagctgtgcaagatgcaagctttaatacctgtaaaaactacaaagaagttcccctagcatttgctaggccaaaccttgtaattgacttcagctatgtacgtggacaagcttagactgagatgtctaggtatatgtattggcttcagtgtatgaaccttcattgttaagcta

SEQ ID NO: 540409 - DNA, 754 bp, Homo sapiens
atgaccccaatacgcaaaactaaccccctaataagaattaattaagccgactcattcatcgtactctccgccaacccattccaacatctccggatgatgaaacttcggctcactccttgtgcgccgtgcctgaatcctccaaatcaccacgaggagcgtattgcctagccatgcgctacttgcaccagatcgccgtcgaaccgctccttttcagtcaattcggccctacgatctactctgagacagtagattagaggctgagatcatccgcgtaccttcacgccaaatggcgcctcaatattctgttatctgcctcttccgtacacatcgggcgaggcctatattacggatcattgtctctagctcagaagacgctgaaacatgcggacattatcctcctgctatgcaactataggcagacagcctatcataggctatgtcctcccgtgaggccagaatatcatctctgaggggccagagtaattacaaaattcactatcgagcgatcccatactattgggtacagacctagttcaatgaatctgaggaggctactgcaggagacagtcccagcctcacacgattctttatctttcacttacatcctgcccgtgcagttagtgcagtcctagcagtactccacctccttatgtcttgcacgaaaggggatcgaacaaatcgccctaggaatcatctcccattccgataaaatcactttccaccttactacacaatccaacgacgcctcggttat

SEQ ID NO: 540410 - DNA, 344 bp, Homo sapiens
cccaagctcatctgagtatggttgtgtggcatatgatttttttcattgaggaggtcaaatctgaaaagactgctttgaaaagaaaagttcaggaaccctagagaattccacaaattatagcaaatttcctcctctgaaaattcttgacattgaaaaaccataagatcaaatgattgttttatttttcaatagacagaaattaagagcaaatgattgttgtatttttcaatagacagaaattaagagctaaatttgagtcaaactgggcatgtaaaaataggatgcagcccctggagaagagcttgtccaaccaggagtagtggaaagccctacaaaaaccaagg

SEQ ID NO: 540411 - DNA, 120 bp, Homo sapiens
tagggatacccagggtggtgggggaagggcctggagggggctatgtgggagcagccactgcgatggtagttcttaagaggggatcattaattgtataagaataagtaagcaagttttcta

SEQ ID NO: 540412 - DNA, 407 bp, Homo sapiens
gctcgaccggattgcagtgagccaagatcgcaccactgcactccagcctggcaacagagcgagactctgtctcagaaaaaaaaaacaaaaaccagtttaggctgggtatggtggctcaccagcactttgggaggctgaggcaggtggatctcttgaggtcgggagtttgagaccagcctggccaacatggtgaaaccctgtctttactaaaaatacaaaaattagccaggcatggtggcgtgtgccagtaatcccagctacttgggatgctgaggcgcgagaatcgcttgaaccctggagatggaggttgcagtgagcagagattcgcaccattgcactccagcctgggcaagagtgagactgtgtctcaaaaggaaaaaaaaataaaagtcgacgcggccggcaat

SEQ ID NO: 540413 - DNA, 130 bp, Homo sapiens
  misc_feature (68)..(68): n is a, c, g, or t
  misc_feature (70)..(70): n is a, c, g, or t
gcttctaatgtcagctctttttgaggcattccaatctcttagtactaaacgtcatctgagatgagggntntcctaaaaattggcaataagacatgacatgaaatgcccgcctcctcccaataggtccttg

SEQ ID NO: 540414 - DNA, 245 bp, Homo sapiens
tgacatcatgacccttggaccataatatgatatatctaccacactagcagagaccaaccgaacccccttacgaccttagccgaagagggagtaccgaacatagtctacagtgctatcaacatcagacataacgccagcaggacccctatacgaccctcattactatcataagaccgaaatcacaacaacacatatattcataactaaaatcaccctacaccactcacaatacttccataggaaca

SEQ ID NO: 540415 - DNA, 128 bp, Homo sapiens
tcataatacttttttttattacaatatccaaaaaactgggtatgcaagtaggggatctcgagacccctctgaaggagggacggggatcgagagattgggatacccatggccgtctacatatggcttgg

SEQ ID NO: 540416 - DNA, 225 bp, Homo sapiens
ttaaaatgaattgattcagcacttaaacaccttaggctatcgtcaagttgatgtaaaagatgaaaagcagctcctaatcaatctcaaaacccagattgaacaagccaatggactttctgtactttctgaaaatgaatggggacagattctcaatcatctgaaagccggtaatagcttcaattgtgccaaagtgctacgtcatcgctttccagtgaactttgatga

SEQ ID NO: 540417 - DNA, 967 bp, Homo sapiens
tcgtggatgagactcgagtgttttggctacatctaccacaagctgttggtccacgaggtgaaggacgtaatcatcaagtgccaattggccaagcgcttcacgagtgcagtggcatccccgactccaaacactcccaagtttatgtcgtgaagactgtgctgcaaaaccactgagcctgatccaggcccgccaggcacgggaagacggtgacgtcgtggccaccatcgtctaccacctggcccgtgcaaggcaactgggccggtgctggtgtgtgctccgagcaacatcgccgtggaccagctaacggagaagatccaccagacggggctaaaggtcgtgcgcctctgcgccaaagagcccgtgaggccaatcgactccccggtgtctttttctggcccttggaaaaacagatcaggaactatggacagcattgccatgagctggagaagctgcaggcaggctgaaagacgagactgggggagcttgtcgtctgccggacgagaaagcggtaccgggccttgaagcgcaccggagaagagagagctgcttgatgaacgcggcatgtcatctgctgcacatgtgtgggcgccggtgaccccgagggctggccaagaatgacagttccgctccattttaatcgacgaaaggcaacccaggcagcgagccggagtgcagtggttccgcgtgctccatcggggaccaaagagctgatccctagtaggggaccacttgcatcgtgtgccacgtggtgtttttcaaaaaggcgcaaaggccggcatgacacaagacgtcttcaagagccctgggagaagcgcaacacggggcaccggtcaagccaaacggtagtcctctgctaagagagccatcaacaggtatataagtccccccacaagggtagcgctgcatagtcttaaaagtgtttccgcgtcaccaggcagggcttatacaacgcagagtaggttgccca

SEQ ID NO: 540418 - DNA, 895 bp, Homo sapiens
gttgctagcggagagggacgagggagaccaaatgtcggaggttggcgagtgggagggcgtctgtgcagagtgcaatctgacttcatttgtgccacacgcatggtgcacttgtccgccttgcgctgtcccatgtgcatgctgcttgcctgtggtgcccatggttgctcgctgagcagcggtgtggtgtcttggtgaggtgggtgttgatgagtgcacgtgatatgtgggtgtcacgaagtaaggtcgggaggtcagtcttacgttgtgtgcctagagattggcaagactcaatagatggtgtgcatgaaccaatgagaaattgggggctagctattctgccgcagtgggagcttgcaagtcgatggctaacatgttgatacctatttttctaacactctacaagcaccaaaagacagcccgtttgatacggatacaacttgagcctctctacttctatctctcgtaacagatatgttacaacccgtccaagataactatttcacttgtaaaaactctgtgtgttaaccacagtggatgcctcaatcttgacgcccccaaaggctcacgcgcacatcgccgttcccacacgcgttctttttggggtgagctaatgaccgccattgtgtacaatgacggcgtcttgggtggtaagcccacagggtcaaaatttacggcaggggcggacgagctcagagcgcgggatacaatattacacataccaccctcctttgacttggtctttccacgtcaaggtgccgcgtttaagccccgtttattcatatcagccaaaagcacgtgaaacttagcttaccccaaggctaaccagcaggggacgcacaaggggcctctctatgctcttctctcacgcgcacgaacaaccctatgcggtgcacaa

SEQ ID NO: 540419 - DNA, 589 bp, Homo sapiens
gtgattccatcgtattttggtgactttctggatgagaaggctaaaaagaagagtggccccttttctaaaattccaaatctttccttttggaagatgacggcatgtgaaagaaataaaaggtgaaaagattggtaaaggatgacgggctctagtaccaactaaaggccaggggggacggtaagtcacggaggtgacacaaagcagccaggggttttcctcgcctttttgatggggaaaaggcacctttcaatcctagaagataatgggactgggcaaagtccctatgggtagcaactattttcttactttaaaaaaaaggggtgagcggggagccagacggtgcacatcagccaagatggctatggccaaagggagcccagaagcatccaggtacactttccaacaggcagaccctaccaggaacggggagacaagagcgggctctctcctgagataagacaagtttaaggtgaagacctttgggaaaatcccggggttgtccgggctctttacagtgggggtagctctgaggaatagggaggttctcatgaagatatcttaaacttccatgctctgagaaatctgagac

SEQ ID NO: 540420 - DNA, 287 bp, Homo sapiens
ctcgctgcactgtggaaagatccctgtgcgtatctctaggctgcgtgcccttttgtgcactgtaagtgagttaggactcttatgctgagcccaaagtgaaaagggttaccagaccactatcaatctgatctcagaccatctatcagttccaaagacctgattccgggaatcattgctttgtgttttaaagagccagcatttgtactgtgttctatggttgacaaataaatattgcacagatttttgatatatctctaggaaagaagacatctgcccatcaaggatga

SEQ ID NO: 540421 - DNA, 164 bp, Homo sapiens
cagaaacgccagggttgcactgatagagggaattcccgatgacttcatccctgattttccaaagatgatgatgggagcagtgccaggggcttccttctccggccaggccccagcctcttcgcaccctcagaagcacctcttggaaaagccaggccccagtctgc

SEQ ID NO: 540422 - DNA, 434 bp, Homo sapiens
catcacagatggggtgttaggggaaggacgattgcttttgaaatatgaggacatgagattgggaggggcggggaagaattatatggtttggctctgtccccacccaaatctcatcttgaattgtaacaattcccatgtgtcaagggtggggccaggtggagataactgaatcatggaggcagtttcccccatgctgttctcatggtagtgaataagtctcatgaggtctgatggttttataaatggatgttcccctgcacatgctctctcctgcccaccatgtctgactaaattttgtatttttactagagacgggggttcaccgtcttagtaaggatggtctcgatctcctgacctaatgatctgcccgcctcggcctcccaaagtgctgggaccacagacgtgcgctgccttgccaggctaaattttaatat

SEQ ID NO: 540423 - DNA, 179 bp, Homo sapiens
  misc_feature (45)..(45): n is a, c, g, or t
  misc_feature (123)..(123): n is a, c, g, or t
  misc_feature (142)..(142): n is a, c, g, or t
cagagatcctaacactggctgggaacctctgactcagagcatgtntttaaagagtccacatctggccaggcgcggtggcacatgcctgtaatcccagcactttgggaggccgaggcgggtggntcacgaggtcaggagtttnagaccagcctggcaacatagtaaaaccccgtccctac

SEQ ID NO: 540424 - DNA, 601 bp, Homo sapiens
  misc_feature (83)..(84): n is a, c, g, or t
  misc_feature (92)..(93): n is a, c, g, or t
  misc_feature (114)..(114): n is a, c, g, or t
  misc_feature (141)..(142): n is a, c, g, or t
  misc_feature (151)..(151): n is a, c, g, or t
  misc_feature (227)..(227): n is a, c, g, or t
  misc_feature (355)..(355): n is a, c, g, or t
  misc_feature (426)..(427): n is a, c, g, or t
agcggtgtcatcaacagcactgccctatcagtgaagtcaaagattgaagacggaactctttcaacacctttcaacgtgccccnnctcctttnnccttaaacgtcttttaataanggggtcccccctatttcttggcccaanntctcccaanatccattgactgaaaggatcaaagcgacacctgaacacagaggcgggcaaaacaaaagaaaaccaaaaaggggggntttccaaaccctttggggagccccaaaggggccaaaccttatgtggccctcatttggggggaggggggcccaaaaaacgggccacaccctgtttaggcgccccaaaaagaaggctcccaaatcgtccncggagcccaaaaaagattttccaaaaacccctcattgaggggggacggcacgcacagaaccattccccttnnggagaaacccaggaaagattgtggggagaaaacccccagaaaagaaactacttggggccgggacccacacccacgggccccacccccctattgtgacgcccaccccagacacagcacccgaccccatattttaccccgtttttgggcacaagagaggcggggaggggacaccca

SEQ ID NO: 540425 - DNA, 886 bp, Homo sapiens
ggagcgcgcatgcgccgcacgccagcgctctccccggatcgtgcggggcctgagcctctccgccggcgcaggtctgttcgcgccagtcgtcccgcagcatgacaaccatcatcgagcgggagttcgaagagtaggatactcagggtcggttggcagccggtgtgcttggaaattcgacccactgtagtcccatgacgtatcctgcatagagttgtggctcaagtttgccagagaaatacgaacatcgaacacgagagtgacagagatgtacgccgcatatgatcacaggcgtgtcagctgtgcaaggtgctgagaatgctgatattaatgtccagtcaagttagactagtagaagaggagccaaagtgagttaacatgcgttaaccgagagggggtccagtttgaatatacactgtgctgtccacttatcgtggtctggagtgggtcttgggcagacagtaaagaccaaaggcggattgtgcatgctgataccgtgattggtgggagacagcgaatgcggatttgactgtgcagaagtattggtgcaagagattggaccaaagaggattgctgtcgtaacacgaccggcgggagtcaggcgtgcacgctcagggtccgagaagattgttcagaggttgtatttctaacacggcactagtcctattgtgcctgggcaaataatctcaagcaggggtggaaaccagcagaatatctccacttccttccctagacgccgggcgcgaaattgggcgccctgaaatacgcagtgccttcatcagatttgcctggtcacactggcaccacctgcgcgcgtgggccggacacggccggggagccctgtgggcacgtcggcggctgaacattttgtacccgcggagcgcccgga

SEQ ID NO: 540426 - DNA, 285 bp, Homo sapiens
taatcgtcgtcttatttcccgatatagcattccctgcatcagtactgacaggctgggtagagggtgataaattcccttaattttgctcgcctgagacacactttatttctacctaatttttctctttctttttttttttaaagtggagtttcaatcatctggcccatgctggagtgcaggggcatgatctgggctcactgcagcctccacctcccgaggttcaagcgattctccgtgtctcagcctcgtgagcagcggggataacacgcgcagtgccaccagtgc

SEQ ID NO: 540427 - DNA, 907 bp, Homo sapiens
gactcagggaccggagcagccctcaactcactcttcagttccctgctgtgttgctaggccagccgctccattcatgtccttcagtgctgaccagattgctgaattcaacggaggcagttcgtcctgtttgacagaacaggtgatgccaagtatcaccttaaagccaggtcggtgatgtccttcgagctctgtggcacaaatcccaccaatgcagaggtcaggaaagttctgggaagaccccagcaatgaagagctgacatgccgaagaaaactgagtttgaacaattttctgcctatgatgcaagccatttccaacaacaaggaccaggcacctatgaagacttcgttgagggtctgcgtgtctttgacacctggaaggcaattggcaccgtcatgggtgctgaactccgccatgttctagccaccctggtgaaacagatcacagaggaagaagtggaagccctgatggcaggtcaagaagactccaatggtctgcatacaagtacgaagctttggtccagcacatcatgtctatctgacatgggagctctctaagacccaagcatgtgttctaggacacactggtgggcacttatttgtagtcaacaccccatgactaaatctctccagattctgtgtaccattcatcagggaaaacaaaagcaatctggagggttccaagaactgaggcaactccctgaatttttatacattcttcacgtttggtcttgaatgggattgcttaccaccccaaagaaagtgtgtgtggtctcagatggagacagcataacattttggcgatttaattccaagcgccatctttatattttccaggaacaagcacgattcttaacacatacatgctacacattggcgcgggcgcgtgtcaagagagacacgaacatac

SEQ ID NO: 540428 - DNA, 292 bp, Homo sapiens
ccagcactgtctacagcagttgattgctcctttcagggagtagcttgattcagaggtatatggtaggataaagaacctgtccagtagttctcccaaataacgaagcggtctctctctctctacagcattcatttctctctgtggggctcctcaatgccctataatcaactcataatccaaacatttcgtgaaatccatattttccagataaggagactggagtatatggtaccgaactatatattcgcagggttctaaatgccatgtgccatagagctgaccctccccaccg

SEQ ID NO: 540429 - DNA, 142 bp, Homo sapiens
acccagtgccacttgatcagcaggccattgccctacactttgtacattaacaaagccccttctgtgactccatatttcaacgcaactcactgctccaccacggtttctaactttcctctcagttccccacattccaatagga

SEQ ID NO: 540430 - DNA, 225 bp, Homo sapiens
ggtccgaaaataaggacaggatatataaagatggaaatataactagagtctggagagagcatgagatataagcactcaagtcaagtcttatttctagatctagacaacaaagcttactggctcccaaacacccaatattgttcctcaatataaaaattaagaacagtagaatgactttacccatactggactgacgcttttacatacagcacattcatctttcac

SEQ ID NO: 540431 - DNA, 826 bp, Homo sapiens
  misc_feature (18)..(18): n is a, c, g, or t
  misc_feature (21)..(21): n is a, c, g, or t
  misc_feature (27)..(28): n is a, c, g, or t
  misc_feature (39)..(39): n is a, c, g, or t
  misc_feature (49)..(49): n is a, c, g, or t
  misc_feature (51)..(51): n is a, c, g, or t
  misc_feature (70)..(70): n is a, c, g, or t
  misc_feature (83)..(83): n is a, c, g, or t
  misc_feature (90)..(90): n is a, c, g, or t
  misc_feature (98)..(99): n is a, c, g, or t
  misc_feature (106)..(106): n is a, c, g, or t
  misc_feature (115)..(115): n is a, c, g, or t
  misc_feature (175)..(175): n is a, c, g, or t
  misc_feature (189)..(189): n is a, c, g, or t
  misc_feature (214)..(214): n is a, c, g, or t
  misc_feature (216)..(216): n is a, c, g, or t
  misc_feature (220)..(220): n is a, c, g, or t
  misc_feature (222)..(222): n is a, c, g, or t
  misc_feature (227)..(227): n is a, c, g, or t
  misc_feature (244)..(244): n is a, c, g, or t
  misc_feature (246)..(246): n is a, c, g, or t
  misc_feature (259)..(260): n is a, c, g, or t
  misc_feature (266)..(266): n is a, c, g, or t
  misc_feature (272)..(272): n is a, c, g, or t
  misc_feature (278)..(278): n is a, c, g, or t
  misc_feature (281)..(282): n is a, c, g, or t
  misc_feature (292)..(292): n is a, c, g, or t
  misc_feature (301)..(301): n is a, c, g, or t
  misc_feature (304)..(304): n is a, c, g, or t
  misc_feature (328)..(329): n is a, c, g, or t
  misc_feature (332)..(332): n is a, c, g, or t
  misc_feature (344)..(344): n is a, c, g, or t
  misc_feature (346)..(346): n is a, c, g, or t
  misc_feature (349)..(350): n is a, c, g, or t
  misc_feature (365)..(365): n is a, c, g, or t
  misc_feature (370)..(370): n is a, c, g, or t
  misc_feature (372)..(372): n is a, c, g, or t
  misc_feature (405)..(405): n is a, c, g, or t
  misc_feature (422)..(422): n is a, c, g, or t
  misc_feature (424)..(424): n is a, c, g, or t
  misc_feature (427)..(427): n is a, c, g, or t
  misc_feature (444)..(444): n is a, c, g, or t
  misc_feature (452)..(452): n is a, c, g, or t
  misc_feature (471)..(471): n is a, c, g, or t
  misc_feature (499)..(499): n is a, c, g, or t
  misc_feature (503)..(503): n is a, c, g, or t
  misc_feature (592)..(593): n is a, c, g, or t
  misc_feature (627)..(627): n is a, c, g, or t
  misc_feature (635)..(635): n is a, c, g, or t
  misc_feature (660)..(660): n is a, c, g, or t
  misc_feature (730)..(730): n is a, c, g, or t
  misc_feature (802)..(802): n is a, c, g, or t
gccggcggggagagaagnggntcccgnncgagccccggncccaaggaangncgccgccccggagccgccngggagggcccccnccccacnaagtgccnntgtgcanagcaccagngcccacccgcacgcgcgcgggaccacgacagcgggacgggcaagggcggggcggggaggngcagacgacccaanggaccagcggcggggaacaagagcngngaangnaagcnggggcggcggggggagngngcgggaggcaaanncagccncggccnccgcgnggnnaagggacagnggcacgagngcnaggagagcacaaggggagcggccnnccncacacagacggngngcnnggatgacacaacagngaagngngagagcggggacacagcgggacaggagcgggancacagcctggcccccangnacnatcggggggcccaggcngccatcgngggcgaggagagcaccaanacagagacaggggcacgggccaagaacngggngaaggagcgacagaggcaggccagccccaacatcgtcattgcactcgcgggttacaaggcagaactggccagcaagagagccgtggaannccaggaagcacaagcctatgcagacgacaacagngtgctgtncatggagacatcagcaaagactgcnatgaacgtgaacgaaatcttcatggcaatagctaagaagcttcccaagaacgagccccagaatgcaactngtgctccaggccgaaaccgaggtgtggacctccaggagaacaacccagccagccggagccagtgctgcagcnactgagccccccttgcctgcccgc

SEQ ID NO: 540432 - DNA, 366 bp, Homo sapiens
ctcagcagtgaggaataattagcctagactgagcacagcgccagaatcccccaccaaatcatgacagcaacccgaagggattgaactgtttccaacaaacttaactgcatcgcagaacaaagcacacaattatttataggaacacaaacatatccagcacccagcgaagtaaaattcatggtgtctgacatccaataaaaaataaccagtcatgcaaagaaggaaaatatgacccatagtaaggagataaatacatcaatcaaaactgacatagaactgacacagaagccaggattagcagacaaggacattaaaacagttattataactgtgttccatatgttcaaaaagtcaaggagagacaaa

SEQ ID NO: 540433 - DNA, 442 bp, Homo sapiens
aaaaagggggggtatcccttttccaaaggctccaaggccctcctccccttccaaattcagggaccccaacccaagctcaactctgggacctttgttcccagcaatctcttgtcctctttgattaaagaagattctccttccagggcctaaagcctggggatttgggcccaagaagataaagaatcccaaactatgaggctagttctttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatg

SEQ ID NO: 540434 - DNA, 387 bp, Homo sapiens
ctgacctgccaggtcacaaaccaagcacaggacactgatttagtgataggttaaggacgcaaagctttgtctacaaacttggagggtccgcagaaaggaacattacggtctggcacaggcaccatcaggaagaaactgagagcaaagaatggcggtcagagtttcgtccctggtgttcccccttatctgacgtctgtgtgcactccatttggtgggggtctgggtattctcgaaaagtcagctcaggggcacgtgtacaggatgtctctaggtgcactctcaacttccctggctattgtatgaaactgttatgaccttcttgcttatcagcttgctggtttccttctcggggcgagctgggtgcctggcagtttacggtgaaggaaa

SEQ ID NO: 540435 - DNA, 736 bp, Homo sapiens
gcctacagtttcgtttccatctcacgacgcgttcactgatcgccacgagtatactgcatatacgcaaagacacagacaatcttcagaaatgatcttttgccaccggagcttggaaattaataagaatagctggccatgcctgaaaggaacttctttcgcatcaacatttcgggtttggctgttggtaccagccatggcgataatggccggccattatcagttcttcctgcggttcgggtttggcagtaacatatatattttaaacacacttatcttgttttaaaagtttgatcttttcaatgaggcttcctggggcttcgttttattactatttttttcggtcgtgggtggatcgggggcgagatgctaaaatatagctgctaggatccagaaataccacactgtttcatatattcggcaacttgttcattggctagccttatgccagctgcactgtccaatatattctgttccccttggttaccaagcttcaatataactcttgtgttcaggcgaaatgaggctttttatcctatggtaatattttcaattgatcataagatgtcattaaaattctactgttgtaataggagaccggtgtacccaaattactcttgacctttctataaaggacacgcaatggagtcgtccttgctctcacgcaggattgactccctcatgttcaaactcatcatcgacttcaacagctaatcctagtcttcctaagaatcaccaa

SEQ ID NO: 540436 - DNA, 1541 bp, Homo sapiens
  misc_feature (822)..(822): n is a, c, g, or t
aaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttgnctggtctgaaagtagtgggttatcttgatgaattgttaagtcagttacagatcaaactccatgttcttttctctgttctcacgactactcttgactagtctaaaaatatattaggtgttgaaaagtaatcgtggttattgccattacttttcttaacaagatggcaaaaaacacaattataagtagcacacatttctgtcggtttccctttagtttggagacagaagtctcggtaacccaggctgggaagtgcagtggaggcaaacacagagaaactcaggagaaagacagcacacacatggatccaaggacaatgcgccggacgaaggcacactaagagtagccgggcacttacgagccctttgcacaccaggtactcagataaaactaagaagccagaacacaagataagaagataagagacaacacccaaggtgggcgccacagagagagggatactagagcgaaagcggacacacacgaggccacaaccagacaggacgcaacaagcgacagcacaacgcgcagcagtcgatgaaaccgatgtaacgacacacgcaggaagcacgacgggacgacgcaaaagcggtacgaagaaatacgcaacggagtagaaggagaagagggagcaggacaagcatgatacccgggggaaagccaggaaggcgaacaggcccagcaccaacggagcagcgcggcagacggcagccgagaccgac

SEQ ID NO: 540437 - DNA, 100 bp, Homo sapiens
gcgtgtcgggtgctaggctgcagacccgccgcatgacgctgcgcgcggccgtcttcggaccttgacggggtgctggcgctgccagcggtgttcggcgtcc

SEQ ID NO: 540438 - DNA, 261 bp, Homo sapiens
tgcacatttcaccgtgtcagtgagccacattgatatggcatgtccaaagacagcacagatttagaatatactacatcattgtagaaagctctattgaacgctgctgagtaaaagggtcaattgggtttggttttgagatcggagtctcgctctagtagcccaggcttggatatgcaatggcaaggatactactgcatcacttgcaactctactgcctacccaggatacgagacaatccatcctgtatacagccccccctaa

SEQ ID NO: 540439 - DNA, 271 bp, Homo sapiens
cgcggtatctagaggatcccacgacggtctctcgatccaagtggacttgtactatactggatcagctgcaaagtagggtgtggggtttttgttgtttttttgtttgtttgttttttgcttttttgttttgagacggggtctcgctctgtcgcctaggctggagtgcagtgttgtgatcttggctcactgcaacctccacctcccaggttcaagcaattcccatgcctcagccacccgagtagctgaggacatcgttggggtaccgagctcg

SEQ ID NO: 540440 - DNA, 364 bp, Homo sapiens
  misc_feature (103)..(103): n is a, c, g, or t
  misc_feature (223)..(223): n is a, c, g, or t
  misc_feature (325)..(325): n is a, c, g, or t
gtggtagagtcccccctatgcgcttgcccttgggccgcaagaagggagccaagctgtctcttgaggaaaaaagagtttttaaccaaaaaccgttttaaaaaanttcagaagaaatatgatgaaaggaaaaagaatgccaaaatcagcagtttcctggaggagcagttccagcagggcaagctttttgggtgcatcgcttcaaggccgggacagtgtggccgancaaatggctatgtgctaaagggcaaaaagttggagttctattttaggaaaatcaaggcccccaaaggcaaataaatccttgttttgttttcccccatgtaanaaaggtgtttattgttttgttcccccaccaaaaaaaaaa

SEQ ID NO: 540441 - DNA, 294 bp, Homo sapiens
  misc_feature (153)..(153): n is a, c, g, or t
  misc_feature (255)..(255): n is a, c, g, or t
cagctggcttcatgcttgcccccagggtacctgaacccccaaaaatttttaagcgggtggaaaggtttgggtagggcccccttgtcgttgtgctaaggatcacctactcttttgcagcgtgcatcgcttcaaggccgggacagtgtggccgancaaatggctatgtgctaaagggcaaaaagttggagttctattttaggaaaatcaaggcccccaaaggcaaataaatccttgttttgttttcccccatgtaanaaaggtgtttattgttttgttcccccaccaaaaaaaaaa

SEQ ID NO: 540442 - DNA, 229 bp, Homo sapiens
tctaggattgacacatagaatgccacacaaggtacctgcacccaagtgctgagcctgccacccaaagtgctgagcctgcagccaagttcagagcatgccacccaaggtgcctgagtcctgcccttcaatagtcactccagcgccagcccagcagaagaacaagcagaagtaatgtggtccacagccattcccttgaggagccggccaccagatgctgaatcccctatcc

SEQ ID NO: 540443 - DNA, 303 bp, Homo sapiens
atttggagatcatacttctctgaatgtccagttggaaagatgtagagttgttgcccaagactctcacttcagtatacaaaccattaaggaagtgagagttgttgcccaagactctcacttccttaatggttgtatactgaagtgagagtcttgccactttagaacatttgtacaaaaagaacagtgtgacttctcaaattcattaaaatgtacagcagtagaaataagaaacattattgaaaaagtaaaatgttctctggaaataacactaaaagaaaaacatcaaaaagaactactgtcttt

SEQ ID NO: 540444 - DNA, 402 bp, Homo sapiens
tggctatggtttgatgcccttcagctcctcaccgtgcctggctggggcatgtgcatttgcatgagcctgttctgaccatgggctgctcaggggtcccgggcaggctgtggtctctgcagtggcctgtgccgagttccttgtgttgctgtgacagtcccccaggtcaggtgattcatgaacacagaaacttctcagagttcttgaggctgaaagtcttagaccaaggcctgggcaggtttggggtctggcgagggccctaggttccctgccgtgtcctcccatggagggtgggagggcgacagctctgctgctgaggcctgggggtagggactttcatccccttccacacctcaccacctcctaccggccccccgcctcctaccggccccgcctcctaccggc

SEQ ID NO: 540445 - DNA, 463 bp, Homo sapiens
  misc_feature (463)..(463): n is a, c, g, or t
ccttattgttgactgctaacagccatcatggggcgtacgcatgctaccggcaagggcctgtcccagtacggctttacgctatcgatgcaactttcccactagtttgaagaggacatgagcctacgtgcctgagcagatttacttaactggccatgacgggtctgactatttcacagatcgaagatactctgatagtaccactatggtgacgcacaagaccgttccgtgacatgggccttattacgagcgaatacctgcttctactgcacttgcacctgacctgactggagaacgctaccactctaatcagcttaaactcgactgactctatttgagagccgcattcaccgtttggctcgatattataagaccaagcggttgctcgcttccaatcggaaatatgtatcatctaccgactttgtgcttgccgcctaaatttgagctgagtcgtcagctatacacn

SEQ ID NO: 540446 - DNA, 273 bp, Homo sapiens
gttttttttattcccaaaaatttttttaaaaaaggggtttttttcccccgattcctaaattgggtcccgagggggggggaattaaaacccccccgggggccggccaaatgagagggggcccttttaaaaccccccctttttagttgggcaaaggggcccgggggggttattggggggttttaaagggggtttttacctcccgggaaccgggttggggccgggttttttttttttaatttggggggttttccccctggtttacccggggtttta

SEQ ID NO: 540447 - DNA, 194 bp, Homo sapiens
gaaagcgtgagagtaatcctggagataacccaaaagttgcacatggaagtgggagatacatgaggagtatggcggacctctaaaggtaattaccatacttggatcataggacagattcacagaatcatgacacttccattgtttatacgcacttatgcagttcacaaacttgcttttacgctacagacatctta

SEQ ID NO: 540448 - DNA, 177 bp, Homo sapiens
  misc_feature (12)..(12): n is a, c, g, or t
  misc_feature (173)..(173): n is a, c, g, or t
agagcggcgggntactactctgctggcgaagaagacgacagaaggggaaagaaacttggactcattgtcctctaagagcttttccaactctaattgtaatgagtattgataattttcatcatatttgtaatgggtactgattcgtcctccctacttaagcattagtgctcacnctta

SEQ ID NO: 540449 - DNA, 460 bp, Homo sapiens
  misc_feature (39)..(39): n is a, c, g, or t
  misc_feature (147)..(147): n is a, c, g, or t
tgttttagggtggttattatgttttttttgtggtttttnggttaagagtaagttaaaaaatattttggtgagaatggtgagtgaagttgggataggtttttgttttaatattaagagaaattgattgtgggaaaaattgattttttngtattatgatttagttgtgaaataaagagttttttttgtggaaaagaaaaaaatatgttttttttaaatggtggattgaaaatgattttgatttataaagagaagattgagggtggggatattgatttagaaattttgtagtgtgtaataaaagaagaggaaatggtatggaattattgttttttgtgatttgaaggttattgtgaaggaaaataatgtagtgaaagaaagttttttatattaggatagatattattgtattatatttatttatttttttgggtatttttatagtttttaataaaaaatatta

SEQ ID NO: 540450 - DNA, 476 bp, Homo sapiens
  misc_feature (224)..(224): n is a, c, g, or t
taggctgaatatccactttgtttttatggatggctcccttcccccattcgccttccaagaatatccttcaagttccacttccaagggagctctgggggaggggcggccattctggctccgtccccagtggccaccttggaaacatcggctggctttgggactattccacctccttcccctgagcccagatctgcccccaccatccttcaagttccacttcccanggagctctgggggaggggcggccattctggctccgtccccagtggccaccttggaaacatcggctggctttgggactattccacctccttcccctgagcccagatctgcccccaccatcctttctctggcttcttttagcaagttatcaactaatcactaactccttccttttcctctgcatgccagcctgaaaattccaaatctagcctctgaatgtcttggctccatctcttcagacccctttgccttta

SEQ ID NO: 540451 - DNA, 114 bp, Homo sapiens
ggcctaagcctgcgtgggtatagtcggcggattaggatgtcacccccatccctcgcagcatccaaaggggtgcgtggtccgtctgtgacaattcctcaaatttttgttaatatg

SEQ ID NO: 540452 - DNA, 301 bp, Homo sapiens
acacctgagaacccagtctctaaggggactgtctcactctgactcccgtccctcatgtgctgtcccggtctctgaggcaggaactggaggatgtggctggccctgcgagccgtctctcccctactgctgggaaaatgagtccagcggaaagccagagtccccacattggctacatgaaggtccccatttctcccgagtctcatgggtgtggaggctgtgtactacagtgccaccaatcaactgccccaggtgccagccctcaaattctcaacttaacattaccctgtggggattaggcagt

SEQ ID NO: 540453 - DNA, 918 bp, Homo sapiens
ggtggctgctctgggaccacccgaacccgcggccatggccccggcctgccgccagccccccgtgaggtgatcccgcgcggcgcagaaggaccgagtactacctgctgtgtgggctgccgggagcgctggcgtggcggcgccctgcacagcctggcgggtgaggggccgggctgccggcccggacgtcctcgcgagcggcccagtgggtgtgttgcccctcatggagtgcggggtgtctgccgtgtgtggtcacggtcgcctgggcccgtcccacaacctggtgaccccgtgcagtctccttcgcctgccctgctggcattcagtggatgtgcgtggtggcacctcctgccctccctggccagttgtggccccagagtgcacagtgccgcagacaccgggggggacctgcgtggtggcctccagttcccgccaagcccttcccgtccccagctcagggcaggtccagctgacgccagcggcttggggaagactctgtcccctccaggtgtgaggccttggaagtgcttcaagcctccctccgatctcccctgtgagcagaggggtcagagcgccgctgggcgaacgcctcatacctcggtccgggtcacactgacccggcttatctaggctgagcagagcccaggccccctagcactgattgaacccagtgtaggctcagcagggcccttgctgctcaccaagcggcgagctgagtacagaagccagtggtctccaatgaagcagaactgtatccagcagtttgggaggcacaggcggaggatcagttgagccaggagtttgaacccctggaacatggcagaaccgtttctaacaaaacttaaattagcggaagtgagaggaatggaaaccacactaagagaggaaaaatacctaacccgggaaacgtagagcgatgca

SEQ ID NO: 540454 - DNA, 267 bp, Homo sapiens
  misc_feature (58)..(58): n is a, c, g, or t
  misc_feature (104)..(104): n is a, c, g, or t
  misc_feature (108)..(108): n is a, c, g, or t
  misc_feature (115)..(115): n is a, c, g, or t
  misc_feature (120)..(120): n is a, c, g, or t
  misc_feature (131)..(131): n is a, c, g, or t
  misc_feature (172)..(172): n is a, c, g, or t
  misc_feature (229)..(229): n is a, c, g, or t
  misc_feature (261)..(261): n is a, c, g, or t
acttcctcgggtggaaaatggggttaataaagtataccaggccgggcgcagtgggctnaacttcctgttaattcccaacactttgggaggccgaggccaggcgnaatncacttgnaggtncaggaattagnaaaccagcctgggccaacatggatgaaacttctgttctttnacttaaggaattagattagcccagacgtggtggtgggcgcctgttagttcccagctnacttctggagggctgaggcaaggagtgtttgncccggg

SEQ ID NO: 540455 - DNA, 139 bp, Homo sapiens
gtagcaggtcaggagatagaaagcgttgaacgatcatgcccgccatcatcctagatcctcatcgccctcccatccctacgacatcctattacatcacagacgagggcccacgatccctcccttaccatcaatatcaatt

SEQ ID NO: 540456 - DNA, 859 bp, Homo sapiens
gtatgtgaattttcgtatgttgccactgagggttcagatgatagacctcaaaaaaaatcgaaaatactggttgaaattgtagcatccatttagttattcttttgacctaaataacttaatagtttattaaatctaaggttagctaaatatgtagctaaccttattgttttctttcctaacaactctgaagaatacataggactttgcacttttttttttttgtttttttttttaaaagaaacggggtccggcctggtggcccagggtggggggttgggcccaccgtgggcccttggaccctgcaacctccggggtccaaggggatctcgggcgcaaagcctccgggagaagcgggagataacgcgcaccggccacaaaacccgccaaattttggcggatgtccaggggacgacggggtttcaccattgggcgccagggggggtcttcaaactcttgagggacctcgggtgatccacccgcattgggcctcccaaaggggcgggggatcacaggggtgtgagccccaagggcgcggggccgggacttggtacttctgccaaatgcatctcaatatatcgctggaattatttacccaaaagaataattcggggcgagaagtgggaacgttaacaatataaacggccgggccgagaaatttatggtgctgaagaccttcaccacaattttttttattaaacctcaagtcggttaactgggggaccctggtctgcgggatgtgaaattcgggacaaagctgtgtcaatcggggcattacgggtagtaacccggaccaatatttgttggggtgtgcccaaaaggggagcataagaccttagagggaatgttcccacaggttccg

SEQ ID NO: 540457 - DNA, 197 bp, Homo sapiens
tcacgcccattcacaactggctaatttttgtatttttggagagatggggttttgccatgttgcccaggctggtccggaactcctgggctcaaacaatcccaaagtgctgggactataagcaggagccaccacgcccagcatctacccacattctcaaccacagcttcaagagccacccccccctccccccccttcca

SEQ ID NO: 540458 - DNA, 415 bp, Homo sapiens
tcgctttgtcttaactttaatgcaattactgggtcatagcttttcacattttaattaagaagagagaatattttctatatttggctaataagttttgctaataatttttagttaacaaatttttaaaaaagcacaacccaacagagattctttggttctacagaaagtctgtatccacccccgtaggggtgggagagatgaaggaggaagaggagagacaaagagaaaaacattaaaaggggaaaaagcaagttggacaatatgcctcaggtaagacaaacacaaagatggggaaagaggtggtaacggaccaacagggaccatcttctatgagcaacaagcttccatgagcctggtaaccctccaggcaatgcagctaaagccttgcacagctgagtgacattctggtaccaca

SEQ ID NO: 540459 - DNA, 312 bp, Homo sapiens
tacacaacctagggtcagttttgcaggtgtaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctaacaattgttcatacaataattgttcattattgttctcaacttggggctctccccaacctggggacccttcctta

SEQ ID NO: 540460 - DNA, 389 bp, Homo sapiens
atttcccctgtcccgccccctcccaggacaaccaccccatttccagggcagcacctgcgctcccagctgccgtgcccgcttggtgcctgagtccgggccaggcagcccccgcagcgcccaggccctcgccctcgccctcgccctcgccctcgccggccccagcgccgccctttgcccggcctgggacttctctgccgggaaaggggaggcgagggcccctaggccttaggcaaggggctcaggcccaccgggtggggtgcgtgggccagggccgccagccccggggtgacttggctggagccggaggaaggagttggaggagggagcccggccggcaggggggcagctgtgggggcagcgcccgtggccgccccattagtatgcggccg

SEQ ID NO: 540461 - DNA, 3645 bp, Homo sapiens
ttccgctgctccaggtcccaggctcagccagagcaaaggctgtggaagggggtgttccaagcaccatcagtgtttccccaccatcacccagacccaagtgcagggactgaccttcccggtttgccaagtactgtcccagttttagcactgaaagtcccacatctcaggaaacccttcagtcctgcgtaagcaaggacaactggtgaccccagatcgaagctgtgcaattaggaaggggactcctctcagcccctggccagtgcttagctgctttggagatgagactcgtctcctgaatctgagaagtacagtcatttgctgcaggaatcaactcgtcccctagatatcggttcccttattcaacaactgtggcctgctataggagtcaatttcttgttacctttggtcaggggaataagacttacttttgagtttttcatggttttccccagtcttccccgcccgccccaccaagcttcccctctctaagtgcaacagaagcctcctcttagagggaaggcttccctggtctctatctcactgctcttttcccagaggagtgagctttagaatcacaaaagggcttgcacccagggctcttcctggtcctgcccccagttctctgaagtcagccccctcctcccatctcagcccctgagagagggtggtcagaggtcaggacttcttgctccttcatctgaaaacttgtgaccatgccagttgcaccctcctgtgccctcttcccttggctaactcacagcaacggcctttgggggtccacacgggggtcagaagagggctgcacatggagggggccctttccaaagtccttgtttgaggccccagcatttctatgtatgcacctgctctaaggtgtttccaaaaattaatgggcaacacccccaggtgcacagtcaggctccctttggtgtgtcccggaggccagcctccctggagctccatggcttctcaccggcacctgtgtgaggacgacatcccgcctttgtcccctgagcccacacctgctccccagagtcactgttgagtgcctgtgagcagcttctcagtgcacatcccatcagtaacaggcgcaacagcctcaacagctcagtgggttcccagcgatccacaatttcttcacgatagcttccttttctgtagaaagcagaacccagaacactcccctgggagattctgctgctagtcaggaagtaaaatgtgttcccatttctcgttctcatagtttgctcagcaggaaatcacctccagtcagagcagtgataaatcagaacacaaacaagcaaaggcagcacttgcctactttgggtcacaacacaggagcttcccctgcccatgagttgagtgggcctttcttctagctactggccttggcttccccagtactcgcaagtgtccaagttccctctgacttgcaccacagccaccacgtgttccttccactgtgagttaggagaggcttccagggagaggacttcatgtggctgggaaggacactgtgttaaccgggatgtcgggccccctgagctcagattctgtccttgtttgtggctgtgttgctgtgcctgggaaagtgtctcacacatgagtttggtagatggagcctcttgagctttcaccctcaagtagcacaagtggttcctgaggaggaggtgtgatcgccttcctgagcggtcatgcaaatgctgggtcggagcagaattgctggagtcagaggagaggctgcggggtggggatgggaggaaccgggaaaggaggcctgttgactggggaggtgggaaggggctgtggagagcaggctcatctgatgaggatgaggggttgatactgaggtgccatgtaagttctcacttcatttctcccacaaatcctccagtgccatgccccttgctcacagatgctctgatgtgaacaggttttatagtggaaaaggtcccaggccagaactgaggctgtctttgaggacaacgtatgatgaacacagtactgtttcctcttcctttttttcacttgaggtgaaattcacttaacataaaattaaccatttcaaaatgaacagtttgctaggctgggcacagtggcttatgcccataatcccagcactttgggaggccaaagtgagaggactgcttgaagcgaagagttcaagaccagcctgggcaatatagtgagactccccatctctacagaataaaacaaaactaaaaaattagccaggcctggaggcattgctactcccagcaatgtccagctactcctagctactcccagctactcccaagtagtctcagctacttgggaggctgaggggaaggactgcttgagcccaagaggttgaggcagcagtgagccatgaccgcaccactgcactccagcctgggtgacagagcgagactctgtctctaaaacaaaacaagacaaaacaatttggtgccattcagtaaatttgcaatgttacacgtctctatctagttcagaaacatttgtatcaccccaaagaaagacccagagccattaagcagccatgctcccatgtcttctcccctggacatgtgtcttccctgctctgtccctggctctaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540462 - DNA, 371 bp, Homo sapiens
caatctttacaaactttctactgactatagtgaaagatacgatgtcactattccctgaaataaacagttaaatttataatatcatattctgtgtgtatgagatacctctaaactgagtgtctatactaaagtctcttaaaaccagggctaggaattactatctaaaagttatggctttgttaatggcgggtttaaaatatttcagggactttgaattttaaggaaaacttgatatactgtacctatttcaagatgaagtgaaagttaggctagctgttaccatgaaatacatgatgtctagctagatcctttgtgcataatgacacagactgatcaatattcaagcttgttgctttaaaatgttaacctgc

SEQ ID NO: 540463 - DNA, 1043 bp, Homo sapiens
  misc_feature (27)..(27): n is a, c, g, or t
ggggaaagctccagcatttttctaatnctttttctttcaagcacgaacgccctgtttgtcagtaacttcatttatgttctctaagatcttgttatatctcccctcccaaaagtcacaaatccaaagagagagccggtggggggcgggggacctgcaattgcattggtgactgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540464 - DNA, 467 bp, Homo sapiens
tatcggcctctatgtctcgatcgtagagatcagcatgtaatagtgtgttagctaatgaagcctcagtaaactattaggacaatgaaacttctatagaacatttatttgcatcctgttattatgcgtgtatataaggcttttcataacagttacctactctttcttcaatagagtagcttatttactctgtaaaatggaaatcgcttataaatcactttagaattcaaagattaacttatgtagagtgttacagaattttgccactaacaccaaataaattatatttgaaaaagtggtagaagtgacggaaggatagtaatatacaatagttaactcttgaagatcgtatggggattaagtaagtacttctggaagccttttttcctaagatatggggatgggggacaggaggaatagatactgttctacatttgcgttaatattatttctcaacagtatcatttctt

SEQ ID NO: 540465 - DNA, 859 bp, Homo sapiens
gtattttgttgttagtattgtgctcattaaagtttaggaggctgattgtggtgaggggtttggtaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540466 - DNA, 879 bp, Homo sapiens
  misc_feature (29)..(29): n is a, c, g, or t
  misc_feature (555)..(555): n is a, c, g, or t
cttcctgctctgccaatgcattggcaggnagtcaagttgggggagcaggttgtgtgtgtgaaagaaatttcaaccctcatcttccatagtggacagtcaaaaatgtaataggacataatgaaaactgaaacatcggaaagtattaatctaagcattttttttttaagaaacagagtagaattccaaaagaatccattaagagagttgaaattggttgcctatagggagctggacattgaagagaggttgggttgtggaggactattgtttgcaaaaaccttatagaacaacgactcttttaattgttgatgacagtaaaatgtaaaattaaatttagatataaattaaaaacaaagcaaaagaaggaaaggaggaagagtaaggaagaaaggagggagggagaagaggaggaagaagaggagaaggaagaagagagaggggaaggagggaggcagggagaaagatgaaaagacgatcacgctgtctctgctctggccaggccaactcttgcttgttccagacatcaccctccccaagcatgagcctctcttgggnagagcagctggaagcagagggagctgggagaccagacacaaactcggggctcagcttggggacgggagttgatagtcaggtgcctggaacataatggagaccgtccatattggttgaatgagtggatgaatgaattaatgaatttcttttctcttaagtcctgcagctcattaagtcacagaaatttctgaataagttggtgatcttggtggaaacagagaaggagaagatcctgcggaaggaatatgtttttgctgactccaaagtaagtgacagcaaacttctgtgggctgtgaggtagggaggggacacgcgttttgggct

SEQ ID NO: 540467 - DNA, 245 bp, Homo sapiens
tccccccaatctcatgacctcgcccacatcagtggcggacattcgggtcccaatattactgagctggctcggaagaacctgcacggggagctagacaagtctggtctcagccagattgaggagagcaccacagtggtcaccacacagtctgctgaggtcggagctgcttacacgacgctcactgagtcttagacgtacgagtctcaggtccttggtacgtatcgacctgtcactccattatagat

SEQ ID NO: 540468 - DNA, 390 bp, Homo sapiens
tttatacgtacgtagaggctgtgctatgtgatatgcttgcgctgctaagattagaaatgtcctagcaattcttaccactatgtacacctacaccctttatccccatactagttattatcagataccatcagcctcactcatacaaccaattagccctgagtccgtacgcctaatccgcttacattactgcatgccacgcttactcatgcacctatttggaatcgccaccctagtcaatatcaaccattaagccttccctctacacttatcatcatcacaattctgattctactgactatcctagaaatcgctgtcgccttaatccaagcctacgttttcatacttctagtaagcctctacctgcacgatatcacatagttcagcgtctga

SEQ ID NO: 540469 - DNA, 257 bp, Homo sapiens
  misc_feature (11)..(11): n is a, c, g, or t
  misc_feature (13)..(13): n is a, c, g, or t
  misc_feature (45)..(45): n is a, c, g, or t
  misc_feature (149)..(149): n is a, c, g, or t
cacgagggctntntccctttgtctggcaggctctgcaaaggggantgaggccagtggttctctgtgtcccagaggtgtccctgggagatgtagtgtcactggactagagattcatccttgctatctctgatgcaagacgattgtatcanttcaggctctggaggtaggacagggagcagaaggatggggactaaagccatggaagaaagacagaaaaatcaccttttctatgtgaagtgaagagacaacggaacccg

SEQ ID NO: 540470 - DNA, 491 bp, Homo sapiens
  misc_feature (194)..(194): n is a, c, g, or t
  misc_feature (215)..(215): n is a, c, g, or t
  misc_feature (320)..(321): n is a, c, g, or t
  misc_feature (324)..(325): n is a, c, g, or t
  misc_feature (337)..(337): n is a, c, g, or t
  misc_feature (341)..(341): n is a, c, g, or t
  misc_feature (344)..(344): n is a, c, g, or t
  misc_feature (346)..(346): n is a, c, g, or t
  misc_feature (348)..(349): n is a, c, g, or t
  misc_feature (354)..(354): n is a, c, g, or t
  misc_feature (363)..(363): n is a, c, g, or t
cgtgacatcgccagcagtccaggctgcatggcgtagtttcaggagcatggtacatgaagacgtttcctcgggccctctttgcccaggcactggccatgtcgattatagggcagatgataaagtagtcccgggtggcattctccagagcccgggagaaggaggcatagtcatccgtggagtgctccagagagtantaccatgtagcagcagcctcnacgcgggcatctgagtcctcgccacccagtagaattctaaagatgcctggtaaaagtctgttttgctactggtccggcctcgactttcctcaaattggttcacannctnngctctggtgatnagcncgncntnntgagnactcccaangagcagatcgacctctacccgtaaagacctcttcagtgctctggctggaggctcacggaggaagtgccatgcagatcacaggacgacagtgagtgggataaggccactcactggccagagctgtagcg

SEQ ID NO: 540471 - DNA, 4639 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540472 - DNA, 578 bp, Homo sapiens
  misc_feature (539)..(539): n is a, c, g, or t
tgcccgatgtgcagcgagcagttccctcctgactatgaccagcaggtgtttgaaaggcatgtgcagacccatttgatcagaatgttctaaattttgactagttactttttattatgagttaatatagtttagcagtaaaaaaaaaaaaaaaaaccacacctaaaatagaccactggagggagacctatagagcgggatggcgttctcatggcgacccttttactggcactttctggaccagggagctactttggagtttgggtggttagctaggatcaggggtcagtctttgggcttatcaataaatgtttaaatctctggttaatctttacctggcgtttaaacaaaaaggttctggtggtggtccggtatcgtttatttattccctaagtttggcgagaactggtctggaataaagggatacaagggattatttcaagtggttaccgtggcaccgtggaacaaacgcggtgttatgtggtattatagcgtgggtgcgcatagaattataattttatgagccagaaaattattttcancaagagttttcgtggtgtggaccttgtggtggaactgga

SEQ ID NO: 540473 - DNA, 4662 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtgagcagctggctgcacgctgggtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540474 - DNA, 1063 bp, Homo sapiens
cttaatagctctgcgaggctgttaagaggcctatcagggccttcgacgacccggggaaacggcgaggtgagttgctaaactgctaagattgacccatcgacttgactggtagggacgcgaacccattgcacagacgttggatccctgcggctgcctggtgcccaccggggggctgtgcctgtgtccgggccgcaagggcaagctggctgccgcgccattccctgcgttgctgctgctgctagctgctccgtggctgtttcgagagacttggtgggcacaggctgtgcggagggcagacctaggtgccttggccgcgcacgcagaaaaaactaccaaaggtctccgtgctttcgggctcactcataaggaagatgtctcctggggagtgcgggcatgaggagaattcgccaggacccagtcgtatggtgggaccatgcgcaagaggcccctttgaccattgcgattatatatgtcacatgcaggtgtagcgacaaaattgcaattccaaacacaataaaattttccctatccggctatataactcacgagattgcactttctccttgctatccctacactgggcccaagtaggattgcgaaccaggtcccttcgagagagaaaccccaatggagtgtggtacatcgcgtgcgtgttgtgacaactgccaaagtgcacccctcagggagggcatattcatctctcttccaccggggttgggagtgtgtatcagttctgtgcttctcctagtttggcattgtttgtcgccaccccccgtccgtttttttttggccaacgcggaaccggtttttacaatctgcggccggtgggtaacccaccctttcgccctagtgttttaacacacacggaagtcgtgccttgcattgcacatggctgtatgactagttgtggggtgaggactctcctcttttgccaccaaggtttgagcatgttcttgatacccagtaccggtggccacacttggctatcctaaaggccgcataactctgtatagagaacctgtgcgctaaccgactggaatccgttgccctgtgacacgcactc

SEQ ID NO: 540475 - DNA, 489 bp, Homo sapiens
  misc_feature (70)..(70): n is a, c, g, or t
  misc_feature (138)..(138): n is a, c, g, or t
  misc_feature (249)..(249): n is a, c, g, or t
  misc_feature (251)..(251): n is a, c, g, or t
  misc_feature (309)..(309): n is a, c, g, or t
  misc_feature (315)..(315): n is a, c, g, or t
  misc_feature (389)..(389): n is a, c, g, or t
acgcggtgcactgttttggtgaaccttgggatccatgcggattgtagtgacagggggctctgggctggtnggcaaagccatcctagaggtggttgcagatggagctggacttgctggagaggactgggtgtttgtctnctcttgagacgccgatctcacggatacagtacagacccgcgccctgtttgtgagggtccaacccacacacgtcatccatcttgctgcaatggtggggggcctgttccggtntntcaaatacaatttggacttttggtggaaaaacgtgcacatgaacgacaacgttctgcnctcggncttcgaggtgggcgcccgcaaggtggtgttctgcctgtccacctgttttttccctgacaagacgacctacctgnttgatgagaccatgatccacaatgggccttcccacaacagcatttttggttcttcgttgccaagaggatgatcgtcgttctgaacagggtctactttcag

SEQ ID NO: 540476 - DNA, 317 bp, Homo sapiens
  misc_feature (225)..(225): n is a, c, g, or t
aagctgtggtttgcattcttcctctttctggtttcagtgacctcaagttaaaacccacaggaaataatgtgtgttgtgcattcgtgcgcgtgcgatgggtacaaaggagtgagactgtgtgtgagagtgtaatcaagatactgctgacagaaggaaatggtttttgccatgtcctgctgtaaaacagcaacactcacctcttaatttttctattattacacatanttgctttcgtttggcaagcagccaatataaactagcgccagttaccagtgcttaaaccagagggtgactgaaagggaattcggttttggttt

SEQ ID NO: 540477 - DNA, 4592 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540478 - DNA, 173 bp, Homo sapiens
gttaactccggcagaacttctgcactggaaggcaggttcagacaatcccctacttcttccagtgtttgctcggctcgcaggaacgggctcaccagaacgcgttcgatttccactttttgacctttcagccagttgccatcaggcgagattcgtcacaaccattagtggtcaga

SEQ ID NO: 540479 - DNA, 4725 bp, Homo sapiens
ggggcaggccgtggtcccagttgagaagctgtgctcccttgggtgttttggaggttcagggtgggtgctgaaaagccccgctgggtacagatggttcgggggcctgtctagggcatggcatcccacgtgggtgtcagcacggccgcagaagaaccacttctctggcccacccatgcctgctaggccatgcttcttcagaagtggccacaactctcctgacgtctccagagccggtcattccacccagggggacttcagctgccactggacacttcaattgtacgctgcgaccagttgccaggaaggagagggctggcaagagagccgcggcagccgtggcagggtgtaggggacggtggacggccagggcccccccctctctctctttctctctctctctcttgcttggtttctgtaatgaggaagttctccgcagctcagtttcctttccctcactgagcgcctgaaacaggaagtcagtcagttaagctggtggcagcagccgaggccaccaagaggcaacgggcggcaggttgcagtggaggggcctccgctcccctcggtggtgtgtgggtcctgggggtgcctgccggcccggccgaggaggcccacgcccaccatggtcccctgctggaaccatggcaacatcacccgctccaaggcggaggagctgctttccaggacaggcaaggacgggagcttcctcgtgcgtgccagcgagtccatctcccgggcatacgcgctctgcgtgctgtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggttcccaggtgatgtgcagctgctggtccagggaactccctttgggaaccactgacctagaatagatcagaacgttggcagaaaaagggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540480 - DNA, 208 bp, Homo sapiens
taaatcgagctcggtaccgatcagcagctggatctgcggctgcgccaccgggttccgatggtgcaccagaccgagtcgtcagaatgcgggctggcctgcctggcgatgatctgcggttactatggtaaaaacgtcgacctgatcgcgctgcgtcggcagttcagcctgtcgacccgcggcgccacgctggccgggttaaccggtatag

SEQ ID NO: 540481 - DNA, 4049 bp, Homo sapiens
  misc_feature (11)..(11): n is a, c, g, or t
  misc_feature (13)..(13): n is a, c, g, or t
  misc_feature (45)..(45): n is a, c, g, or t
  misc_feature (149)..(149): n is a, c, g, or t
cacgagggctntntccctttgtctggcaggctctgcaaaggggantgaggccagtggttctctgtgtcccagaggtgtccctgggagatgtagtgtcactggactagagattcatccttgctatctctgatgcaagacgattgtatcanttcaggctctggaggtatcggaattgcgtttacacttacagaattctgcccaatgaagatgataaattcactgttcaggcatccgaaggcgtctccatgaggttcttcaccaagctggaccagctcatcgagttttacaagaaggaaaacatggggctggtgacccatctgcaataccctgtgccgctggaggaagaggacacaggcgacgaccctgaggaggacacagtagaaagtgtcgtgtctccacccgagctgcccccaagaaacatcccgctgactgccagctcctgtgaggccaaggaggttcctttttcaaacgagaatccccgagcgaccgagaccagccggccgagcctctccgagacattgttccagcgactgcaaagcatggacaccagtgggcttccagaagagcatcttaaggccatccaagattatttaagcactcagctcgcccaggactctgaatttgtgaagacagggtccagcagtcttcctcacctgaagaaactgaccacactgctctgcaaggagctctatggagaagtcatccggaccctcccatccctggagtctctgcagaggttatttgaccagcagctctccccgggcctccgtccacgtcctcaggttcctggtgaggccaatcccatcaacatggtgtccaagctcagccaactgacaagcctgttgtcgtccattgaagacaaggtcaaggccttgctgcacgagggtcctgagtctccgcaccggccctcccttatccctccagtcacctttgaggtgaaggcagagtctctggggattcctcagaaaatgcagctcaaagtcgacgttgagtctgggaaactgatcattaagaagtccaaggatggttctgaggacaagttctacagccacaagaaaatcctgcagctcattaagtcacagaaatttctgaataagttggtgatcttggtggaaacagagaaggagaagatcctgcggaaggaatatgtttttgctgactccaaaaagagagaaggcttctgccagctcctgcagcagatgaagaacaagcactcagagcagccggagcccgacatgatcaccatcttcatcggcacctggaacatgggtaacgccccccctcccaagaagatcacgtcctggtttctctccaaggggcagggaaagacgcgggacgactctgcggactacatcccccatgacatttacgtgatcggcacccaagaggaccccctgagtgagaaggagtggctggagatcctcaaacactccctgcaagaaatcaccagtgtgacttttaaaacagtcgccatccacacgctctggaacatccgcatcgtggtgctggccaagcctgagcacgagaaccggatcagccacatctgtactgacaacgtgaagacaggcattgcaaacacactggggaacaagggagccgtgggggtgtcgttcatgttcaatggaacctccttagggttcgtcaacagccacttgacttcaggaagtgaaaagaaactcaggcgaaaccaaaactatatgaacattctccggttcctggccctgggcgacaagaagctgagtccctttaacatcactcaccgcttcacgcacctcttctggtttggggatcttaactaccgtgtggatctgcctacctgggaggcagaaaccatcatccagaaaatcaagcagcagcagtacgcagacctcctgtcccacgaccagctgctcacagagaggagggagcagaaggtcttcctacacttcgaggaggaagaaatcacgtttgccccaacctaccgttttgagagactgactcgggacaaatacgcctacaccaagcagaaagcgacagggatgaagtacaacttgccttcctggtgtgaccgagtcctctggaagtcttatcccctggtgcacgtggtgtgtcagtcttatggcagtaccagcgacatcatgacgagtgaccacagccctgtctttgccacatttgaggcaggagtcacttcccagtttgtctccaagaacggtcccgggactgttgacagccaaggacagattgagtttctcaggtgctatgccacattgaagaccaagtcccagaccaaattctacctggagttccactcgagctgcttggagagttttgtcaagagtcaggaaggagaaaatgaagaaggaagtgagggggagctggtggtgaagtttggtgagactcttccaaagctgaagcccattatctctgaccctgagtacctgctagaccagcacatcctcatcagcatcaagtcctctgacagcgacgaatcctatggcgagggctgcattgcccttcggttagaggccacagaaacgcagctgcccatctacacgcctctcacccaccatggggagttgacaggccacttccagggggagatcaagctgcagacctctcagggcaagacgagggagaagctctatgactttgtgaagacggagcgtgatgaatccagtgggccaaagaccctgaagagcctcaccagccacgaccccatgaagcagtgggaagtcactagcagggcccctccgtgcagtggctccagcatcactgaaatcatcaaccccaactacatgggagtggggccctttgggccaccaatgcccctgcacgtgaagcagaccttgtcccctgaccagcagcccacagcctggagctacgaccagccgcccaaggactccccgctggggccctgcaggggagaaagtcctccgacacctcccggccagccgcccatatcacccaagaagtttttaccctcaacagcaaaccggggtctccctcccaggacacaggagtcaaggcccagtgacctggggaagaacgcaggggacacgctgcctcaggaggacctgccgctgacgaagcccgagatgtttgagaaccccctgtatgggtccctgagttccttccctaagcctgctcccaggaaggaccaggaatcccccaaaatgccgcggaaggaacccccgccctgcccggaacccggcatcttgtcgcccagcatcgtgctcaccaaagcccaggaggctgatcgcggcgaggggcccggcaagcaggtgcccgcgccccggctgcgctccttcacgtgctcatcctctgccgagggcagggcggccggcggggacaagagccaagggaagcccaagaccccggtcagctcccaggccccggtgccggccaagaggcccatcaagccttccagatcggaaatcaaccagcagaccccgcccaccccgacgccgcggccgccgctgccagtcaagagcccggcggtgctgcacctccagcactccaagggccgcgactaccgcgacaacaccgagctcccgcatcacggcaagcaccggccggaggaggggccaccagggcctctaggcaggactgccatgcaggtgcgctgcgccacacgtgggttcgtgtgcatttgtgtgtgtgtgtgcatgcgtgagtgcgtatgtgtgtacctatgcatatgtgtgtgcatgtgtgtgtgcacgcatgcatatgtgcgtgcatgtgtgaacgcatgcatgtgcacacatgcgagtgatggtcctgggaactgctccatgagaagggagagtcaggatttgaacccaggtctgcctgtcccacacatccctgaccctgcattgcctctgcagcagttgttaaaaggaagaaaggcggggctgtggataaacttagtctagtgtcagtcccagaggaagaagattccataaagaaaaggagcctaaatcatttatatctcattgttattataaatttgttttgcaactgagtttcgccaggtgatctgcctgcctgggcctcccaaagttctgggattacaggcatgagcactg

SEQ ID NO: 540482 - DNA, 145 bp, Homo sapiens
tccaaagggaaaaaaaaaattttaattaacaacgggaaaaaaagtagggaaaaaagtatttgggccccaaaaaatggcataacggttttatccacaacctaagaagaaggtagtaaaaaaaaattcggccctccccctccccccc

SEQ ID NO: 540483 - DNA, 320 bp, Homo sapiens
cgacaagaggtgaactcggtccgggctgaacggtccgggggaagcccttgggaaacctcagcagccctgtgagcgggtgggggcaggaaacataaatgcagaaggtcccaagctggccactggaaagaccaggtctcccaccatctcatcacagagcaagcaggggtctggtccgggcagctgccatgtacccggattcagccaggctctggcaaaaactactccggagacctcggggcgcgagtggcccggcatgaactctacaagtacatcaacaagtactatgaccagatcatcacggcccgggttagggatgcggt

SEQ ID NO: 540484 - DNA, 350 bp, Homo sapiens
  misc_feature (1)..(1): n is a, c, g, or t
  misc_feature (130)..(130): n is a, c, g, or t
  misc_feature (170)..(170): n is a, c, g, or t
  misc_feature (262)..(262): n is a, c, g, or t
  misc_feature (304)..(304): n is a, c, g, or t
nagaaaaaagaaaagtagtaaaaaaaaaagcggtaacggacggaaaaccgggaacaaaattaaaaaaatcaacaaaggcagaaaaataaaagaagaagcaaaaaaaacaaaacaaaaaacatcaaaaaantcacattctgtggcacaaaaaatcaacacaaaaaaaaaanagggaaacaacaaaataaacaatgtcaaaactacaaaatcagacaaagggaacacaagaacaacaaacacaaaaactataagcatatacaanttcacacaaaagagaaagaggcttccagataaaacaaaacanggatgacagaacagaacactgggaagggaaatccagaaaagcagaa

SEQ ID NO: 540485 - DNA, 301 bp, Homo sapiens
catctcccatgccttgtattttcattaaaaaaaaaaaaaaaaaaaagcatttcagggccaggctcagtggtttactcttgtaatcccagcacttttggaggcctaggtgggaggatcacttgaggccagaagttcaaaaccagcctgagcaacatagcaagaccttgtctccatgaaaaataaaaaattagccagaaatggtgatgtgtgcctagagttccaactacttggaaagctgaggcaagaggatcgcttgagcctaggagttcaaggttgcagtgatctataatcaccactgcac

SEQ ID NO: 540486 - DNA, 180 bp, Homo sapiens
  misc_feature (156)..(156): n is a, c, g, or t
atctatgggccacttatttttaattttattttgagacagagtctctgtcgcccaggctggagtacagtggcgtgatcacagctcactgcagcctcgaccgcctgggctcaagtcatcttcccacctcagcctcctaagtagctgggaccgcagtgntgcaccactgtacctggctaattt

SEQ ID NO: 540487 - DNA, 786 bp, Homo sapiens
cgtggtggctcacgcctgtaatcccagcactttgggaggctgaggcaggcggatcacaaggttaggagatcaacaccatcctggctaatatggtgaaaacccgtctctactaaaaatacaaaaaattagccaggcatggtggcacacacctgtagtctcacctactcgggaggctgaagcaggagaatcacttgaacccaggaggtggaggttgcagtgagcctcactgcactctagcctcggtgacagagcaagactccatctcaaaaaaaaaaaaaattcctcaggagaagaatttattatcaaggttatttccaggttccgtgggtcccaggcaaatcccaggggaaacacccaattttcctcgtggaaactctcaaagaaatctcttaaagaaatttctcaaagcttaaagccaccaaagaaattaaactcacgagagccaggcagggtggctcatgcctgtaacaccacttggggaggccaggcaggaggactcatgagctcaagagatcgagaccatccgggacaccttggtgaaaccccggtttctactaaaattacaccactacatttagccgcgcgtggagggcatacgctggtattccagtactcaggaaggctgaggcaggcagaaattggtggaaacccagcgaggccagtgcagggagccgagatggggccacggcctcccagcttggaggacccggggagaattcggtccccggaaaacacaacagcacaaaaaacaacgcggcggccgccggcccagagaagcccaaaccc

SEQ ID NO: 540488 - DNA, 596 bp, Homo sapiens
aacagtaggatgtatttactaaaccccggccagacaccgaaaaaaaaaaccttgagggtcacaaattttcctgggtttgaattcctagtctcagcgaattgggaccaaacagctggctgtcatcaccaatttgagcaacatggggccctgaaccacctccaactgaagaatgagctgaagggctctttcccaccatggatgaaccgagagagaaagaacactttatcatcacatcacttgttactcccttctgcaaaaggcaaaacctccttgaccttcacccaggccacaagattgctgtcgggatcctaataaaataaatttgatgaggcacttcagcttccttgaaaagggatgagacagatatgtcatttttattagtccaaacgtgaaagtacttttaaaaagcattctagctactgaaatgtgcgactcaactttatccagttgacattgtctatcagcattaggctgaaattagaaataagcttgtttttaatgacttgtttccccagagaaatttatataaggtagatatgtaacttattattttccaacaccatggatcatccaaataaatattatgcagtcattaa

SEQ ID NO: 540489 - DNA, 723 bp, Homo sapiens
aacagtaggatgtatttactaaaccccggccagacaccgaaaaaaaaaaccttgagggtcacaaattttcctgggtttgaattcctagtctcagcgaattgggaccaaacagctggctgtcatcaccaatttgagcaacatggggccctgaaccacctccaactgaagaatgagctgaagggctctttcccaccatggatgaaccgagagagaaagaacactttatcatcacatcacttgttactcccttctgcaaaaggcaaaacctccttgaccttcacccaggccacaagattgctgtcgggatcctaataaaataaatttgatgaggcacttcagcttccttgaaaagggatgagacagatatgtcatttttattagtccaaacgtgaaagtacttttaaaaagcattctagctactgaaatgtgcgactcaactttatccagttgacattgtctatcagcattaggctgaaattagaaataagcttgtttttaatgacttgtttccccagagaaatttatataaggtagatatgtaacttattattttccaacaccatggatcatccaaataaatattatgcagtcattaacaaaaaaaaaaaacaatgggctcgatgacctcaacgaaggaactctgcggacgctagcctttaaagagggataaatgatgatactgagtcactgactcaatgaactcgaacatattactgagacaaa

SEQ ID NO: 540490 - DNA, 123 bp, Homo sapiens
agtgatcgtctctgaactctctgatggttgtggtgttcatctgtgggattaaagtggtcccagtgttcagggcatgtaaagatatgttggagtgcttctgttgagaatatcaccttcctccca

SEQ ID NO: 540491 - DNA, 1348 bp, Homo sapiens
  misc_feature (394)..(394): n is a, c, g, or t
gaccgggatgtgagtcatgtggctgagtgcgtggttggagtaacaatggactccccagggaggagtggcatcattagctgaggatctcactggctgtctgttgcccctcccctggtctaccggtcgacgcgacacgatgcgggggtgaacacccaagcgcgtctgggttttagtgagacgaagttgtaggcattcccaaacgaactctgccgtggtgagtacgtggctcctcgtcgtctagggactcggctcgacactgttgcgatacgtgccatattgtgaatgactgtgcgtacgaccccttccctcttcagcagtgagtggacgatgttgtggcatgactccgacctatgtggtggtccgagataatttgggacatgcccttgttgtggcnatgagccaaatgtggcttatgaatcggagccagggcttcgcggtgagcgtccttgtgattgtgggggcttggcaagcactgggaacttttgcggaacactagcgtccctcacttaaagagagaggatcaacgttgatatgttgacccaataacgcaccagcacttggtctgacccaaatctgaatagtcaactcgaatgttggagccaaggaccaatcggagcccaatttctttgggtccgtatcgaaatcgagcggggccaattgagacctccacgtttcgcagcacctagcccattcttggattgcaacgctaccggggaacatacttcggagagatattccctccattgccctcgttgcgatttgtcgtagggcgcatccctggggtgggtggtggagtcgatcgcaaattacagcattgctgctagcacgttcgttctcactagggtttcgagccccgttggacaactctgaattccggggtgcctttcttacccgaaacccaaggcctcccaagtttatcaacctttaaactttagggatctcccacctttttccaagcgaaacggaactttggaggtggtctcgggaagggggactctttcgcacgggaagaggggcaacacagattttcgcccaaagcagccaaggaaaacgaaccccagctgtcccggtgggggtgggcacaagtccagggggggtacaccccacacgggcccaggaaaaagggagcaccctcacatcagaagaaaaacgcaaacggaaaaaaaagagcgcggggcaagcacgcgaattcccgttaaacagttgcagacacccccgttctaggaaaaagaccccaacgggtaaaatccaatggcgacattatttgccggttgtaaagttaaccgtattggcccgcgatggaataacccacccaacggagacttgggcccgactgcaaacacggggg

SEQ ID NO: 540492 - DNA, 254 bp, Homo sapiens
cagagagtcccagcttattcttgactgccctttgataagtgaatttcccggcaactcctacctgccagtcggcatggcgcggatctaccgatcgaagaacgacacaaagtctccgctctcgtgccgtttacagagaataatgaatgagattaattaagacatgactgagattaatcgactgacattgccagactgaatgaagtgaatggcctgaatatcaacaatttccaaatacagataacactgcatattga

SEQ ID NO: 540493 - DNA, 167 bp, Homo sapiens
tatcccccggcgacatatcctaatctctctagaagacgctggaataaaatgcctttaacgtccttagtggcaggacttttatggagacacacaggtatccagccgtgcaaacactgacttcaagaaactggtcctttcacatcattttgcgatggtctctcacgaga

SEQ ID NO: 540494 - DNA, 808 bp, Homo sapiens
tgttcggccaatcctgggcccttcaagttgccggccacaaatgtccggggtcctttagaaggctattcggccacgcatattgtccaacgaagccgcttccaggaatgtctatctttaagttcacccaccgaggagttccaccctgagtggcccccccaagctttgggttggtctattatatgggaagggaaccctggtacagagcgcttgaccacattgacatcattttaaaggggcccctaggagataccccgtgaaaaagtcgacaataacagccagtgtagacccaacagcgtgaccttcagcctcaacaggtgagacccaaatcaagacttggccaattttctcacatttgttgcaagtatgtttactagctgaatctccgatacaccatgtgaccagccaccaaacccatctttttgattctttattcccactaccaatatttccccaacacagtccagtagttctttcttgtcttaaataatcatgatttcaaaaagacagccccaggcccggagcggtggctctacacccgttatccgtagcacatttggtaggcaccaggcgggtggacacataagtcaggagttccaagacccgacctggcgccacatggtgaaacacccatccctttacttaaaataccacaaattagccgggtgtggtggtgggcccccgtaatccccaactactcaggaggctgaggcagagggacttgtcttgtaacctgagaggcggaggttcaatgagcctagatcacgtccctgcatttcaacctcggcgacagagccagactccctttcca

SEQ ID NO: 540495 - DNA, 168 bp, Homo sapiens
ccacctcagcctcccaagtagctgggattataggtatgcaccactatccctggctaaagagtttttaaaagcgcaaggtacaagtggtggtaaatatgtacctgggaggaacccctctctgctcctgtggccatctttgtagcccactgagagcagcagggaaagaca

SEQ ID NO: 540496 - DNA, 1179 bp, Homo sapiens
ggcggaatggtagtcatgtgaacccgccagacagaggtgagcacgagcctggaagacataccaggcacttcacgcctggaagaaagacctacctgtcgcgagggactatacttactgggactcttgcacccctggccgcggggtgaacttgcagtccgacttgccgtgttgcttgcacaacacttcgataagtacatgcagtcggattgcattcttctcgctagatgggtaacgatcgaagcatcgccgggaaggacaacgctctatcaaacacagtctgtgcgagtgtgctgtcgccttcggacgaatcctcatactaagtccagatcacaggatggtcccgtgtcaggaatggggaccagacaacacgactcatccacttccgtgataaactcgcttctggagacccactgagcggtctaactcattcactagaatgcgagacttccttgctaacagagggcagcatggcatgatgggcagaaggtggtgaagcccagacctatctgaggcccatcatggcgtaagggcatctagcggccctcagtacgtattgccgatggaccgggtacctgcaccactagatagcttggcgtctgagtttctcgaggctgcagactcatatcgctgaaagaacatggcgcagaagtaacggcttgctggtgaccttctagaacgggtatcgccatggtagtggctcgagctcgcttgagagcgcgcaccaggtttctgaggggatgtacgatcaacgtgctcggttccctcgggacgggtccgagactacaggtcgcccggccgcaagagtgagtttcgtggcgttggcagtcctgggcgttgtggcccggtcctgtggtgtctcggccgctggtcctggagggcccttagggagtcgtggtgctggccccggaccgggctggggcccgcgtgagtgaggccagggcggcccccaggactggggcctgagggcccggaacccgtttcgcaaccgggctgtcccagaacaagggccggttttagagagaggcttttacctgtggcgccggcctgcgtctggggcgaaccctgtgacgtcctttcaaagttaggggcggggtgtcaatcgtgggaccctttgtctttgcacgtaagtcacatattctgttatagagcggcctgtaaaagggtgcaggggcaacacag

SEQ ID NO: 540497 - DNA, 696 bp, Homo sapiens
agctgggtacccgttcttgccaacgtattgcggaaggggctgtctgtttagttttactccaatcttgtctgttggcgcctattatggagaccctcaggccctatggactccatcgttatgagacttgaagtcatcgctcaaacattcccctaaaagaacgggggtgagggagaatgggaggcaacccgagggaaaaaagcagattagcttcggaatcggacaacttaaagtctcgatgtagagcctcggattgtatacgaacgtccatgagttctagacccagctctgctactaacttgtctgaccttccccatttatgaactgttgtgggtgagaggtgggactaggtgaactctgagagccctgcactcagcgcggacgagggattgaggggagagtgtgctgtataccccgcgagccttcacccgtacgagggcccagcctgccctggatgaaatcccggatggcaggcgcatgtgcaggcagatgatcctggcggctgacgtgggccgggagctatctggacagttacatcttgttggacgccggcaatcggcaaagtgtgttctgtgaactccgggatcctagattgataagttccggaattaacaggctggtaaaccccttattgctggtgctttaacgggtataggcaagcacaagcccaggggtgccttaacactatccaagggcgcc

SEQ ID NO: 540498 - DNA, 133 bp, Homo sapiens
gtagagtatagagactcgcaactcgcagcagcatcttagtcattgctgacagagcactttcacactgcccctacacagcgcgctgctgctttagagccactgtctgtatcgtggagtgaagcgactgtcgtta

SEQ ID NO: 540499 - DNA, 83 bp, Homo sapiens
gatttgctggtgcagtacaactaggcttaatagggacatgtccctcgaattcaacttctaacgttagaagcttgaattcgagc

SEQ ID NO: 540500 - DNA, 185 bp, Homo sapiens
ctgcttgtgcgtctcctccaccatgtgcatcccccttgcggcactagggacttttgtacagcgtcgcctcaagagcgggagacgcatatcccgtggcctgagatgtgtgcttcccagcacgctcacggttattacacgatactactttacaggacagaatactccgtcggactgccttcttcaaa

SEQ ID NO: 540501 - DNA, 858 bp, Homo sapiens
  misc_feature (14)..(14): n is a, c, g, or t
  misc_feature (25)..(25): n is a, c, g, or t
  misc_feature (52)..(52): n is a, c, g, or t
  misc_feature (57)..(58): n is a, c, g, or t
  misc_feature (63)..(63): n is a, c, g, or t
  misc_feature (81)..(82): n is a, c, g, or t
  misc_feature (139)..(140): n is a, c, g, or t
  misc_feature (158)..(158): n is a, c, g, or t
  misc_feature (165)..(166): n is a, c, g, or t
  misc_feature (168)..(168): n is a, c, g, or t
  misc_feature (177)..(177): n is a, c, g, or t
  misc_feature (321)..(321): n is a, c, g, or t
  misc_feature (484)..(484): n is a, c, g, or t
  misc_feature (573)..(573): n is a, c, g, or t
  misc_feature (611)..(611): n is a, c, g, or t
  misc_feature (620)..(620): n is a, c, g, or t
  misc_feature (622)..(622): n is a, c, g, or t
  misc_feature (631)..(631): n is a, c, g, or t
  misc_feature (718)..(719): n is a, c, g, or t
  misc_feature (723)..(723): n is a, c, g, or t
  misc_feature (729)..(730): n is a, c, g, or t
  misc_feature (751)..(751): n is a, c, g, or t
  misc_feature (783)..(783): n is a, c, g, or t
  misc_feature (796)..(796): n is a, c, g, or t
  misc_feature (841)..(841): n is a, c, g, or t
gcggcgggcagggngcaggcctggnatatggacgacgccccgggcgacccgnggcanncccancgccccgaccccggccgnncgagtgggcctggagcacgctgcggcggctcggggtgctctactggaagctggatgnngacaaatatgagaatganccagaannanaaaagatcngaagagagaggaactacatcctggatggacatcgataaccatatgcaaagataaactacgcgaaattatgaagaagaagcattaagatgttctacgaggagcatttgcacttggagcgatgagatccgctacatcctggatggnagtgggtacttcgacgtgagggacaaggaggaccgagtggatccggatcttcatggagaagggagacatggtgacgctgccccgcggggatctatcaccagcttcacggtggagcgagaagaactacacgagaggccatgcggctgtttgtgggagaaccggngtggacagcgtacaaccggcccgctgaccattttgaagcccgcgggcagtacgtgaaatttctggcacagaccgcctagcagttctgcntgggaactaacacgcgcctcgtaaaggtccccaatgtnatgactgancngaaaatcantcactttctctttgcttttagaggatagccttgaggctaggttatctttcctttgtaagattatttgatcagaatattttgtaatgnnaggntctagnnagccacttggcagtgtaaagngtcaccttcattttctgtaactcaatcaagantggtgggtccatngccctgtgttagttcatgcattcagttgagtcccaaatgaaagtntcatctcccgaaatgca

SEQ ID NO: 540502 - DNA, 90 bp, Homo sapiens
gagcagccagggtgtggactgtaggctccatgttgaacttccgtgaactagccgtgaatgtgccataatgcacccttctgtcgtcttctc

SEQ ID NO: 540503 - DNA, 869 bp, Homo sapiens
attctagaggccgaggcgggtggatcaactgtggtcaggagtttgagatcagccaggccaacctggtgaaaccccgtctctactaaaaatacaaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaaaagaaagggaaaaaaaattagctttatacctcttcctggtgtctcaaccgccattgaaatttctgaacactccaatttcgtggattatttccaaaacaaattttttagtttaaaatatttttcactccttatagtaatagtatactttaaaaagcctcgggtatattatcttctaaacagctacaatccagtgcagctactttaaccacctatgtctctagttgagaacaactaggcctatttcatgctgtgtagcctcagtgcctaacatggtgccaaatagatatcgtagaattaccctgaatggtaaaccattcgttgtgttacaatgccaaatctcaagggtcgtattttgtaattctttgaacttatattctattggattcccagtatgacggcggggggacttagcatagtctcatttttaaactctattgtgctggtttcacaaatcttctcttccaggtattttcaatccggctgcccccaggtttatggtctggaacgtccgattgcctcgcatgggtatcccattttaaaatgctggtttgagagcacgtacattggtgggtgatcacaagctatggggcacggtaaagaaggcgattgtacg

SEQ ID NO: 540504 - DNA, 954 bp, Homo sapiens
cttcctgggaatgaagatggttggtgagctgctacgaatgtcgggtgcctttttcatgcggcgtacctttggtggcaataaactctactgggctgtattctctgaatatgtaaaaactatgttacggaatggttatgctcctgttgaatttttcctcgaagggacaagaagccgctctgccaaggacattgactcctaaattcggtcttctgaattaatggggaggggaccctattttaccaagagagaaagtttgatgaatcatactcatgttgctaactcaagttatgcaagtcatgattggaatactgtgtcattgagcaagccaaccttcgttgtatgtagtcatgaagctggctaggtgagttcctaaacccactaagaactctacaagctgggttgctgaacagccagaaagattctctctgaaaattgtggaagcactccatgtgtacttggaagatcctgtgtcacttcgatctttggcacgctgggaggatgagtcggagctcatataacttggttccaagatacattcctcagaaacagtctgaggacatgcatgcctttgtcactgaagttgcctacaaaatggagcttctgcaattgacaaaccatggttttgagcccctggacctaatagtcgtgtctgcttcagaaaccggcaaccatggacttgatgctccggtgcaaacagacctctatggctaacaggttaacccaggcatgggagggtcctcatggctgataataacggctgagagttgtccggcacgcatctccggattccagctgccacctgcacaccagggaccgcgaagggcccggaaccgcagggcaagggcgagacaagcaactccggtccacacgcacgcgcactgggccatagagacattcgcaaccggccaaagcgcaggccacagagagagccccacaccaaagggcgaaaaaaaa

SEQ ID NO: 540505 - DNA, 184 bp, Homo sapiens
gactccaagcatggatacagcaaatgagatccacatcaagactcattacagtccaattgttgaaagccaaagacaaagggatattattattttttttttaaaaaccgggtttacccataatatggcccaggctggtctaaactggcgtggcgctcaatggattctcccgcctcaggcctcccaa

SEQ ID NO: 540506 - DNA, 892 bp, Homo sapiens
gagaagatgttattgtgcaaaaggatctcaaaaatcatgacttgaatgtgaaatatctgttggcaccagcacaacactgagtttgtgtgtgtgtgttgcatggcagagtagcttcagtcagtcatcttccatctatttatttttgggtcacatgtcctttattaacacttgcatcaacatcaacaggaccagtgggtcatcatcacagttactgctttcagtgtgtcccttatactctgaataaacggagtgtgggcagacacttatttcggaagagtctgtcttgggtgatacctggtaagaaagaccccattagggtcactgtccagtgcttagggttagttcactgcagaagcaactgaactgagacttgatgagaaagtgcaagggcatcggcatagtcagccataccacctagcagataagtcatgatccagatcgcgaatagcatgcaccgcaagaccacgcagcaaccatctgagcctatcacgcaacgggaacctgggcagcgaacagcgccgcaacagcgggcaaggggacgaacgaccagacacaccaatgaaacacagcacgaaaacaacacagaggcactcccagagcaactacaaaagagagaacgaaaacacgaacacgacacaccaaacaacaggcaaagaaaaaccacaaccaaacaagaccgcactggcaacgcgaaggcaaccggaggacatacagacacacggcaacgtacacaacacacgaacacccaaccaccaccacagcagacaccacagatggcccaacgaacacaagaaataaccaagcaccagagagacacaccaagcagcgagcaccaccactcaaagaaaacaccgacaacagagcataaacaccacaccgtaaaacaccgccg

SEQ ID NO: 540507 - DNA, 498 bp, Homo sapiens
  misc_feature (99)..(99): n is a, c, g, or t
  misc_feature (138)..(138): n is a, c, g, or t
atacatcccttccaaaaagcatcaaaatggcccaatggctttcttctttcccctgggacaatattaggggcttcagtccttcacccaaaggccctggcntattctgtctctctttctccccctggctgtgtctgtctntaagctctgtgtcctcggttcaatccaaggctgggaatccactaatcttcctttgcctttttaaggtggactggccctggttttaccagtaagccttttccccaactggtgctgcaagaactttatttataaggaagaacctgtggcaacttctgccccaaccacaactgccctggctgtgctccccacacatttggggcaaccttccctggcaagggcccttgtgggttttcattttccatttccttccctgtgggtaaagggttgggttaagggaatgaaaaggaaggcttccctccatggttttgggccttaagaaaattagtttggttattttaataaaagatttggcctttttta

SEQ ID NO: 540508 - DNA, 109 bp, Homo sapiens
cggctcgtcgattaggacggatcagacgaacaggggcgtttggtattgggttatggcaggcggtttcatattgataattgttgtgatgaaattgatcggcccctaagtg

SEQ ID NO: 540509 - DNA, 303 bp, Homo sapiens
  misc_feature (64)..(64): n is a, c, g, or t
  misc_feature (202)..(202): n is a, c, g, or t
  misc_feature (259)..(259): n is a, c, g, or t
gcacgagcttcgcagcagtgcctccctactagaaaaagtaagggcccacagctgggcgcaagtntgcgcctgtaatcccagcattttgggaggccaagatgggcggatcacttgaggtcaggagtttgagaccagccttgccaagatggtgaaaccctgtctctacaaaaaatacaaaaattagcctggtgtggtggtgcanacctgtaatcccaggctacttgagaggttgaggcaggagaatcactttaacttaggnggcagaggttgcagtgacacaagattgaccactgcactccagcc

SEQ ID NO: 540510 - DNA, 469 bp, Homo sapiens
  misc_feature (89)..(89): n is a, c, g, or t
  misc_feature (152)..(152): n is a, c, g, or t
gtgagagtgtctcagcccggtgctgggtctggccgaggggctggagggcacagctgcttccagcagccagcattcagtggccttgtacnaagctccacacctcctcctggtgctggctttggtgacatcacaaggcccctccaggtgcaggngcttctgtttggcaggcccctgccagggggacctggtggcctcctcattctcttttgccattggaatgtccccttgcagttctcttctcttttttttttttgaaatggattttcatttttgctgcccaggtctggagttgcagtgcctcaattctcggtctcacttgcaaccttccgcctcccgggtttcaagttatcgtcctgccttaggctcctgagtatgctggggatttacaggttcctcccagcattgctcggcttatttttttttttccctgggaaaaaggttcagctttgtgggaaccctctagagttca

SEQ ID NO: 540511 - DNA, 252 bp, Homo sapiens
cagtgccttcaggcgccattctagaccctgagaaagctttgaataaaacagaattcctgtccccagacagtttacactctggtggggagagacaggcaagtgaaccagtaaatagacagtatatcctgtggggaatcagtagtgtagatgcctgcaaggagattgctactactttacccagggtgtcaaaggaaggcctttctactaaggtgagtcctttcaggaaatctgaagaggtgtctggagaggctg

SEQ ID NO: 540512 - DNA, 384 bp, Homo sapiens
agggccgaggtccagctcctcaacaacacgtgggtctcgtcagcgtcacccagtgcctctgctgcctgcgtcccggtgcagtgccaggtgcagctccacagatgcaggtgcacccgctgccccaaggctgcccatgcccccagagccatcatccgaaccaccctatctccttcctgggcagggaggtttgagcaagacagggagctcgtagcagacatggccggtgaagatggccaggcagctgctctcactcccgctggctgtgctgcatcccaagtcccaggggccatcatcccagggaggaagattcatcacacctggaaacagctgggtccgccctcagatgaagagtgactggaaaaataaagccaaggatgccttaaa

SEQ ID NO: 540513 - DNA, 249 bp, Homo sapiens
agaatttattccggacacgtggcatgcggtgctggcagtgcccaccgtgggggacggggtggagggtgggttgggggcaggtaggagccgagccccgagcccctgcccggctactcgcggtaagtgaccgctggtgctggatgagctgggagctctggcgaaggccttcgcaggcgccacaagcgaaagcttcacgcccgaaagagaacgcaggtaccggaagaagagaaagcggccacaagcaaaaca

SEQ ID NO: 540514 - DNA, 827 bp, Homo sapiens
agcggaaccctagttgacaggagccgaagcagcagcgcgggttgtccccgtttcccgcgtcccccttccctatctccggtttgactcattcctggagggtcggccgtatacggacttgccagcagatcccacggttcgccgccagtgtgccccagatagacgaaacgaacgaaagagcaatcccggccgagacgccgacgacccggcggagcgaagcaagcaggacacgcacggaccaaaagaaaggtatactgcgctgaggacgaagctgaacgaggcaaaggctacatggccacaatacgccaagacctcatgtgagcagacagaagccatggagggtctccgagattccctcattgatactaagactctcacgaaaggggcactagacgtcacttttcgaccttcacggaggcactaagcagatccatagggctcagagaggacgccacaaagaatgtaaacgaattgatagggcaatgtgctggcccacaaagatgtcctaggggacccatgaacttaagaaatccttaggttgacttgggggttggatccggacaagtgctcgctccaaccctcgcgaaccaaagcgaacttcttttgtcacccccaagggaaagaaagacggttcctttccagaccttccggtctatcccaatgacctaccattgccattgtgaaccgggtgcttgggacctcacaaggttatagagcactggaacttggccttggccccccagtgggtcactttccttagtccagagaatttccccttgaagcgatctcgaccatttccccccccttacacttgaactttgcgatcacac

SEQ ID NO: 540515 - DNA, 315 bp, Homo sapiens
ttatgcacaacctagggtcagtctgcaggtgtaaagccatttaccaagatagttgtaggtaaagaagggcagatttattagagaaattgtgaaaatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtctctaacaattgttcatacaataattgttcattattgttctcaacttggggctctccccaacctggggacccttcctta

SEQ ID NO: 540516 - DNA, 279 bp, Homo sapiens
gacaacatcaaaagcctccatgtgacactgaatggtagtgtggaaagattttgtggggatgccagttacatacaatagccttgttactggtaagcactgtcaataaaaggtcacgtcatgccccttgatttgaggaaaacaatgagaatgtatttggtgaactagaatccgtgtcagtattgggaaattttaatgttgcaatatctagtcaaactttgagtgtactggtgctgtgaaccacctgaaaaaacaaattaaatgtattaatccttaataaga

SEQ ID NO: 540517 - DNA, 116 bp, Homo sapiens
tcggtaccttacttattttatgatctgagcactttatattcacttacagaagagttaaaagaatcacagtagaaaacagtaaagtttttcttggttccttgtttacctttcacggt

SEQ ID NO: 540518 - DNA, 928 bp, Homo sapiens
ggactcgagcagtctctggaacacgctgcggtgctcccgggtcctgagccaggtctgttctccactcaggttttccgcgcgccccgttcagccatgtcgtccggtcatccatgttgctgctggatgattggaaggcttacaaaggtgcacttcggcttggccatctgtgcgcgatcctggtgccggcttgttctcgagcgcgtgactgctggtgctcacggccgtcgggactgtgaccgcgtggtgccagggctgcgccgtactatgtcgagcatgcacggctggagggcctgtagcccagcgcttccaccagactgagtacatctgacgatctgcaagaatgcatccgcagccctgcgcagaacttcctgacgacacaggatgtactgggggcctgtacgtgctggtcaacaacgcgggcatcgccttcaaggcttgcgtgatcctcacatcccttgtcatattcaagcttgaagtgacgattaaacacaaatttctttggctacccgagaatgtgtgcacagaattactccctctatagtatagagacccctagaggtggagagtgcgtgaacgtactctagcgatcgatgacgcgtcagatcccttaaaagcgtgcaggccagagtctgcagcgagaaggttcctgcagtgagtaccatctactgagcgaggagctggtggggctcatgaacaatgtttgttggatggatacaattgaagcggagtgcaacctcaaaggaagggctggtcccagcagtcgcattacggggttgacgaagattggcgtacaccgttctgtaccaggatccagcgccaaggaaaacttgagttgagccagaggaacaggggaccaagatccttccttgaattgcctgctgcccaaggttggtgagaactgacattgggggaccaatggcaccagagc

SEQ ID NO: 540519 - DNA, 873 bp, Homo sapiens
gtgcattcctgaagtctctaatgtgactgtagggggcctggggaaaccactggcaaagtggatccaccttacgagcccactcaactcctcgcatcacttccgcgcctcccctccctctcctctcctctgagctcacactcctcgctcccacctccagcttgtgcccgcgacccccgaagaagaggaagctctatactcgtgagtcggccctgagggcgtggaaggtgatagagtggacatatgatcatcatcagagactatccacgtgcgaactctctgtgcccttcccgcggagatcaccaacgacagtgtgacatcacgagggcgtgagacctcatgatgcacaactctcgctgtgcaactctctccgtgtgcatctctatatcccactacccttttgcgcgagctctctctcgctgaaatagatgtgagtgtcgggcgtatctataaccgcgagggtgtgtgtagggcctcaacagtgtgtgacccccaataacgctgctcccagttgatgtgatccatgtcatttctaactcgctgattataaacccagctctctcctctactcaaagatgccctccacagctgagaggctacaaatcgcggtgtacaccgagacattattaatcccagccctccaaatgaataagaatcaataaatccactaaataggactgttatatttatcctcctcccgctcctaaggatgatggcacccgtcgatagatagaggcgctcccccgaagaaagatgaggggagcagttccgatcgaagtatgctagctatagatctcttcctccgccgacgtcagtcgctggtactaagaagaagaattctttctcacgggggctgatctccataaagatcgacgt

SEQ ID NO: 540520 - DNA, 302 bp, Homo sapiens
  misc_feature (198)..(198): n is a, c, g, or t
  misc_feature (223)..(223): n is a, c, g, or t
  misc_feature (273)..(273): n is a, c, g, or t
cccacagcaaagttgtatcttcggcccagcatgaagacctcttacacagtggttctgagagtacctggtacatacgtgtgtgcacatagttgaaaatgccttctgaataaagtgattgttttttaatcactaaaggagaataaccgaaaattcagagatttgggaatgttctatcttctatgtaaaagagaagaaganagacctactgctccctctctggatntcaagattaaatctactacccttttatcacacttccaggttttccttcanaattcattaactgcgagttggttccccat

SEQ ID NO: 540521 - DNA, 155 bp, Homo sapiens
  misc_feature (89)..(89): n is a, c, g, or t
  misc_feature (118)..(118): n is a, c, g, or t
  misc_feature (123)..(123): n is a, c, g, or t
  misc_feature (130)..(130): n is a, c, g, or t
ctttctgagcccatggaggacacagctaatcagtaaaggcatatattcttttttttttgagacacagtctcactccatcacccaggctngagtgcagtgagctgagatcgcgccactncactncagcgtnggggacaaaagcgaaactctgtctc

SEQ ID NO: 540522 - DNA, 118 bp, Homo sapiens
  misc_feature (6)..(6): n is a, c, g, or t
  misc_feature (43)..(44): n is a, c, g, or t
  misc_feature (46)..(46): n is a, c, g, or t
  misc_feature (99)..(99): n is a, c, g, or t
  misc_feature (106)..(106): n is a, c, g, or t
cactcncttccagcagtagtcgcttttactgtttacctgtttnngncctagaagttttccctcatctgtaaatgtgatttaaatctaagccatgatatncttattntaagagtatgcg

SEQ ID NO: 540523 - DNA, 347 bp, Homo sapiens
ttgtattcgggttaattccattccattccattccattccattccattccattcgcattccattacaatcgagttgattccattctattccattccattccagtcctttccattccattccactcgggctgattccattctattagtttccattccattccattcccttccattccactctggttgataccattcctttccattccactcgaatacattccctcctattccactcggaacgattccattccattccattccattccattccattccattccattccattccattccattccattccattccattccatttcgttccattccattctattccgtatcat

SEQ ID NO: 540524 - DNA, 107 bp, Homo sapiens
atctagaggatcccgtggacatttccacgagtcacaaattgagtattctatttctcagaaataattaataagaactttgattttattgcctttgcccactttatgag

SEQ ID NO: 540525 - DNA, 174 bp, Homo sapiens
  misc_feature (22)..(22): n is a, c, g, or t
  misc_feature (62)..(62): n is a, c, g, or t
  misc_feature (65)..(65): n is a, c, g, or t
aatgactctacatgctcatctnggctcagcatcctgggaccagtaacatgcctgctgctgtncancacccagccggggacgctgcagccacccatggtctcctagatttcccacccctcgcctgctttctcaacaatattctggttgccttcaatgatctgcgcctctgctgcc

SEQ ID NO: 540526 - DNA, 722 bp, Homo sapiens
gggcacggtcaatacaccatttgagactttatttaaaccggaaggccacataacaggtcctccccttggggtgatatcgtaggtaactccggccaatcatgcgtggtacaacaacctgggttctcccataatgaaggatttcttaacccatgtccgtgaccacatgaaagtgagtaaagggcactcctttccattcagaggcagacccagaaaacaatatcgaacagtagtcggtgcatttgtcatgccatagcagacgttttcaagttggtcattgggtaataagcatcccgcatactccgcgtcaagctcaataagcagtgcctaaccagctgggccccaaaatagctatcacaatccgcagctttggcaatctctatcaaaaggatgatgacgccacgcaggttgtaatcaagcccttataaaaagaaggtgataggccagtgacctagcgatcccacagctaccgtctcgatacgccaagtgtcccccagctccgtcagaggtgtattcagttcaaatgtcagtggtcctaaaaacatagattataggcctcagagtacgaagcagtctgggccgaaagaatatgaggtgtgtaaaataaagccccatcaaccaactctaaaagtactgcagactttcctatgtacaagattttacatatcagtatgaaaccagtcagaaataagatatgttgagtacttaataaataagctcagact

SEQ ID NO: 540527 - DNA, 360 bp, Homo sapiens
tcgacgggtggcagtgtgcacctgcagtccttgctacttgggaggctgaggcagaaggatggcttgaaccaaggagttcagttgcaccactgcactcctgggttattttggagaccctgtctctaaaataaataaaaaagaagttagagaccagcctgggcaacatagtaagaccctgtctctacaaaaaatggaaagattagctgggcatgatggcacacgcctgtagtcccagctacttgggtggctgatgtgggaggactgcttgagcctggaaggtcgaggctgcagtgagctctgattgtgatcgcccaccatattccagactggaagacagagcaaaccttatcaaaaaaaaaa

SEQ ID NO: 540528 - DNA, 106 bp, Homo sapiens
  misc_feature (46)..(46): n is a, c, g, or t
aagtcatcatctgtgcatggcacgaacagcagcacaacgacagacnggtgatcacttcgggcatcaccaacggtgccgtcaccaggccaccgaacagcgtgcggcc

SEQ ID NO: 540529 - DNA, 1037 bp, Homo sapiens
  misc_feature (739)..(739): n is a, c, g, or t
cctctgggtcggaactggcatcttgcagtagtccgcccaaatcaggaatgcacagggaagagtacagcggaggctcccgatatatgtcctctagaccttgctgaaaatgtggagttgctcgttgtgtccacatatatgcagaatctgtacgaaaggtgaatactagtgaaagcaatgaaggaaatgtggtgctgttcctaccgaacgcgaagtgtcccagagagtgttgatccagagggcaaagaactggagggatgatcgtagcggagtgtttacaccaagttatagcttgtattggccatttgtatgtaaatacaaaaacaatgttaaagggacaaatgattccttggcaatagagacataaactgttgctgtattttgacgtcaacgatgtaatgtcacattatatagatgacttggaagaataagcaatgcctgacaactgtatttgagggccaagtgattcgggaggctaagatatatgacagacctacacgatgacaccggtaatcttgggtatactatttgacctggggcaaagactgttcacaaccaagaagaaagcaacaacttgtgttgatgaaccaatggggaaaggaagccctagagtttgttgaaaacctattctcttatggagttcagtggacataatagttgggacaccacacagcactaagcggcctcctggggtcaccgacgagaacaagaacaaagaggctcgagaaacaacaccctatgnagaaaacgcgcggccggaaaaaagagttgttcagcaccactctcagacgggcgacggccacaggaagtaattggaatctgcaccaggtgcccccaaaggcaacaatggaataacccgggacgtgtgtgtgtgacccaaaaagacaacgcccgcgcgaccgcgctgtttgcaacaacccagacagctacggagcacaaggagcaccacacaggaggccagcgagcctaataaccacacacatcaggtggagaacaaccacgagcacaacgcacgcaccagcacaaccccacgccagaca

SEQ ID NO: 540530 - DNA, 118 bp, Homo sapiens
gttctcagcaggcatcccccaaaaacagcccttcattcacccatccaaccaccagtttgcaacggtcaattccagtggggtcccgcagctcgcacattcgtcaatccatggtccatca

SEQ ID NO: 540531 - DNA, 516 bp, Homo sapiens
  misc_feature (134)..(134): n is a, c, g, or t
  misc_feature (268)..(268): n is a, c, g, or t
  misc_feature (272)..(272): n is a, c, g, or t
  misc_feature (382)..(382): n is a, c, g, or t
  misc_feature (399)..(399): n is a, c, g, or t
gaagatattttatttaaaggatttagaagtacggtccctctgaatgataaagtccaggatgtggcagtgggctgcagtggcagaagaattttagtggtgctgactacactggagctgaggaggttgcctgaccntcactgtgatctgtgatatcacccacagtaattgaagtacctgggatggagaagacatgaacccagttctaaagccttaactgaagaggggattgtcagaactgaagaatacaaactggtgtcattagatggcntganattcaaaggaatggggtttttgtttttattaagggtggagaagtgattggaaaagtcactgtgagcaagtagcaagtgcttacttctcatcctaactctgaggaaatganatatgggagaaggaacngcttccagggaacctgaaatgtggtttgagcgtatcattctgtggtctgaagaggctgtgacttttctatgtggttagcaactggcagacactaaacttcaaaccaagtctccaaac

SEQ ID NO: 540532 - DNA, 112 bp, Homo sapiens
atcgatttgctgcctttttttgcggaatcaccatggttgctgtgacctgtacacgtatctgaaaactgtagggcttcaaggtctcatcgctgctcagtacagcggggctcag

SEQ ID NO: 540533 - DNA, 123 bp, Homo sapiens
tagtattgatatactagtttactaaacagtaaatatatgtgtgttatatttttatagaaaatactaaatgtagtcttctgggacttctttttgttcaagatcacattactaatatttgtcctt

SEQ ID NO: 540534 - DNA, 257 bp, Homo sapiens
aaaatccacaaatataaaatactggatgtggtgatgcaaacctgtggtcacagctacttgggaggctgaagtaggaggactgcttgagcccaggaggttgaggctgcactgagctataattgcaccactgcactccagcctggtgacagagccagcctccgtctccaacgaaaacaaacaaaaaaagaattacttcttccagagattctctgccagaactcctaggtggtgttggacccatatcttttacttccata

SEQ ID NO: 540535 - DNA, 447 bp, Homo sapiens
gtcacagaagagctggatccagtgacaagactcaccttgaccaaacccttgttaggctcctctgagccttcctctgccctggtcctcaaccctagtccccagccctggacctcctgttcttgcgagggcttcatggcccagttttaggaaagaatcctgctaagtcagtttagaaaggctcccccccacccttggtatctgatcaccctcaacatctgaccaagttcttctttcctttgatgtctaaggctttgtcctggctttagcaacaatattgttaggtcagtttatctagaacctcctacctttgatgtctctgcttagtaattctgtttgaaaccgttccgctactttaataatgacccaatcattccatactgtaagtgagatgattttaccctccctacttgcttgttttaattgttttccaatttttctccatctttt

SEQ ID NO: 540536 - DNA, 338 bp, Homo sapiens
  misc_feature (33)..(33): n is a, c, g, or t
  misc_feature (44)..(44): n is a, c, g, or t
  misc_feature (105)..(105): n is a, c, g, or t
  misc_feature (112)..(112): n is a, c, g, or t
  misc_feature (161)..(161): n is a, c, g, or t
  misc_feature (172)..(173): n is a, c, g, or t
tgttcccctccagggaggggtccccttgctccngtcctgaggtnaccaggtggtgggaaaggagctggagcttccgtgctcagacccacaacattggtccatcancaggctncacttttcctcagttccagggtggatagaggtcaagttcttgaccttangctctgtatcnnaaaattgccttgagaaactgcttaagaaaaccagatgtcatgctgagcgcggtggctcacacctgtaatcccaacactttgggaggccaaggtgggaggattgcttgaggcgaggagttcaagaccagcctggccaatatagtgagaccccatttctgtttttga

SEQ ID NO: 540537 - DNA, 303 bp, Homo sapiens
tggcccatgcaatgtcgaaatccactagggcagccaaatatcaatgctctgaaatgatctcttttgactccatgtgtcacaagtagtgtcattgctgatgcaagaaggtgggctcccagtggccttgtggcagctccacccctgttggtttgcagtggtacagcatttgctcccagactgcctatcatggtactggcactagagtgtctgcagtttttctaaggcaactggtgcaagctgtcagtggatctaccattctggggtctagaggacgaaggcctttatctcacagatccactaggc

SEQ ID NO: 540538 - DNA, 658 bp, Homo sapiens
  misc_feature (310)..(310): n is a, c, g, or t
  misc_feature (313)..(313): n is a, c, g, or t
  misc_feature (596)..(596): n is a, c, g, or t
ctgcctcggcctcccatagtgctgggattacaggcataagccaccacgcctggccaataaaatcaacatttacctggtttatgtgttgaccaactatacacatataattctacatttttttctaaaaattattatcaaacccccaatttcaccattagaaaaagagatcttaacatttctagatttttttttccatcataactcagttacttatggctgggataaaatatgtagggagataatctaatacctaattcaaaggaagaaaatatctaattctaagtcttgaattcttctcatcataccatancangatttaacatttaacatttttcacgaacttctaatacacttcattcacttttttagccacagcattggcatttaaattactgtactttaaaacatggaattgctggaggcttggaaacttagatgcaatttccctactgctacctccaatgagaatgacacaaaacagtggtaggaaaaactctcaaaattttacccaattgtatattttctacattgtcactatctacttttatatacttaatatatacttctaaaatttctgacagtgtttggtgtatcanaccaacctcaacatgtaagaacattgactttcacagtcaactaatgccacttatggtacccg

SEQ ID NO: 540539 - DNA, 896 bp, Homo sapiens
  misc_feature (9)..(9): n is a, c, g, or t
  misc_feature (18)..(18): n is a, c, g, or t
  misc_feature (30)..(30): n is a, c, g, or t
  misc_feature (38)..(38): n is a, c, g, or t
  misc_feature (49)..(49): n is a, c, g, or t
  misc_feature (89)..(89): n is a, c, g, or t
  misc_feature (99)..(99): n is a, c, g, or t
  misc_feature (127)..(127): n is a, c, g, or t
  misc_feature (146)..(147): n is a, c, g, or t
  misc_feature (162)..(162): n is a, c, g, or t
  misc_feature (168)..(168): n is a, c, g, or t
  misc_feature (170)..(170): n is a, c, g, or t
  misc_feature (212)..(212): n is a, c, g, or t
  misc_feature (227)..(227): n is a, c, g, or t
  misc_feature (239)..(239): n is a, c, g, or t
  misc_feature (258)..(258): n is a, c, g, or t
  misc_feature (260)..(260): n is a, c, g, or t
  misc_feature (268)..(268): n is a, c, g, or t
  misc_feature (281)..(282): n is a, c, g, or t
  misc_feature (288)..(288): n is a, c, g, or t
  misc_feature (295)..(295): n is a, c, g, or t
  misc_feature (304)..(304): n is a, c, g, or t
  misc_feature (394)..(394): n is a, c, g, or t
  misc_feature (396)..(396): n is a, c, g, or t
  misc_feature (440)..(440): n is a, c, g, or t
  misc_feature (443)..(443): n is a, c, g, or t
  misc_feature (453)..(453): n is a, c, g, or t
  misc_feature (478)..(479): n is a, c, g, or t
  misc_feature (483)..(483): n is a, c, g, or t
  misc_feature (486)..(486): n is a, c, g, or t
  misc_feature (488)..(488): n is a, c, g, or t
  misc_feature (491)..(491): n is a, c, g, or t
  misc_feature (500)..(500): n is a, c, g, or t
  misc_feature (522)..(522): n is a, c, g, or t
  misc_feature (535)..(535): n is a, c, g, or t
  misc_feature (569)..(569): n is a, c, g, or t
  misc_feature (574)..(574): n is a, c, g, or t
  misc_feature (580)..(580): n is a, c, g, or t
  misc_feature (589)..(589): n is a, c, g, or t
  misc_feature (631)..(631): n is a, c, g, or t
  misc_feature (665)..(665): n is a, c, g, or t
  misc_feature (671)..(671): n is a, c, g, or t
  misc_feature (674)..(674): n is a, c, g, or t
  misc_feature (697)..(697): n is a, c, g, or t
  misc_feature (733)..(733): n is a, c, g, or t
  misc_feature (743)..(743): n is a, c, g, or t
  misc_feature (779)..(779): n is a, c, g, or t
  misc_feature (827)..(827): n is a, c, g, or t
  misc_feature (879)..(879): n is a, c, g, or t
cgggggggncagggaggngcgcggagaganaaggccgngagcgcgccangaggcgctcaggccgagacaccttgcagctggccgccgcngccaccgagncgccgctgtgctcactgatccgtctccngggccaccgccttgttganncgcggtgggaagaanaagtcnancaagacgtcgcaggctctgccaaagcagggagttatgctttnccgtgggtgcggatnctgtggtacatnaagaaaggctacctccaantncaggattngagtgggggcacnngtgtanatggtcngccgtcctnggatacctgacagcggagattctggagctttctggcaatgcatcgatgatacacacaagaagggacgggtgcacaccctggctatatgcntngctggttgtgtgccaatgatgaagtagttgaatcaggctggctnaanggggttaccntagccagtgggggtgtgttaccgcnncatncancncgngttgctagngaagaaggggggattcaaaggnaagttggaagctntcagtcacaccacccccaggcataaaaggccaanttttnatcccngaagaagcntgtatctaaaaaagcaggaggtaagaaaggggcgcggaaatncaagaagaagcagggtgaagtcagttaggcagcnagcgcnganagcacaaccgagggcacacctgncgacggcttcacagtcctctccaccaagagcctctnccttggccanaagttgcaagttgtacaggctgacattgcctcgatngacagtgatgctgttgttcacccgacaaacactgacttctacatcggnggtgaagtaggaaacacgctggagaagaaaggtggcaaggagtttgtggaanctgttctggaactccgg

SEQ ID NO: 540540 - DNA, 323 bp, Homo sapiens
cccccggcacgagcgctgccacctccgattccgagctttcggcacctctgccgggtggtaccgagccttcccggggcccctcctctcctccaccggcctgcctttcccgcggactatcgccccacgtttcctcagccccctctctcccggccgagcgcggcggcagagcagcagcagcagcagcagcaggaggaggagcccggtgcggcggttgcggggagcccattggtaacagtcaaggaggcggcaaaaaaaagtcttctactactacacggttatatggaattattattatggacaggtcatcccatgagcctcataga

SEQ ID NO: 540541 - DNA, 615 bp, Homo sapiens
  misc_feature (365)..(365): n is a, c, g, or t
  misc_feature (615)..(615): n is a, c, g, or t
gcagtaattcgccaatagatgagctgatacagctcaaggtgaaaggagtgagatgcgcacccgagtatatgtgctctagtgcctttcaggaaacacatggagtttgttcccttttggtccgacgatatagtggcgagatactagtaagaggaaaaagagtcgatgttggttatgatcagtctaaggcgagatgaggctagctgtctcgagaaaaggaagtagccccacaaggtgcttatccaagtggactaaaatgcgtgcgcaattagatcatactagatgttgacccgagcatgactgctctgcgcatgtgttggtcaatactgatagcgaagattcagaggggcatcagtattcattgtccnagagaagaattcaatgatgcaggtattggagcgacattaaggtgacttctataggagccgagatagcttccttgaacacgttgtgaagggaataactgatcgagaatacaagataatgagagccaaacgagcatagaggtacactgtggcttcaagcatacacagcgccatgccatgctcctagccctagtagaagcacactttgtgagaaccaatgggaggggagcctgagctgctggaacctattacn

SEQ ID NO: 540542 - DNA, 796 bp, Homo sapiens
cccacatcctgggttgtgggccgcgttcccaacgggtgttactggcgcgctatggtcccgcgtggcgcgagcagaggcgcttctacgtctgcaccttgctgcaacttgtgcctgggcagacgaagtcgctgtagcagtgggtgaccaaagaggacacctgcctttgtgccgactttgccaaccactccggacgcgcatcttcgcacaacggtctcttggacaaagccgtgagcaacacgatcgcctctctcatctgcgggcgccgcttcgagatcgacgaccctcgcttactcaggctgttggacctatctcatgagggactgtaggaggagtcgggctttctgtgcgaggtgctgtatgctgtacccgtcctcctgtgtatcccagcgctggctgtcaaagggctacgctgacaaatggcgttcctgacccagctgggtgagctgctcactgagcacatgatgacctgtgacacaaaccagaccccccgagacctgtctgaggcctatctggctgagatggaggcgaaggggaaccctgagagcagatttaatgatgagcccgcgcgtagtggtggctgacctgttctctgccgcgatggtgaccacctcgtgcacgctggcctggggccgcctgctgatgatactacatccggatgtgcagagccgtgtccatcaggagatcgtcgacatcgtatggctggtgctgcgaccacagagggggaccaggctcacattatctacaccactggcgtgattctgacgtgcagagtttgtgacatatacccctggggggc

SEQ ID NO: 540543 - DNA, 814 bp, Homo sapiens
  misc_feature (78)..(78): n is a, c, g, or t
  misc_feature (340)..(340): n is a, c, g, or t
cctcggggagacctcgctaccttattaggagcaaatgtcctttggagctctcagtgtgtgataagggaaccaactcanaataagtctcgggggggaggaaactacgaaaatttgtgatgctctgaaacttcaggggaagaatgtgcaggccctcaaacccccatgatctggcttttcattcagatttgtgtgggtcaaggggagtattttatccctcactgtggcctgagcctgagggtgggggaattttagccccagggggcatctctgctttggcttggacctctgtcttcttacaccacattatctttctttctttacttggtcctttatgggtttngggggggttttggatatggattcggatttatttgggaatctggttctctctcaggggcaccatgaaaagctagggatgggagaagggagatcttctacttggctggttccctgaagaactggttggagcagagcccagcctttgcctcatgtaaaatccttggaatgttgagggagaaaagtcccaaccttgtacctaggcattacggcccaaagacacccaaacagggggcttgcgggcgctaagggggggagctctggcggcggttgcctccagaggggggtgaggtccggggcctcggtgccgggtcggtggggtcgggggcgcggtggggggagcggggtcgcggacctgaaggggggggtacgtgcgtccccccgacgcgggggttaccgcgtgatggagcgggggcggggggggcgtggggggggcgggaccggataaagggcgcgtggcttgccgtcttccctgtcg

SEQ ID NO: 540544 - DNA, 348 bp, Homo sapiens
  misc_feature (48)..(48): n is a, c, g, or t
  misc_feature (70)..(70): n is a, c, g, or t
cagggctttgaccatgtcgacttcaaacttcgtgaattgatcattacntgagcaacctcggcaaccgctntggcccgttcgatttccattggtctttctgggtccaggaggctctcgatcgcgacgaacaggtgattacgtagatcttcaatcttgttcttcatgttcaacctcccggatggtgcgtttgagtttgccgatagcgcgtattgcggatttcagctcttccggataccgatgaatggtgttccgacgcatacgttctgcttcaaggacggcaacaaggcccatatagccctgaataacctggagttgctgacgagagcagtcgacgcggccgcgaattta

SEQ ID NO: 540545 - DNA, 346 bp, Homo sapiens
gtatagacagggtctcactatgttgcccaagctggtctcaaactcctgggctcaaaggatcctcccacctcagcctcccaaagtgctgggcttacaggcgtgagccaccaaccccagcccacttgttggtcctatgcacaacagccagagatctctctgtgtatgtgaccttgctctccacaaagaaggacagcagaagctgggagaaagtcctctgggcgcctgggctctggcggtgctctctttcacccatcgttcttatctcgcactcaggggagaaaaggtttcagtacagaaatttacccacagcagaggccaggcctcaattaaaggcctacacaatggg

SEQ ID NO: 540546 - DNA, 689 bp, Homo sapiens
ctgtctcaccaaaggaaaaaaaaaatatccagtagtctatacaacataagtaattgcgtaaacatgtcagtggggggagggccaggtctgtcttattaattctaatatagaagaaattttgggaacaggaaactgctgttgcagaaaccacactggtgacaggtgcagattacaaccctcagcgggccgggcgccagtggctcacgcctataatcccaacactttgggaggccgaggcaggcagatcacttgaggccaggagttcaaggccagcctggccaacatggagaaaccctgtatctactaaaaatacaaaaattagccggggctggtggcgtatgtctgtaatccagctattcgggaggccgaggtgggagaattgcctaaaccaggaggcagaggttgcacgcgagcagggattgtgccaactcactccagacctgggcgacagaaccgtctctaaagacaaaaccttcagttgccatgaagcgcatggtgacgtgtggtgagaagcaggtgcacgctgcctgaaaaaacacacaaggacaagcatagtggaccccgagcgacagcatggtacagcgaacggagaggcccctccagaagcgaggcgggccacagggcgcacaccggggggtccaagggcggacccccggaactggccaatgcggcgaggaccggggcccccg

SEQ ID NO: 540547 - DNA, 935 bp, Homo sapiens
  misc_feature (34)..(34): n is a, c, g, or t
  misc_feature (103)..(103): n is a, c, g, or t
  misc_feature (141)..(141): n is a, c, g, or t
  misc_feature (148)..(148): n is a, c, g, or t
  misc_feature (150)..(150): n is a, c, g, or t
gatcgaagatgggggcggcgatctgtgtcgggcnttaccagaagagtcttcatgtggacagtctcagggacaccatgtagagaattttggtctcgattcaganaaagagaaagagccagtggttgttgagcacagtaggangagaaananagggaacctcatcctagtgtgtccaccgtttagcgaagccgcaggcatacacaccgacctgaaggatctccagagtcgttggggaatctgtacgtgtaaagaaggttttggttctcatgctctttcctgaggtaattgggcaagaccatctccctgggaagatggctcgatctatgaggttcaatcttctgggctcattccagctgatgacttggggctcatgtatgtctcgcctaaacatccagactccatcccagattgtgcaggggttaagagatgttcttgtatgtttctataatgtccctattcgaagatagatctagcatttgatggaagcgtcatgtgccgggtgatctgccccccatatttgaacaatcaccttggtggttactaacgcaattcgggaagagatacacatgtggatcacgtgtgctttccctgagcaaggggggtgtcattagatctttgataactttacatgtggagatatcttgcagaactgtgctgtaaaccacttttctggtcaaggagtgtcatctttcgtctcatattaccagtggcagttacggtgctcactgcctgtttgtgagcccatttcatgggatgcgctcttttgaaaagtttggtgggctgggcttggttaaaaagagggcctgggagcccttgctaaggtaaattgaaaatgtcgccgcggacacaaaaaatgtgggcgcaacaattgcactcgacaaaaagttgggtcggggcatttagtgtggaaaaaaaaagggcggctacaggcgggg

SEQ ID NO: 540548 - DNA, 164 bp, Homo sapiens
ttcgagtcagacttgctctcgagggcgagaagaggcatcacatcaacaaggtacaccaaggtacccaatgcctgtttattcaccatcaaggaagaagaccacacactgggaaacctccattaaatacacaactcctaaaagacccgcaaagtgctattctgctg

SEQ ID NO: 540549 - DNA, 743 bp, Homo sapiens
  misc_feature (6)..(6): n is a, c, g, or t
  misc_feature (102)..(102): n is a, c, g, or t
  misc_feature (110)..(111): n is a, c, g, or t
  misc_feature (114)..(114): n is a, c, g, or t
  misc_feature (124)..(124): n is a, c, g, or t
  misc_feature (129)..(129): n is a, c, g, or t
  misc_feature (143)..(143): n is a, c, g, or t
  misc_feature (168)..(168): n is a, c, g, or t
  misc_feature (170)..(171): n is a, c, g, or t
  misc_feature (219)..(219): n is a, c, g, or t
  misc_feature (238)..(238): n is a, c, g, or t
  misc_feature (248)..(248): n is a, c, g, or t
  misc_feature (263)..(263): n is a, c, g, or t
  misc_feature (270)..(271): n is a, c, g, or t
  misc_feature (275)..(275): n is a, c, g, or t
  misc_feature (281)..(281): n is a, c, g, or t
  misc_feature (284)..(285): n is a, c, g, or t
  misc_feature (353)..(355): n is a, c, g, or t
  misc_feature (453)..(453): n is a, c, g, or t
  misc_feature (460)..(460): n is a, c, g, or t
  misc_feature (464)..(464): n is a, c, g, or t
  misc_feature (486)..(486): n is a, c, g, or t
  misc_feature (625)..(625): n is a, c, g, or t
  misc_feature (645)..(645): n is a, c, g, or t
  misc_feature (727)..(727): n is a, c, g, or t
atcatnactttcataaatattcaactatctagaaatatgttacctccatgtttagcacatttaggtattttggtacattttaagtactatttcaatgttctntgtttatnntgnctgagtaggnagctnatagaaaattatgncatatatgatcaactattaccattntnnataaaaccacaggactttctacttggggctaatcaatagagggtcatntggcccctgtcttgtttancttctgagcntcaccctcttcttcnccctcanngtancgttgnatnntggtctgattatctctccttcaatgtaacctgtagcatttatatgggtcaatgagacaactattaatnnncctcaacataaacaaatctttaactaaacttattttgactaattatataatacccttcagaactgttgttcacaacaggtctgaaaatgatctggtgntcgtttngtanttgtgaggagaaaaatattgcngacattagattttcaatggtaaccccaaacatttgttctacagctttttctcccctcttatcttcctactaacgacattgagattgtggctgcaagaaaagttttccagttacttgataaaggcctagcatgaccccanataagcacctaatgtgtttngcacaatcacatttagctttgtgatatgttgctcttcaaaatagagtcctttgttgctgagttgagttcaatttctcttgancattaactgctcttct

SEQ ID NO: 540550 - DNA, 168 bp, Homo sapiens
gatcacctcccttccgctaattaaagctaagattcagctgagtcgtattgtgttccagtagtatacaaaatacactacgaaagtggatttagattatctgaacactcaatagctaagacccaaactgggattagattccccactagtgcttggtcccttatcgagggt

SEQ ID NO: 540551 - DNA, 413 bp, Homo sapiens
  misc_feature (133)..(133): n is a, c, g, or t
atgtgagtaacaggaatgtgtctttaaaaagctagagtggtttcttttaatcagcctttttggtggtttgggttcatgagttgttttggcctcctctcccacaactggggttgttttctcaggacttttttcnttaaagctagtcccttcgaaagcattttgtatttttttgaatgcccccagtatgggcgctttcgacacctttaacccactttggtttggtgtttataaaacctggtccctccctcaagttaatggatggtcttgctttttttttgtttttttttccctccttttgattgattagacattgtctagtattataaaatggtatttaaaatgcttgtaaatactatttatgtttttaattttgtaaaataaaaatttctttttaaccactggcaaaaaaaaaa

SEQ ID NO: 540552 - DNA, 1170 bp, Homo sapiens
tagacacacgaagcatatttcacctccgctaccataatcatcgctatccccaccggcgtcaaaagtatttaggctagactctgccacactccacggaagcaatatgaaatgatctgctagcatgtggctctgagccctagtgattcatcttactattcacctgtacggtggcctcgactggtcattcgtattagcaaacgtcatcactagacatcgttactacacgacacgtactacgattgtgatctcacgttccaactatgatcctatcaaataggagcatgtatttgccatcataggaggcttcattcactgattacccctatgctcaggctaaaccctaggaccaaacctacgccaaaatccatttcactatcatattcatcgtgcgtaaatctaactttcttcccacaacactttctcggacctatccggaatgccccgaggtaagtcggactaccccgagtgcatacaccacatgaaacatcctatcatctgtaggctcattcatttctctaacagcagtaatattaataattttcatgattctgagaagccttcggttcgaacgcgcaaaagtcctaatagtagaagaaccctccataaacctggagtgaatatatggatgcccctcaagcgctacaaacattcgaagaacccgtatacatcacatcttagacctaaaaatcggacggcatcgaagcccccaaaggcagggttcaaagcgcaagcccaaggggctccacgactgcgctcaacggacaccgacacagaagaacaccgacacacacaacacacacaaacgcggggcggaacaggagagacacactaaagggaccccacaaaggagaacacagcgcgagctcgaccaacggcgggcccacagacggagcgccaaacaaacgacagagcagggcgaatacaacgacgggcacaagagacaacacggacgacacacactccgaacgacaccaggcggggcagcacacgcgagccaaccccagcaccggccgggacccaagactcacactgagctcacacgaccaacccgacgacgggaggttacgccacaaaagagacagtggaccgcaccaacagcacgcaccacggccacctcaacagcaacagagagacaggacgcacgagccgccaccacgcccccatcgcgcg

SEQ ID NO: 540553 - DNA, 215 bp, Homo sapiens
  misc_feature (1)..(1): n is a, c, g, or t
nttttccataaaactagctcatcatagattaaaaagcaacagatgttaaagttacaaactaatattacacaaggataaataatagcttaatcatggcaatctaactcccaagctaacactaagagaatgacatctttcagaatatgagtttaaaaacttacaaaacagggtatcaaataggatgtgattactaccatgattctgtgacaatcatc

SEQ ID NO: 540554 - DNA, 253 bp, Homo sapiens
cacgaggcttaccactgaacaaatagcacacgattttcttaatgaacgtgttgctacctttgcgcaaagtgcaatctctgagtgtctaccatccccagctggcatactgtgtgctgcagtttttacctaaggtcagcaccctcaccggaccagtggggatgggacttctcacatactggccatcgattcacagaccatcagaagtcatgttctgaaacgagttatcacaaatttgacatatcaatgcatcatc

SEQ ID NO: 540555 - DNA, 1279 bp, Homo sapiens
cgagccctgtccgaatgggagcggagcgcatgcctggccctggggcctggtcgagcccgcggccatggcggcctgaggcgacagtgtggccggaagcggggctgttggcggctgcctggccaaagacggcttgcagcagtctaagtgcccggacataccccaaaactggctgtgcgcgcctcgtcgctgtcgcgtgacgccgagcgcctgagcctaccaaatggtgccgggagtacttgggcaggggcctggcgccgagtgcagccctgagtgagctgagggttttacccccgttggaggtgggaggtcaggggtacagcctctaccggtgcgcggatcgcgggtcacgggggtcagcctgcgtgggcccctcagggatcgctccattgttattacggcccccccttctttgctgccctgctgcccttggcggccgtggcgcctggggtggcccgcgcccttgggccggcgaaggggggcccgggggggccctgccgggccacgcggctagggcgcccgggccgcgacaggcgccttgaacgcggcggccccatggccacgttggggcttcttgctatgtcgggcaagggcccatcagggcgtatcccttgtcttccgttcccagcttgcactcggcatccgcggggtacccatccgcttggccccaggcggtctgcgcccgagggagggccccccacgtgggacaccggcttgcccattacattagccgcggcataggctaaaccagaaaaggacccaactcctatgtaccaagtggggacaggttcgacaactattcccccattgagccatggctatacgaacacaagcgccggcttggacattagttacccggccccaactaaagctttttgaccgaggacaacgccgtggccatacgacaattgctgaggaggacaccccccaaagcggattgtgataaccgggcgaggcatacacatatcaccccaaagaaggggtgtggccccaggcgacttgttgactaaacgtagcactaagcaatttccccccaaaaatgcactaccgaggccccagataggcataacaacaactcttcccgtacggacagcccattttccgaacagccactgccccccaggatcgtacttcgggtcaacaggtcacacgacacctatgtttgaccaccacgtcgtaaccaacgtgtgtggccgccaaactttatccacattggacgctatttgtgcatgcacgatgtccctcgtatctccactaccgaatgtggtgtacggtcccctaa

SEQ ID NO: 540556 - DNA, 163 bp, Homo sapiens
gctcggcccgacgtacagggcgactccttcttaaaacaaaaaagtttgtcatttctagattacagatttccaaattaaggtgttaggtacacacatttagaatttttatgttatcttgatggattaaccactttatcattaagaaatgagccgactgagtcca

SEQ ID NO: 540557 - DNA, 183 bp, Homo sapiens
agaagacatatctttagctagacaaagtgcttatagaaatcttgacaactgaaccattcagaaggatttgtctggtataaaactggatcccactgtacagcaattaagagataaaatatatgatatcatactccatatgcttctctatccgctatactatgaggtaactaagatttgtttaca

SEQ ID NO: 540558 - DNA, 951 bp, Homo sapiens
ctctgttcaccgccaccctcatgcacaggctagcgccacactggttccttcgcacgctggctgctctgcaatggcagtctgttccggtacatacacccgtcagaggaggaacttcgggcgctgtcagggaaactgaggccccgggtcaggaaggagcggtgggcaaatggtcttcatgacgagaagccattgtcagtgcctcgagatgcccatttccagctgcagacctgtcccctcactgctgtggatgccctagtcctgcgcttctttctggaataccagtggttcgtcgacttcgcagtgtactccgttggtgtgtacctcttcacagaggcctactattttgtgctgggcccagtccaggagaccaacatcgctgtgttctggtgcctgctcactctggccttctctctgaaggtgttcctcatggtgacccggctgtacttcagtaccaaggagggcggtgagcgctccgtatgtctctcctttgccttcctcttcctcctcttggccatgctggtacaggtggtgcgggaggagaccctggagctgggcctggagccgggcctagccagcatgacccagcacctggagcctattctgaagaagcaggattgggactggacactccctgtgatcaagttggcatccgccttgggctggcggtgctaagtccctgtgggcgccttcctcattttcactggcctgaggtggccagaccacaggagcgctgacctgtctggggacgaccctgtacggtgtctaacccagttctgttccctgtggcctgtggtctggcaagctggccggattcggcacggcccaggactggtttccgtgcggcgaggtcgacctcgcgggtggggggtcgtccggacgcctggcttttgcggcgggaccatggtgcgccacgcgggtgggggccccctcgaggggccgcgggggcggcgg

SEQ ID NO: 540559 - DNA, 238 bp, Homo sapiens
  misc_feature (11)..(11): n is a, c, g, or t
atgtctagtantctaaggatcccggcctccacttggtttgcagaaagccaagatcgcgccattgcaccccaagcgtgagcaacacggcgaaactccatctcaaaaaaaaaaagaaaggggtaaaccccgttttttatttgccccgttattcccttccttagttttccggcaaagaaaattaaaaccttgggcttacacacaaaaagggaggtgtccccatttgtccttggctttttca

SEQ ID NO: 540560 - DNA, 168 bp, Homo sapiens
  misc_feature (12)..(12): n is a, c, g, or t
  misc_feature (93)..(93): n is a, c, g, or t
  misc_feature (98)..(98): n is a, c, g, or t
  misc_feature (118)..(118): n is a, c, g, or t
  misc_feature (141)..(142): n is a, c, g, or t
  misc_feature (154)..(155): n is a, c, g, or t
  misc_feature (166)..(166): n is a, c, g, or t
aaattgttagcnttccttcctttggtcttcccacacccctcaccacaagaagaaaacaaaaaaaactaataaggaggacaataagtgcaaganaaaanagaaaatctaaatagtatgngattagtttttatttttaactannaataaatgcttnncatctttccanaa

SEQ ID NO: 540561 - DNA, 212 bp, Homo sapiens
tatatattgggctgttttgtccgtcactgttctctattctgacgcaggctttgcggaggacaatgtctcttcatgcttacttatactaacattcgcttcttctatcgagtgattgattgctccaatctgggtgtgaggacttcagttatctgtttgggattttttaggtcgtgcgtgttgctgtttgtgggggtagcactgggtaccgagct

SEQ ID NO: 540562 - DNA, 339 bp, Homo sapiens
  misc_feature (12)..(12): n is a, c, g, or t
aggctctctcgnggggggatcgaggaaaaagctggagcactgggtgcagtttctggagccagaggacaccgtcactccacggtgctcggagtaatggatgctcggtagaaagggaagcccggcacttcatttgggttagagacacggaactcgggataacccaggcaccaggtttcaggttcggcccagtgccttcctgggtagtttacatataagtatccagggatatactcccactaaggcgagttctcaaatggcataagggggcaaatcttttcaccttcttactaaccttggtggatttatttggtctatttcttacccccacagagagagcgt

SEQ ID NO: 540563 - DNA, 1014 bp, Homo sapiens
cgtgtatttaattacgtggctgggttagtcgctctgtgactgggccgaggtcgtcagaaggtgatcaagagaagctcacttactggctttacacattgagagcagcagccggaaccaggcagcccaagctgccaatcctgaagaccctcggagccagggcgtggaagattcatacaggagtcaaaattaaaaaataaacctctttgagaaagaaaaggacatgaagaaaagccccacgtctcttaaagggagacatactacctgtcagacagccccttgctggggccccctgtgtgtgagccgtcggtcttgggctcctccccggccgtgcccagctcgtggtgcccaggcctcgcctcacccggtcgccgaggcctcggtatctgctcatgctttgcccagggaatcatgcactgttcatgctgccaagtcaggcagcggactcagaggaagcccgggagcaaccttgctgctggctcgagcggcctctgttagagggaaagaagcatccctggggctgcggagaaagcccaggatatgagatccaggtagtccttccaggacaaaaaatctccaggtgagaaggaatcccagcggattgtctccctgacaaacctgcccggtgctgtcacatgtgccggccgcggagccacttggccaggcaagggggcgatcccttgttccaacacgtgggggctaaaagaagaccctgttaaaaagcaacccggtctaacagcaatctcgcaaggaagtcctcctcagggctggttggacacgggcaatcaaatggcggtgccatcccaggaatggaagctaatacagggatttggaggttcctgcaaaagatccggcttgtcaaataggaagtggacaatggcccccatgttggcaatttctcaggcgtgggaccctgcaccacggcgatttaacggggatagcaccctaaacccacaaacaaagaaagacaaaaaggaaataaaaaaaaggagacaccagaataaaagaaataagacg

SEQ ID NO: 540564 - DNA, 143 bp, Homo sapiens
gtacggtcacacgcaccggaagggggcaaagggagtctagggaagagggggatcgggagagggcttaggtgcctagatgatgttgctcagcagcctggcctgggtcagagagcctgaggggcccttctccggtggcgtggtgt

SEQ ID NO: 540565 - DNA, 311 bp, Homo sapiens
tacaacgtcgtgcacagagttaaaaccaagggggtaaaaggatcctgaaatgtcctaatagttggtgtaggcccccaaccattaagggcaagatagatagtttaaaaatgtaatacctcaggtctacacatgaatgactttaaatttactccttttggtatgaacccaataagcagtctaataccacggggcctacgtgctataaaagtaagtaataaaccaaatacttgaaccatgatggcaacttaaatcctggggataatcttttatattactagagagaaggagagtgggctaggccccaggggggc

SEQ ID NO: 540566 - DNA, 476 bp, Homo sapiens
acgaaaatgacactctgacacagacgcatggagacagcatcagtctccactttaggctggatggtctgagaagaaggctgaattcctcccaacggtatatcgaagactcctgttgtggtgtagatggatctgtctgttttatcacctgttgccaaaattccagcaggaaggtttattttatttagctgctgttgagtctcagagtttaccttaatgttcaacacttggacaaaatcagccatattaacacttgtaatagattgtagtaggtttagtagaattgccaattcactgtggtttaagtgctgtccagggcctgtttatacaggtgccacatttgcgctgccctgagatttcagctgtgaagatggcagcacaccctggggtgtgtaggttctgctgtcatccaagcccagagacaagtccttcctgggggctttaattgtggaaacatcatcagtcatgcccatctgctt

SEQ ID NO: 540567 - DNA, 289 bp, Homo sapiens
ctcatctgtctttggtcgttctttcttcccatggtggtctcctctttgctttcatccctggtgatcccgctcgaggaggagaactcccaggggatgatgggcggatatactttagactcgttctgcccgtctggaggatagagatttagttcttactcttatagagatccgttctctaggtgggtagaagcgatttcgctaactcttcagaaaaggccgcagaagtctcccaaaattccttgtaacaagaaagtcaatccgctagacttttggtctccgctggtgtcca

SEQ ID NO: 540568 - DNA, 407 bp, Homo sapiens
tcgagccggtcctcaccctactgtatctagatgtgcaaacacaagtggggacttggtgatccacttcatggaggagatagacaaggagatcagtgagatgaagctgtcagtcaatgcctctccctgacgtatcctaaggaaataagttgaaatgtgaacaaatatttatttataagtatgttaactgtgaggttattagcagccatggaaaattggagacattccaaatttctaacaatgggggaatgtgtttaatgacatattgtacaaccatttaatataatgtataggattaagatggtaatttttatgttatgtctttttcactacaatttttaaaaaaatgtatagggcctggtgtggtggcacagtttctgtaatcccagcaactcaggagactgaggcag

SEQ ID NO: 540569 - DNA, 296 bp, Homo sapiens
ttttagtcttatcgagagactcgatagtgaacccgttgaggtcgatgaactttgccgtgccatagggcggggtagcgagtcgccgaataaacggagccagtggaatgatgggggtgctgttatcggccggcagggtgaaagtcgcgtttttcagcgcgtagccaaggatgatggggtcggggtaatgcacatcgttttccaatagcaacacgccgtgaatcagcgtcattgtggaagccgtcgtgtcagtggagtcctcgtcgtaggggtgcaaggtcgaggaagagagttcgatc

SEQ ID NO: 540570 - DNA, 235 bp, Homo sapiens
  misc_feature (106)..(106): n is a, c, g, or t
taactccacagtagtagacagcagcatgaaacgggggggggtgggagaaaggggaggggaagagtactggaatatgtatttgagccctgatattgacgtagttgangcggccagcgcgtgaatatggtgaaggcaaaaagacgctgctttggcattctctttgcagcacagagaagtttacatgaagtagaagaaatccttgcagtggtgaaaactgacatggcaagtggcagaa

SEQ ID NO: 540571 - DNA, 431 bp, Homo sapiens
  misc_feature (4)..(4): n is a, c, g, or t
  misc_feature (11)..(11): n is a, c, g, or t
  misc_feature (21)..(21): n is a, c, g, or t
  misc_feature (29)..(29): n is a, c, g, or t
  misc_feature (39)..(39): n is a, c, g, or t
  misc_feature (54)..(54): n is a, c, g, or t
  misc_feature (61)..(61): n is a, c, g, or t
  misc_feature (69)..(69): n is a, c, g, or t
  misc_feature (89)..(89): n is a, c, g, or t
  misc_feature (119)..(119): n is a, c, g, or t
  misc_feature (128)..(128): n is a, c, g, or t
  misc_feature (144)..(144): n is a, c, g, or t
  misc_feature (158)..(158): n is a, c, g, or t
  misc_feature (170)..(170): n is a, c, g, or t
  misc_feature (176)..(176): n is a, c, g, or t
  misc_feature (190)..(190): n is a, c, g, or t
  misc_feature (209)..(209): n is a, c, g, or t
  misc_feature (219)..(219): n is a, c, g, or t
  misc_feature (240)..(240): n is a, c, g, or t
  misc_feature (243)..(243): n is a, c, g, or t
  misc_feature (245)..(245): n is a, c, g, or t
  misc_feature (273)..(273): n is a, c, g, or t
  misc_feature (299)..(299): n is a, c, g, or t
  misc_feature (306)..(306): n is a, c, g, or t
  misc_feature (309)..(309): n is a, c, g, or t
  misc_feature (311)..(311): n is a, c, g, or t
  misc_feature (315)..(315): n is a, c, g, or t
  misc_feature (321)..(321): n is a, c, g, or t
  misc_feature (325)..(325): n is a, c, g, or t
  misc_feature (334)..(334): n is a, c, g, or t
  misc_feature (337)..(338): n is a, c, g, or t
  misc_feature (341)..(341): n is a, c, g, or t
  misc_feature (360)..(360): n is a, c, g, or t
  misc_feature (364)..(365): n is a, c, g, or t
  misc_feature (368)..(368): n is a, c, g, or t
  misc_feature (371)..(371): n is a, c, g, or t
  misc_feature (407)..(407): n is a, c, g, or t
taanaaaaacntatttatttnccaggccnggggggggcntgggggtacggttcngggcccnggggcccnaaagggggccggggggcccngtcgggggggccgcgggcccccgggggacngccgggccngaggcccggccccccnccccggccgtgggngggacccgtggngggggncgggcccgggcccnccgggggggggccccccgngttggccccnccccccccggttctcccgggnccncncgcccctccggggccgggggccccggcngcccccgggggcccgggggccgtccngggggcnggncncccngggccncccncgggggccnccnnccntgccggggggccgggggcncccnnccnccnccccgttccgggggccctggccccccggctgtttcncccggggccgggctgggtcccccc

SEQ ID NO: 540572 - DNA, 1450 bp, Homo sapiens
gagaggcggccgcgggcggaggggcgggggcaggctagcgggaggctctccgtgaggcacggagggtgactggggacaggcgggcggcgacgggcttgtcatggggatccgggctgcgagacggcactcgtagcatctggggactccgagggggacaggaagttcagcgcccgggaccccggcgccggccccgccgaggggatccccactgctccggtcctggagcgggaggggagaaaggagggagccccggtttcgccccgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggctgcgctcctgaccggggagcggagccggctgctcacctgctacgtgcaggactaccttgagtgcgtggagtcgctgccccacgacatgcagaggaacgtgtctgtgctgcgagagctggacaacaaatatcaagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttg

SEQ ID NO: 540573 - DNA, 157 bp, Homo sapiens
atgttgcaggatgtctcaaactcctggacttaaggaatccctctgtctcagacttccaaaatgttgggattacaggcatgagccaacatgcccggtaaaagaaaggttttgtagctgtttctgtgggcagtgagcaccgtgagaaaatcttaccttt

SEQ ID NO: 540574 - DNA, 88 bp, Homo sapiens
caggggattgatttgaaaaaaaaatgtgttgaattaccccatttgctggacaaattatttaataaactttattcaaaattgggtggca

SEQ ID NO: 540575 - DNA, 1562 bp, Homo sapiens
  misc_feature (1562)..(1562): n is a, c, g, or t
gagaggcggccgcgggcggaggggcgggggcaggctagcgggaggctctccgtgaggcacggagggtgactggggacaggcgggcggcgacgggcttgtcatggggatccgggctgcgagacggcactcgtagcatctggggactccgagggggacaggaagttcagcgcccgggaccccggcgccggccccgccgaggggatccccactgctccggtcctggagcgggaggggagaaaggagggagccccggtttcgccccgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggctgcgctcctgaccggggagcggagccggctgctcacctgctacgtgcaggactaccttgagtgcgtggagtcgctgccccacgacatgcagaggaacgtgtctgtgctgcgagagctggacaacaaatatcaagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttgaaaaaaaaaaatgggcttgttggctaacggggagctttgcgccgttcccttaggagggtattatgacctcgtactgatcgtgcctcggcgttcgtggggaacggatagtaan

SEQ ID NO: 540576 - DNA, 1199 bp, Homo sapiens
  misc_feature (1084)..(1084): n is a, c, g, or t
  misc_feature (1111)..(1111): n is a, c, g, or t
  misc_feature (1114)..(1114): n is a, c, g, or t
  misc_feature (1124)..(1124): n is a, c, g, or t
  misc_feature (1132)..(1133): n is a, c, g, or t
  misc_feature (1138)..(1138): n is a, c, g, or t
  misc_feature (1141)..(1141): n is a, c, g, or t
  misc_feature (1151)..(1151): n is a, c, g, or t
  misc_feature (1187)..(1187): n is a, c, g, or t
gagaggcggccgcgggcggaggggcgggggcaggctagcgggaggctctccgtgaggcacggagggtgactggggacaggcgggcggcgacgggcttgtcatggggatccgggctgcgagacggcactcgtagcatctggggactccgagggggacaggaagttcagcgcccgggaccccggcgccggccccgccgaggggatccccactgctccggtcctggagcgggaggggagaaaggagggagccccggtttcgccccgcccctgggctggtgctgcgggggcggggagtgagggctgctctggggggagtggagatcggggagcgcggccgtgccctctcgagcggctgcggggtccccgcggcgccgggctgctgagctgagggcccgcggcggccgcggccggtgcatgtgcggctgctggatgcggaggcggcggcgacggcgcggatcggcaggatgttagggcagcagcagcagcaactgtactcgtcggctgcgctcctgaccggggagcggagccggctgctcacctgctacgtgcaggactaccttgagtgcgtggagtcgctgccccacgacatgcagaggaacgtgtctgtgctgcgagagctggacaacaaatatcaagaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcagggaaaggggaagctttcacctgtttggagtttngcattaggttccttattggaacctacntantggtttatgncaacccanntgttnttntggggggagntggttggggtgtggaccattgaaccagtgttcccanttggattgggtt

SEQ ID NO: 540577 - DNA, 1025 bp, Homo sapiens
cgggcctggaaaatggctggtcgcgagaggggcggtggcgagctggctgctggggagggagtcggggctgtgcgggggcgttggttcggccccagcggagtccgaatcggggtttgcagcatgttttgcggtgatgtttccaacctctttcccagtcaatggatcaggacggcgatcagcagctcggaccgtcgcggatcctggctccgcaaacgttaaaggaaattgatgatgtctacgaaaaatataagaaagaagatgatttaaaccagaagaaacgtctacagcagcttctccagagagcactaattaatagtcaagaattgggagatgaaaaaatacagattgttacacaaatgctcgaattggtggaaaatcgggcaagacaaatggagttacactcacagtgtttccaagatcctgctgaaagtgaacgagcctcagataaagcaaagatggattccagccaaccagaaagatcttcaagaagaccccgcaggcagcggaccagtgaaagccgtgatttatgtcacatggcaaatgggattgaagactgtgatgatcagccacctaaagaaaagaaatccaagtcagcaaagaaaaagaaacgctccaaggccaagcaggaaagggaagcttcacctgttgagtttgcaatagatcctaatgaacctacatactgcttatgcaaccaagtgtcttatggggagatgataggatgtgacaatgaacagtgtccaattgaatggtttcacttttcatgtgtttcacttacctataaaccaaaggggaaatggtattgcccaaagtgcaggggagataatgagaaaacaatggacaaaagtactgaaaagacaaaaaaggatagaagatcgaggtagtaaaggccatccacattttaaagggttatttgtcttttatataattcgtttgctttcagaaaatgttttagggtaaatgcataagactatgcaataatttttaatcattagtattaatggtgtattaaaagttgttgtactttg

SEQ ID NO: 540578 - DNA, 205 bp, Homo sapiens
ggcccggagacagcggctcgagatgaacctggggctgcagaagatattccagtgaaatgctctacattatgtgactggatggatgaaatgaatggtgctagtatttgtctcaatgactattggcaaacgacttacttgtgtgtgcgaagaccctgttacatgaagcacacccgtggttgaatgcagacacttggcatccatggca

SEQ ID NO: 540579 - DNA, 103 bp, Homo sapiens
gcggccgcctactactactactaccactgctcgaattcaagcttctaacgatgtacggggacatggaaatacagttgttggcctccggcctcccctcaaaaaa

SEQ ID NO: 540580 - DNA, 948 bp, Homo sapiens
  misc_feature (124)..(124): n is a, c, g, or t
gggtttccggaatatggcggggcgtttggctcttgctgcagccagagctccaggtctcgtcttcatttctgtgtcctttgttcttagaggtccagcctgtgtggccctgtgacccgcagatatngggagatacacagctaagactccaggaccccctggaagcctagaaatgtgactgtgcctgacgtgtagccctgtctggggagctctgcacgcgcaattccgcagtctctcccagattgtgcaagaaccatgggaggggcgtcagatggagtcttgctctgtcgcccaggctggagtgcatggcaccatctcggctcacagcaacttccacctcccgggttcaagtgattctcctgcctcagcctcctgagatagctgggactacacgatgtgcaccaccacgcccagctaaatttctatttctctcctatttttaagtagagaaagggtttcactgtgttagccaggatagtctcgatctcctgacatcgtgatctgcacactcagcttccaaagtgctgggattaccaggcatgagccattcgtgcccaaggcctgtattatatctttatctttatcaagtgcggtctaagtgagcattggtatgacttcggggcatcacttggcattctggctgacggatcggcgcgtatactgcatgcggtggccaattttcagcacgtttctgacacctgggtcactgcaccacccacctcctcatcactcatggcttggcgttccccccaatggccaggaacttccccaccacttatggtcattcagcgccaggcaattggggtccagctgtctgcagctacacgtcacgggaccaccggcggcattgtctgggccccccgggtgcgcccaactcaacagcgaatacccatgacattccaacactacacgtgcaacagggtccccggatctcgaggcgaactatcaaaa

SEQ ID NO: 540581 - DNA, 586 bp, Homo sapiens
tgggtcagatggacaataaaattcaggctgaagtggtttctgatggagatgaggaacttattcagagttggagtaaaggtcactcttgctatgcaaagagactagtggcattttgcccctgtcctagagatctgtggaactttgaacttgagagagatgatttagggtatctggcagaagaaatttctaaatggcaaagtgttccagaggaagcagagcatacaaatttgaaaaatctgcagactgacgatgcagtagaaaataaaaacccattttctagggagaaattcaagctggcagcagaaatttgcataggtaataagaagctaactattaatcaccaagacaatggggaaaatgtctccagggcatgtcagagaccttcacaacaggccctcccatcacaggcccagaaacctaggaggaaaaatggtttcatgggtcaggtccagggtccccctgctgtttgcagcctagggacttggtgtcctgcatcccagacatgccagacatggctaaaaagggccatgtacagtcaggcctggttcaacagtgaagcctgaagtctggagttccaatggtgtga

SEQ ID NO: 540582 - DNA, 361 bp, Homo sapiens
catttccactggtgatatgaatcaggaatatcaactcccattgtcacaaaatcatattcacaggtacagaatgtgaagactctcaactcgtatctcatttgactgagctgcaaggcaaggaagagtagcattttcaccatttgtttgtctttctgggaactttgatgatgatttgcttcgactagaaactcctaaccatgttactctaggcacaatcggttgtcgatcgctctcaggctccagtgctgttgtcacagaattttgataaacgagcaaggaaaatgtcgcttattgcctatgcactgcatttctacaaacatggttcctttataggattagtccaggataacaggatgaatga

SEQ ID NO: 540583 - DNA, 134 bp, Homo sapiens
cacacacacagatggggaggtacagaaacccagctggtaagagtttcttaccctccttagccagcataccagctttccaggttaccatttctctgcagcttattgagcacagagagctttttatgacctactag

SEQ ID NO: 540584 - DNA, 294 bp, Homo sapiens
  misc_feature (35)..(35): n is a, c, g, or t
cttggcggggccctgcaaattaatgatctacatgnagtatattattagagggaaactaatctttctgctaagcagtgtgttgtcctacatagtgaatgttcgtgttttggaatttattaattatttaaggtaatggtgttccgtatggttttggaatgtctggtgacttgcttattttttagtgatccccattaagtcagaaaaatgtatttttaaatgtttcaaaaagagccatatgacatattttaacaaacgaaatttaaataaagcataaaataaaatgccatgttaaaa

SEQ ID NO: 540585 - DNA, 1713 bp, Homo sapiens
  misc_feature (1135)..(1136): n is a, c, g, or t
  misc_feature (1140)..(1140): n is a, c, g, or t
  misc_feature (1143)..(1143): n is a, c, g, or t
  misc_feature (1147)..(1147): n is a, c, g, or t
  misc_feature (1149)..(1149): n is a, c, g, or t
  misc_feature (1151)..(1151): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgaggggtggctattaattattcggtctgcattcccagtgggcagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540586 - DNA, 128 bp, Homo sapiens
gtcaaaggtaatatccaactaaagtcacatactagaggtaacaggtagacatgaagtaaagggggacaccactcaacccatagcagaaccacatatagcagtcacattcccgataaccacaaagaccc

SEQ ID NO: 540587 - DNA, 158 bp, Homo sapiens
ccgagatcgcgccactgcactccagcctgggccacggagcgagacttccgtctcaggaaaaaaaaaaaactgattatgagggcacttgtttgtactccttggtagcttcagttacggcaacagcccagatgcggtggctcccgcctgttgtcccagca

SEQ ID NO: 540588 - DNA, 1221 bp, Homo sapiens
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgagccttcgcctcagaggtggcatgcagatctttgtgaagaccctgacaggcaagaccatcaccctggacgtcgagcccagtgttaccaccaagaaggtcaaacaggaagacagacgtaccttcctcaccacagtatctaaaaagagccctccttgtgcttgttcttgggtgtgatgggggaggtgtcttagttttccctatcttttaagctgttaacaagtttcattgcactttgaataaagttcttgcattcc

SEQ ID NO: 540589 - DNA, 262 bp, Homo sapiens
  misc_feature (32)..(32): n is a, c, g, or t
gtgttagaggatcccattagaggcgagcgctntacgagtaggaatatgataggacggtctatttgttgttcgaatgaggcatgatcagagggacggcggggatcgtattgcgcgtagaggtgaattcttggactgggcaagacggacagagcgaaagtatttgcaagaatgtctcattaatcaagaacgaaagtcggaggttcgaagacgatcagataccgtcgtagttccgaccataaacgatgccgcctggttaaaagtg

SEQ ID NO: 540590 - DNA, 1884 bp, Homo sapiens
  misc_feature (1049)..(1052): n is a, c, g, or t
  misc_feature (1056)..(1057): n is a, c, g, or t
  misc_feature (1059)..(1059): n is a, c, g, or t
  misc_feature (1063)..(1063): n is a, c, g, or t
  misc_feature (1065)..(1065): n is a, c, g, or t
  misc_feature (1319)..(1319): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540591 - DNA, 427 bp, Homo sapiens
tgttccggcctttctttgaggaggtttaagcccacagggcccccttggtgtgttttataaggtatttttacccgggaaccgtacagttggcccggaaggcaaaaaaacgccccgttaaggggggggtggggtccccccccccctccaaaaaaagcaataataggtagggggccagcagtttcctgagcctgacgccttgacagtggaagtcccccaaaggttacagttgccaggtcaggcatgaagggggccccgtggaaaagacaggggcccctaaagaatgtttaagggtttttacccctcccccccccccggggggattaaaggggggggatcccagggggggggtttttcctccccccccaagggataaagcccttttcccggccctcaataaacccccaataaaaattttttttgtcaatca

SEQ ID NO: 540592 - DNA, 2123 bp, Homo sapiens
  misc_feature (751)..(751): n is a, c, g, or t
  misc_feature (1288)..(1291): n is a, c, g, or t
  misc_feature (1295)..(1296): n is a, c, g, or t
  misc_feature (1298)..(1298): n is a, c, g, or t
  misc_feature (1302)..(1302): n is a, c, g, or t
  misc_feature (1304)..(1304): n is a, c, g, or t
  misc_feature (1558)..(1558): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540593 - DNA, 458 bp, Homo sapiens
gactcatggacctgagcttctggatctaagcctgctgcactttgttctcttctctttcccttgccgggagagggggtgtggattgaggcggcatcacggaggccagcagggaggtccgcaggcacccccagctcttctgggcagcgcttatgctgccgacaggagtggggactacaggcatgcgtcaccacacctggctaatttttgtatttttagtagagacggggtttcacctattggccaggctggtcttgaactcctgacctcaaatgaaccaccccctcggcctcccaaagtgttgggattacaggcatgaaccactgcggccagccacctttttcttttttttatttttctttacttttttgagatggagtcttgctctgttgcccaggctggagtgcagtggtgagatctcagctcactgcaacctctgcctcctgggttcaagtgatcct

SEQ ID NO: 540594 - DNA, 2014 bp, Homo sapiens
  misc_feature (1179)..(1182): n is a, c, g, or t
  misc_feature (1186)..(1187): n is a, c, g, or t
  misc_feature (1189)..(1189): n is a, c, g, or t
  misc_feature (1193)..(1193): n is a, c, g, or t
  misc_feature (1195)..(1195): n is a, c, g, or t
  misc_feature (1449)..(1449): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540595 - DNA, 763 bp, Homo sapiens
  misc_feature (49)..(49): n is a, c, g, or t
  misc_feature (65)..(65): n is a, c, g, or t
  misc_feature (107)..(107): n is a, c, g, or t
  misc_feature (133)..(133): n is a, c, g, or t
  misc_feature (203)..(203): n is a, c, g, or t
  misc_feature (224)..(224): n is a, c, g, or t
caatttgcgggctctctttctgctgctccccggttctcggaaacagccnacaccatgggtttcgnagacctgaaaagccctgccggcctccaggtgctcaacgattncctggcgcacacaccgctacatccangcgtctgtgccctcacaagcagctgtggcagtatttgaacgccctgtccagcccaccccctgcccacttntctcatcccctacgttggtanaatcacatcaagtcttacgaaaaggaaaaggccagcctcccaggagtgaaaaaagctttgggcaaatatggtcctgccgatgtggaagacactacaggaagtggagctacagatagtaaagatgatgatcacattgacctctttggatctgatgatgaggaggaaagtgcagaagcaaagaggctaagggaagaacctcttgcacaatatgaatcaaagaaagccaaaaaacctgcacttgttgccaagtcttccatcttactagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgagagactatgtgcagtccatgacgtggctgccttcaacaatactaaatccatcctagtgcatcctgttggctagca

SEQ ID NO: 540596 - DNA, 2117 bp, Homo sapiens
  misc_feature (751)..(751): n is a, c, g, or t
  misc_feature (1282)..(1285): n is a, c, g, or t
  misc_feature (1289)..(1290): n is a, c, g, or t
  misc_feature (1292)..(1292): n is a, c, g, or t
  misc_feature (1296)..(1296): n is a, c, g, or t
  misc_feature (1298)..(1298): n is a, c, g, or t
  misc_feature (1552)..(1552): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgcgattgacggtcactggaagtacatcgcccttgacgtggagcccagtgagcacgcatctgagaactgtcaaggcaaagatccaggacaaggaaggcattcctcctgagcagcagaggttgatctgtgtgccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540597 - DNA, 2013 bp, Homo sapiens
  misc_feature (641)..(641): n is a, c, g, or t
  misc_feature (1178)..(1181): n is a, c, g, or t
  misc_feature (1185)..(1186): n is a, c, g, or t
  misc_feature (1188)..(1188): n is a, c, g, or t
  misc_feature (1192)..(1192): n is a, c, g, or t
  misc_feature (1194)..(1194): n is a, c, g, or t
  misc_feature (1448)..(1448): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540598 - DNA, 132 bp, Homo sapiens
  misc_feature (110)..(110): n is a, c, g, or t
  misc_feature (116)..(116): n is a, c, g, or t
tccttataggaaagactttactgagaccctgactcgggccaaatttgaagagctcaacatggatctgttccggtctactatgaagcccgtccagaaagtgttggaagatnctgatntgaagaagtctgacat

SEQ ID NO: 540599 - DNA, 166 bp, Homo sapiens
atacctctctcccttttgagtcccagtgtctattgtttcatctttatgaccacacgtacccattgtttagctctcacttataagtgagtacacatggtatttgatttctgttctgaatttagagacagtagattaggggaattagttttcaggagtaaatggatct

SEQ ID NO: 540600 - DNA, 1894 bp, Homo sapiens
  misc_feature (1059)..(1062): n is a, c, g, or t
  misc_feature (1066)..(1067): n is a, c, g, or t
  misc_feature (1069)..(1069): n is a, c, g, or t
  misc_feature (1073)..(1073): n is a, c, g, or t
  misc_feature (1075)..(1075): n is a, c, g, or t
  misc_feature (1329)..(1329): n is a, c, g, or t
acttgaaccgattctggatggctgtcctgatgttcctcattttcactttgggctgtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540601 - DNA, 2171 bp, Homo sapiens
  misc_feature (1336)..(1339): n is a, c, g, or t
  misc_feature (1343)..(1344): n is a, c, g, or t
  misc_feature (1346)..(1346): n is a, c, g, or t
  misc_feature (1350)..(1350): n is a, c, g, or t
  misc_feature (1352)..(1352): n is a, c, g, or t
  misc_feature (1606)..(1606): n is a, c, g, or t
tcgccctctgaccgcaggtgatcttgctgtaaacgtgacagctcccgtctgattacaacattcataatgagtccctgtcctctggtccgtcttacatgtggcatgcttatttcgtgtataccctgtactggtcacatactcactctcgtaattggtccgagatgcactccatagtcaatgtcaaggcatagatcctatgacactgaacgctactccctcctgagccagcagaggttgatctttgccggaaagcagctggaagatgggcgcaccctgtctgactacaacatccagaaagagtctaccctgcacctggtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcattcctcctggaccagcagaggttgatctttggccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540602 - DNA, 2127 bp, Homo sapiens
  misc_feature (751)..(751): n is a, c, g, or t
  misc_feature (791)..(791): n is a, c, g, or t
  misc_feature (1292)..(1295): n is a, c, g, or t
  misc_feature (1299)..(1300): n is a, c, g, or t
  misc_feature (1302)..(1302): n is a, c, g, or t
  misc_feature (1306)..(1306): n is a, c, g, or t
  misc_feature (1308)..(1308): n is a, c, g, or t
  misc_feature (1562)..(1562): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgatgcaaatcttcgtgaagaccctgactggtaanaccatcactctctgaagtggagccgagatgacacccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540603 - DNA, 175 bp, Homo sapiens
ttcacacggcacatttggacatttccagaactaccatgagatggtttagacgggaattcatgcaaaggaggggtcaaaagtggtatagtgaccccgtccacgtgctccgagctgacgaccttggaggccgcggggagctggactgaggaggaggctagcacaagcgcgagagcag

SEQ ID NO: 540604 - DNA, 531 bp, Homo sapiens
  misc_feature (28)..(28): n is a, c, g, or t
acggtcgaaccagtagcgttctgaacanaatccagtatggcacgttcatgaggtcacttactgagatcgtatcgaaacgacgtgagttccattagcgagcgtcagatatcatatttacgccccgtcctctgcaagatgtaccagaaacttgacaattccgaaatggccgagggatggccaagcaaaaagctggcaacttcatatgtacctgcagaaacccaaaattggccgttattgtcatcacgaatcagaggtatcaactggacgtgacgcccaaaaggcttcgaacaggtgtcgccacgcttctttcggccttcgtcaaaactcttcacatggaaacctttgtgacagctcaacgacggcttcgattaccatgctgaggattgtacgagccatatattgcatgggggtaccccaatctgaaagtcacgttcacatgaactaatctaccaagcggttggttatggcacaaatcacattaagaaggcgaatttgcttttgacagaataacgcctttgattcgctcgaatc

SEQ ID NO: 540605 - DNA, 250 bp, Homo sapiens
aaactgatgattctactgctgtagatgaatggttaaaacgagctagttaaacagagccatgtttgccagggagcctccaaccctaagccactggacggggccagagatgccagcagcctctgtcgcccttagtcatataaccaaaatccaaccttatcacaaccggggctggaaaggaaggtatttggaatacacctccggttatgttgctccagtaaaatcttgccaaaagaagcagtcttcttagagg

SEQ ID NO: 540606 - DNA, 872 bp, Homo sapiens
  misc_feature (477)..(477): n is a, c, g, or t
  misc_feature (626)..(626): n is a, c, g, or t
ggcgcgcctttctccgctgcaacgggccgtccccgtcctcctccccagccatggcgtcacgttcgcgggcttcttgctacatgctggcggctgtgtcaatgccgcgttcatcttcttccgccattgtggcacattatagcattggatgagctgaagactgattacaagaatcctatagaccagtgtaataccctgaatccccttgtactcccagagtacctcatccacgcttcttctgtgtcatgtttcttgtgtgcagcagagtggcttaccactgggtctcaatatgcccctctttgcatatcatattgggaggttttatgagtagaccagtgatgagtggcccaggactctatgaccctaaaacatcatgaattgcagatattctagcatatggtcagaaggaaggatggtggcaaataagcttttaatcttctagacatttttttactacctattatggcatgatctatgttnggggagctcttaagaacaaacacagaagaatttgtccaagttaagtgcatgaaaagccaccaaatgaaggggatccttctccagcaagatcctgtccagggagtagcctgtgaatctgatcagttactttaaaaaaatgactccttatntttaagtgttccacattttgtgctgtggaacgacgtgtttcatattgttatctcagattaagatttaaatgggattaccgtcataaattaacttcacggggtacccccggtgttgacgggttggacttggcctttctaaggaaggccagaatccttgaggagggtaaaacggcgcggcagaacatggagcgttggtataggaacagtgtggggcccttggggcagacagcgggcaataaaagggga

SEQ ID NO: 540607 - DNA, 766 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (11)..(11): n is a, c, g, or t
  misc_feature (13)..(13): n is a, c, g, or t
  misc_feature (15)..(16): n is a, c, g, or t
  misc_feature (22)..(23): n is a, c, g, or t
  misc_feature (35)..(35): n is a, c, g, or t
  misc_feature (40)..(40): n is a, c, g, or t
  misc_feature (50)..(50): n is a, c, g, or t
  misc_feature (52)..(52): n is a, c, g, or t
  misc_feature (57)..(57): n is a, c, g, or t
  misc_feature (61)..(65): n is a, c, g, or t
  misc_feature (81)..(81): n is a, c, g, or t
  misc_feature (85)..(85): n is a, c, g, or t
  misc_feature (88)..(89): n is a, c, g, or t
  misc_feature (98)..(98): n is a, c, g, or t
  misc_feature (107)..(107): n is a, c, g, or t
  misc_feature (116)..(116): n is a, c, g, or t
  misc_feature (119)..(119): n is a, c, g, or t
  misc_feature (126)..(126): n is a, c, g, or t
  misc_feature (135)..(135): n is a, c, g, or t
  misc_feature (139)..(139): n is a, c, g, or t
  misc_feature (141)..(141): n is a, c, g, or t
  misc_feature (155)..(155): n is a, c, g, or t
  misc_feature (174)..(174): n is a, c, g, or t
  misc_feature (184)..(184): n is a, c, g, or t
  misc_feature (205)..(205): n is a, c, g, or t
  misc_feature (207)..(207): n is a, c, g, or t
  misc_feature (211)..(211): n is a, c, g, or t
  misc_feature (220)..(220): n is a, c, g, or t
  misc_feature (222)..(222): n is a, c, g, or t
  misc_feature (224)..(224): n is a, c, g, or t
  misc_feature (226)..(226): n is a, c, g, or t
  misc_feature (229)..(229): n is a, c, g, or t
  misc_feature (232)..(232): n is a, c, g, or t
  misc_feature (238)..(238): n is a, c, g, or t
  misc_feature (244)..(244): n is a, c, g, or t
  misc_feature (263)..(263): n is a, c, g, or t
  misc_feature (272)..(273): n is a, c, g, or t
  misc_feature (277)..(277): n is a, c, g, or t
  misc_feature (286)..(286): n is a, c, g, or t
  misc_feature (312)..(312): n is a, c, g, or t
  misc_feature (328)..(328): n is a, c, g, or t
  misc_feature (335)..(336): n is a, c, g, or t
  misc_feature (348)..(348): n is a, c, g, or t
  misc_feature (350)..(350): n is a, c, g, or t
  misc_feature (381)..(381): n is a, c, g, or t
  misc_feature (390)..(390): n is a, c, g, or t
  misc_feature (401)..(401): n is a, c, g, or t
  misc_feature (405)..(405): n is a, c, g, or t
  misc_feature (409)..(409): n is a, c, g, or t
  misc_feature (411)..(411): n is a, c, g, or t
  misc_feature (418)..(419): n is a, c, g, or t
  misc_feature (426)..(426): n is a, c, g, or t
  misc_feature (449)..(450): n is a, c, g, or t
  misc_feature (501)..(501): n is a, c, g, or t
  misc_feature (512)..(512): n is a, c, g, or t
  misc_feature (514)..(514): n is a, c, g, or t
  misc_feature (549)..(549): n is a, c, g, or t
  misc_feature (569)..(569): n is a, c, g, or t
  misc_feature (637)..(637): n is a, c, g, or t
  misc_feature (641)..(641): n is a, c, g, or t
  misc_feature (671)..(671): n is a, c, g, or t
  misc_feature (682)..(682): n is a, c, g, or t
  misc_feature (706)..(706): n is a, c, g, or t
  misc_feature (731)..(731): n is a, c, g, or t
nagngnatccncngnnatgagnntcttctcaaggnctatntgtgaaagcngncccangggnnnnngggcagcaaggatgcncaanagnntctggggcngatgggganagcagcggnggnctggganggggggatnggcnanagggaggggatgcntaagggggggggggggagngggggcggtngggggggggggggggggtggngngggncagcaaagngngnanaanagngggggngatggntaggcggggagggaggaangggggcagnnaggngggggacgngggacgggggggggggggggtgggtnagggggggcccggggnggggctnngggggcaggggntnagggggggggggcggttgatggggggggganggggggaanggggggggccngggncaangngcctggnncggggcnggggtcagggaaggggggcgcgnncggggtccaggccaggggtgggggggggagggaagggtggggcgagggggncaggtcggggntnctggggcgtggggggaggggggggggtttcgaagnggggggtgggaagagggggnggggggggggcggtgtcggaggtggtttggggggggcactacgccatcgggaaaggagtcacatgtgntgcntgcaggagccttcattctatcacaaacgcngcacactgcangcctgcggcatgtggttgtgggantctcgagtccgggccgctgtctatnaacaacgctcaacgtgtgtcctgatgtatgtgctt

SEQ ID NO: 540608 - DNA, 105 bp, Homo sapiens
  misc_feature (78)..(78): n is a, c, g, or t
  misc_feature (80)..(80): n is a, c, g, or t
  misc_feature (83)..(83): n is a, c, g, or t
  misc_feature (86)..(86): n is a, c, g, or t
gccaaacatacctgggaataccttttatttttttttaccttggggtgatggttccaaaccataaatgtggttatagtnancanatnacccttctgtcgtcttctc

SEQ ID NO: 540609 - DNA, 141 bp, Homo sapiens
gccttctcgtaatcataaagtcaccagctgcatgcagaccctcccaggagagtcacgcctgccctttgaagctttgaagctccgcaattatttctcccctctagctttgaagatccttcatcgctcaccgcattttcaatc

SEQ ID NO: 540610 - DNA, 808 bp, Homo sapiens
  misc_feature (2)..(2): n is a, c, g, or t
  misc_feature (4)..(4): n is a, c, g, or t
  misc_feature (40)..(40): n is a, c, g, or t
  misc_feature (77)..(77): n is a, c, g, or t
  misc_feature (132)..(132): n is a, c, g, or t
  misc_feature (177)..(177): n is a, c, g, or t
  misc_feature (183)..(183): n is a, c, g, or t
  misc_feature (230)..(230): n is a, c, g, or t
  misc_feature (294)..(294): n is a, c, g, or t
  misc_feature (303)..(304): n is a, c, g, or t
  misc_feature (306)..(306): n is a, c, g, or t
  misc_feature (400)..(400): n is a, c, g, or t
  misc_feature (414)..(414): n is a, c, g, or t
  misc_feature (466)..(467): n is a, c, g, or t
  misc_feature (528)..(528): n is a, c, g, or t
  misc_feature (560)..(560): n is a, c, g, or t
  misc_feature (568)..(568): n is a, c, g, or t
  misc_feature (596)..(596): n is a, c, g, or t
  misc_feature (614)..(614): n is a, c, g, or t
  misc_feature (632)..(632): n is a, c, g, or t
  misc_feature (668)..(668): n is a, c, g, or t
  misc_feature (678)..(678): n is a, c, g, or t
  misc_feature (701)..(701): n is a, c, g, or t
  misc_feature (743)..(743): n is a, c, g, or t
  misc_feature (745)..(745): n is a, c, g, or t
  misc_feature (791)..(791): n is a, c, g, or t
gngncctggcgccgcccgccgggtctgggtctgccgcccnggctggcgtcccctggtgtgctcttggctctttgccncctctgcctcctgggctcccgccttcctcccccctgcccctcccccgtcgcgggnctgccgggtgccggccctgccgcctcctgggcccgttccccgccnggcgantctgtggctcccgtgtgagtgggggtcctgctcctttgtgtgctccnccctggccccgttctttgcgcctgtccctccgcccctgccgccgcccctgcctggctctggggnggcggcggnngnggccgcggcggctgcccccacttgcggccgccttctcctgcttgtggccggcacatgtggcttttgttctctggcccgatgctgctgccctccnccgcccagtctccntcccctgccccccccccccgctgcccccgtgggggctgtccggcctttgccnngcccggctgcccttggcccctgcctacctggccttcccgcgccggcccgtcctaccctgcnctccctgcccccttcctgtgtctgtgggcgcnctgtgcgncttccttcgcccctcctgcgtggttttntcggcctgtggccgcccnccgtctgtgctgtgcctncgccgccgttggcccgggccccccggtggtgctgtntggctggccnggctgttcctgccccttcccggnccgccgttcccttcgcgcgcccctccgccgccctaccccggngnccgtggtcgcctgccccccctgttgggggcctgtttgccccccctnccccgttcttcgttccc

SEQ ID NO: 540611 - DNA, 730 bp, Homo sapiens
ggcagtcagactggtccgggagcgttatccctaagactgcctgtgctctggggggatcccggcccagtggtctgggctggtagagggcaccgcctcatgtgcgtcatactgcttcgtgaaggcgctggtgcgcgtgttcaagatctacctgaccgacagatacacctacccataccgcggctggtctaggtaggccgctatcctggtggcgatgatacggtgcgcgcgcgatgggtgggcggcaggcacgttcgaggcctagcaccggggctgccctgtaccttggcggcgagcgagaaccctgtccgcgtcgggtgcggcgggttgggttggtgcttttgggcccattggcgggcggggaaagccggtaggaaaacggaccttgttggggcggagggtggcactgcctggccctgggtggggggcacggggcgccgttccgccaccgggttgtgggggggggcctggcccttggccaatggccccccaattgagggcctggggcaaggatagggggggcaaataccgttttttggggccaaggggtcagattgggcgttcccccggtcggggaaagtcgtaggcactctggggggccacgctcgtctaaggctacctggcaggcttgggcacgcaggctcgggctaggagtcctgctgggctacgtagtactccccgggtaatcacgatgtgccgcatagagtagagcgccggcggccgactagacttg

SEQ ID NO: 540612 - DNA, 371 bp, Homo sapiens
aacaagttgctaggtatgtaacttcctagaaactccaaaggcaggaaaggtagccatggtcctcaaaccaaagagccctctctgttggtcctctgatctttgagtgttagctcaagctctccagttgtgtacacagataaaggcctggtagtaagtggtttgctttgtgaggtatgaggatccctggtaaattcagcagcatgttgtttttggaaatctgtccacaagattagaacactgcaaccaaactcattactaatactgcttatttaactattgtccaaaagagaaagggaagaagaaaaatatccccactctactgcgaggttctaggctttcctataagttatccaaatagtctttttttaatc

SEQ ID NO: 540613 - DNA, 273 bp, Homo sapiens
  misc_feature (4)..(4): n is a, c, g, or t
  misc_feature (24)..(24): n is a, c, g, or t
  misc_feature (65)..(65): n is a, c, g, or t
  misc_feature (164)..(164): n is a, c, g, or t
  misc_feature (211)..(211): n is a, c, g, or t
  misc_feature (261)..(261): n is a, c, g, or t
  misc_feature (264)..(264): n is a, c, g, or t
gaanattcccaaatgaagaaaaanagtggctccctagactcattgcccagaggaggcctatgaanatcttagcaagtctcccccgaggttttcctagaatagatgtctctacgtagttaataaaaacatacattcaagttttgcagctttttgctccactttanactttaagttgaacgtttacacttcccattccaagatctttctaaanatgtttctgaagagaagaatatcccaacatcagcctgggtgacaaaagcnacntccgtctca

SEQ ID NO: 540614 - DNA, 879 bp, Homo sapiens
  misc_feature (526)..(526): n is a, c, g, or t
  misc_feature (879)..(879): n is a, c, g, or t
tttttggttctggttgaattttgggtcaagaaatgttctccaatccatgaagcaacgcctgaaaaggacagggttctataacaaaataatggcaaatgttccgtctccatcctttctttctttttcgtgggtagtggtggtgctagtggggtgtggtggtggcttgttttttttgttgtgttctgccctccctttctctctccgtgtgtagcccctcgacagaccagcggggcgaggaggaacgccatactcagcttttcgcagagagtcttgtatacaccgtggtgcggagcacaagacgcacacagtacacacacgcgaggcgaaagagtgatgacaacagaggtgctctatgcgcggaagagaacgcacgagactagcgtgtactcacatgggatcacacgtcgtgtgtgccctctgttgcgaaaggagcacagcgtgatggaatgcgcatagagtgtgatagaagcagctccaggtccacacgtcggtgcatggtggacgccaaacgataaggtgcaccccnacggtggttgtgatacaattacgagcagcgaaaacacaagtacctcacaggggtgaaatgtaggaggcaccctgttgcagcgaagcccaagaaaagggggagcaggagagaggcgtagatggatcaccaagtagtaagaaaacaggggccctagtggaagacccacaaagaaaacaggcgtaattcgaaccaagaaaagagatcaccccccccccggttgagagacataaagagtagcacatccgacaggcagagaacggttgagcacaacaaggataccaccccaacaaatgggcgcataaaacccagagcggaggcattgtgcggcacacggtgtggaataaacaccaccn

SEQ ID NO: 540615 - DNA, 106 bp, Homo sapiens
atgaggagtccccctggccaaaagtctgtaaggttaccccaatggacagggaccaatggaaactgaagggggcttgaagacatttttacaaaccaggcaggggcca

SEQ ID NO: 540616 - DNA, 732 bp, Homo sapiens
  misc_feature (68)..(68): n is a, c, g, or t
  misc_feature (169)..(169): n is a, c, g, or t
  misc_feature (174)..(176): n is a, c, g, or t
  misc_feature (178)..(178): n is a, c, g, or t
  misc_feature (180)..(181): n is a, c, g, or t
  misc_feature (205)..(205): n is a, c, g, or t
  misc_feature (225)..(225): n is a, c, g, or t
  misc_feature (233)..(233): n is a, c, g, or t
  misc_feature (237)..(238): n is a, c, g, or t
  misc_feature (255)..(255): n is a, c, g, or t
  misc_feature (271)..(271): n is a, c, g, or t
  misc_feature (285)..(286): n is a, c, g, or t
  misc_feature (292)..(292): n is a, c, g, or t
  misc_feature (295)..(295): n is a, c, g, or t
  misc_feature (302)..(302): n is a, c, g, or t
  misc_feature (305)..(305): n is a, c, g, or t
  misc_feature (312)..(312): n is a, c, g, or t
  misc_feature (319)..(319): n is a, c, g, or t
  misc_feature (345)..(345): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (373)..(373): n is a, c, g, or t
  misc_feature (376)..(376): n is a, c, g, or t
  misc_feature (381)..(383): n is a, c, g, or t
  misc_feature (391)..(391): n is a, c, g, or t
  misc_feature (395)..(395): n is a, c, g, or t
  misc_feature (399)..(399): n is a, c, g, or t
  misc_feature (403)..(404): n is a, c, g, or t
  misc_feature (406)..(406): n is a, c, g, or t
  misc_feature (426)..(426): n is a, c, g, or t
  misc_feature (439)..(440): n is a, c, g, or t
  misc_feature (444)..(444): n is a, c, g, or t
  misc_feature (464)..(464): n is a, c, g, or t
  misc_feature (489)..(489): n is a, c, g, or t
  misc_feature (493)..(493): n is a, c, g, or t
  misc_feature (523)..(523): n is a, c, g, or t
tggttccgtaggttcctcgtgagggggggggccttcgtaccggactggctgaggggcaaggcggaagnaatcaagagactatccagcggctccttgaggagaatgaccagctgatccgctgtattgtggagtatcagaacaagggccgcgggaacgagtgcgtgcagtnccagnnngngnnacatagaaatctcatttatttggntaccattgcagatgccagtncaaccagnactnnaaaagcaatggaataanctttcaaaagcaatanaataatcttccatnnggctgncgngaggagnaantgaatgnaatccanctcttacaaatggagacagggtcttnaccanctnaactggntaaaacatgaatnaancctcnnnggctcttnaaancgtnaaanngngaagaaagctactacttagntgtattctcatgnnaatnttttttaaataattaagcanatcccttaataagttgagcccaggntgtnctcttttcttgacttggagccatgttgganttacaagacatcacttggattgtcaagtctaacttttaggttcaaacctgagaggaaactcagtagtggttggccggaattgggaggattcttgccttgtaaccttctaaatggccatgtaactgtgggcgtcttcctattaagtttgaaatggtgtcccccttgattgccgttttaggatgctttgaaataaagcttattttctttaa

SEQ ID NO: 540617 - DNA, 586 bp, Homo sapiens
  misc_feature (68)..(68): n is a, c, g, or t
  misc_feature (169)..(169): n is a, c, g, or t
  misc_feature (174)..(176): n is a, c, g, or t
  misc_feature (178)..(178): n is a, c, g, or t
  misc_feature (180)..(181): n is a, c, g, or t
  misc_feature (205)..(205): n is a, c, g, or t
  misc_feature (225)..(225): n is a, c, g, or t
  misc_feature (233)..(233): n is a, c, g, or t
  misc_feature (237)..(238): n is a, c, g, or t
  misc_feature (255)..(255): n is a, c, g, or t
  misc_feature (271)..(271): n is a, c, g, or t
  misc_feature (285)..(286): n is a, c, g, or t
  misc_feature (292)..(292): n is a, c, g, or t
  misc_feature (295)..(295): n is a, c, g, or t
  misc_feature (302)..(302): n is a, c, g, or t
  misc_feature (305)..(305): n is a, c, g, or t
  misc_feature (312)..(312): n is a, c, g, or t
  misc_feature (319)..(319): n is a, c, g, or t
  misc_feature (345)..(345): n is a, c, g, or t
  misc_feature (350)..(350): n is a, c, g, or t
  misc_feature (353)..(353): n is a, c, g, or t
  misc_feature (360)..(360): n is a, c, g, or t
  misc_feature (373)..(373): n is a, c, g, or t
  misc_feature (376)..(376): n is a, c, g, or t
  misc_feature (381)..(383): n is a, c, g, or t
  misc_feature (391)..(391): n is a, c, g, or t
  misc_feature (395)..(395): n is a, c, g, or t
  misc_feature (399)..(399): n is a, c, g, or t
  misc_feature (403)..(404): n is a, c, g, or t
  misc_feature (406)..(406): n is a, c, g, or t
  misc_feature (426)..(426): n is a, c, g, or t
  misc_feature (439)..(440): n is a, c, g, or t
  misc_feature (444)..(444): n is a, c, g, or t
tggttccgtaggttcctcgtgagggggggggccttcgtaccggactggctgaggggcaaggcggaagnaatcaagagactatccagcggctccttgaggagaatgaccagctgatccgctgtattgtggagtatcagaacaagggccgcgggaacgagtgcgtgcagtnccagnnngngnnacatagaaatctcatttatttggntaccattgcagatgccagtncaaccagnactnnaaaagcaatggaataanctttcaaaagcaatanaataatcttccatnnggctgncgngaggagnaantgaatgnaatccanctcttacaaatggagacagggtcttnaccanctnaactggntaaaacatgaatnaancctcnnnggctcttnaaancgtnaaanngngaagaaagctactacttagntgtattctcatgnnaatnttttttcgaacctgtttagctatcatatccttcttggttgtccaaggcaacgtttaggtacaacggtagcggaacccagccagtgttcgccctattatgttgtattctagcctcgaccttgtctatgcaattaaacctatat

SEQ ID NO: 540618 - DNA, 306 bp, Homo sapiens
tccaaagtggactctctgtcgtctcaagagcttgcaggaaaggagatcgccctgccaatgagaaggttgcgcctcatttaatgaagctataaccctatgtagaaagtctctttcgggggcagaggctaactctgggtgccaagccatatatataagggaatagtagattgttaacttcgtgttttccctcccagtgcatgatcctaaacaacactggctgttgcatcctcattctctgagggagccatcaatgagatttccctaattccatctgagctagcaacactggagcaagacgaataagga

SEQ ID NO: 540619 - DNA, 201 bp, Homo sapiens
tccataatgtgtgccaggcgacagaggaagaccccgtctcaaaaaaaaaaaaaaaaaaaaaaaggcccaaattggcccaataatttaaagtccataagttacaagggggaaacacattagtcgggggtgtaagggggttttccttttttaaaaaagggattttaaccctcttccctcttcccatacacaaaaattaattcc

SEQ ID NO: 540620 - DNA, 417 bp, Homo sapiens
  misc_feature (65)..(65): n is a, c, g, or t
  misc_feature (104)..(104): n is a, c, g, or t
  misc_feature (275)..(275): n is a, c, g, or t
  misc_feature (329)..(329): n is a, c, g, or t
ctggtcaaaacaaaaagtaaacataaaccaaaaatgttagaacttgtttatcccaagtgtggctncttgcagcagcagtactgaacatcatggaggttgggggnaggtgttagaaatacagaccctcggccgggcacggtggctcactcctgtaatcccagcacttttggaggccgaggtaggtggatcacgaggtccggagttcgagaccagcctggccaagatggtgaaatcccatctctactaaaaatacaaaaattagctaggcgtggtgncgcttgcctgtagtcccagctacctgcgaggatgaggcaggagaatcgcttgancctgggagtcagaggttgcagtgagccaagattctgccattgcactgcagcctgggcaacaagagtgaaactctgcgtaaaaaaaaaa

SEQ ID NO: 540621 - DNA, 355 bp, Homo sapiens
  misc_feature (247)..(247): n is a, c, g, or t
  misc_feature (254)..(254): n is a, c, g, or t
aggggtgagccaccatgcttgacagaaattcttctcctttattgcctgtagaggctaaagattgatagtccagagatgcttgaactccttgccaggtaattttatgtagcttattccccattccatttctttgctcatgacacaggccattcagaaagtcctatgaagagtaaatagatggcccgatttccagttttgctgtttctatatccaattcttaaaaggtataagaagcatggactttcanaatccanaattatagagatagccctcatctttactccatatagcctgatcacagtgtccacagtgatcgtgctcgggttatataatccctcgtgccgtattcctacag

SEQ ID NO: 540622 - DNA, 1931 bp, Homo sapiens
  misc_feature (1096)..(1099): n is a, c, g, or t
  misc_feature (1103)..(1104): n is a, c, g, or t
  misc_feature (1106)..(1106): n is a, c, g, or t
  misc_feature (1110)..(1110): n is a, c, g, or t
  misc_feature (1112)..(1112): n is a, c, g, or t
  misc_feature (1366)..(1366): n is a, c, g, or t
tcgccctctgaccgcaggtgatcttgctgtaaacgtgacagctcccgtctgattacaacattcataatgagtccctgtcctctggtccgtcttacatgtggcatgcttatttcgtgtataccctgtactggtcacatactcactctcgtaattggtccgagatgcactccatagtcaatgtcaaggcatagatcctatgacactgaacgctactccctcctgagccagcagaggttgatctttgccggaaagcagctggaagatgggcgcaccctgtctgactacaacatccagaaagagtctaccctgcacctggtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgcagatcttcgtgaagaccctgactggtaagaccatcaccctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540623 - DNA, 134 bp, Homo sapiens
cgctctcttctacagcctcctcgattgaggacacattcgttgggtatctgaccggcatcgtttggggtgccggctaccgcatgaccctgttacgacgatgtgcggccatgcgcggttacaacaccggcgatgat

SEQ ID NO: 540624 - DNA, 1892 bp, Homo sapiens
  misc_feature (751)..(751): n is a, c, g, or t
  misc_feature (1057)..(1060): n is a, c, g, or t
  misc_feature (1064)..(1065): n is a, c, g, or t
  misc_feature (1067)..(1067): n is a, c, g, or t
  misc_feature (1071)..(1071): n is a, c, g, or t
  misc_feature (1073)..(1073): n is a, c, g, or t
  misc_feature (1327)..(1327): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggagcccaagtgagcacgcatcgacgaatgtcaaggcaaagatcccagactaaggaaggccatctcctcctgatccacgcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540625 - DNA, 276 bp, Homo sapiens
ttgcaggaagagagaactgtcaggtgttataacctgtgaacttttcccaggaaggtcaaagcaggacaagaccatctctctgcaggtgagggcatgacacaacaaaagacatttgactgggcttcttgccaggatcaacattaagcccagggctctgtgaatcacatactacactggctctcctgcccagccgtcagtcccacgggagggctaagattgggagttgcagagaaaaccaatttattctaaacattaagctgatgggagaaacaaatt

SEQ ID NO: 540626 - DNA, 671 bp, Homo sapiens
  misc_feature (176)..(176): n is a, c, g, or t
gtggaccgctgcggcttggagtgtgtgatggatcctgaacccagtgtgtggggggtggaggcggctcctgcgatcgaagggtgacttgagactcagcctggcctgcactgccagtgatggtgccctgtgggggtgcttgggcgctcctgccttgcctgtccattgcgttgaccatntccgtgcgtctgtgtcaggacgggtgacctgacttgaacggtttgattgttgtgagttgtgttaacataggtccaggcaacaagcatggggcattcccttgggtgatcctacacaactggtcagggcaatgtcaacattgggcaatttccaagaatgtggccagctggcggcaatttggaaatttggcaccaccgtttcaacggttacaccccagcggcaaggccaatgccactggtggcacaatgcccaagattggcgctttacatttttccgccgacgccttcttagtggcaacctttagggagggacattttttcaccagcgagttttggccagttttccaagccgaatgaaggaactttcaacacagtggacactggacaaaaccgttctttcacaagcaaacggcgcaactcggccagcacggggttttcaccggtggacaaccacgacacaatggggttattattagggcgcccctttgtttcccccga

SEQ ID NO: 540627 - DNA, 369 bp, Homo sapiens
  misc_feature (8)..(8): n is a, c, g, or t
  misc_feature (141)..(141): n is a, c, g, or t
agtaatcnttccacctttagcttccctgaggagcttgagaccacacctgattaatggctttctttttaaatttttagtagagatgggaactctatgttgctcaaactggtcaccaaactcctggctttgagtgttcctccntcttcggcctcagattgctgggattactggcatgagccaccgaacccaactacctcactgttttaaaaagcaattttttttttttttttttttttgagacagagtcttgctctgtcacccaggctggagtgcagtgttgcaatctgagcccactgcaccctccacctcccaggagaattgcttgaactggggagctggaggttgcagtgagccatcgtgccacttcac

SEQ ID NO: 540628 - DNA, 1912 bp, Homo sapiens
  misc_feature (751)..(751): n is a, c, g, or t
  misc_feature (791)..(791): n is a, c, g, or t
  misc_feature (1334)..(1335): n is a, c, g, or t
  misc_feature (1339)..(1339): n is a, c, g, or t
  misc_feature (1342)..(1342): n is a, c, g, or t
  misc_feature (1346)..(1346): n is a, c, g, or t
  misc_feature (1348)..(1348): n is a, c, g, or t
  misc_feature (1350)..(1350): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgatgcaaatcttcgtgaagaccctgactggtaanaccatcactctctgaagtggagccgagatgacacccattgagaatgtcaaggcaaagatccaagacaaggaaggcatccctcctgaccagcagaggttgatctttgcttcgggcaccttgcacctgtggctccgtgtcacaagtgggatgcagatcttcgtgaagaccctgactggtaagaccatcactctggaggtggagcccagtgacaccatctgaaaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540629 - DNA, 1872 bp, Homo sapiens
  misc_feature (751)..(751): n is a, c, g, or t
  misc_feature (1037)..(1040): n is a, c, g, or t
  misc_feature (1044)..(1045): n is a, c, g, or t
  misc_feature (1047)..(1047): n is a, c, g, or t
  misc_feature (1051)..(1051): n is a, c, g, or t
  misc_feature (1053)..(1053): n is a, c, g, or t
  misc_feature (1307)..(1307): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctaactgttaagaccatcaccctcgaggtggaagcccagtgacaccattgagaatgtcaaggcaaagatccaagacaaggaaggcatgcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540630 - DNA, 566 bp, Homo sapiens
tctttctatatctgaatctatgaccgtatctatttgacacctgtttccgtattcatctctatgcctctgtctctctatatctatgtatctatgcccatatctgtgtctgtacctaggtccatttccattcctgtttcatatctgtatctagatttcctttcccattgcctccctcccttttaatcctggctccatttcaggtgaaaaaccagtatctggctcatagttgaccatatttgtgggaagaataaattcatcattaagtacattcattgatcttctcaattaattcttagtatttctcatgagaaaacaggagacatgaggtttgtaaatctgatttatcactttttattttcttttttttcttccttttttcttttgagatggaatctcgctctgttgcccagggtggagtgcagtggcgtgatctcagctcactgtaaactctgcctcccgggctctagcgattctcctgccgcagcctcccaagtagctgggattacagatgacctgctcgcacgcctggttaattttgtatctttcgtagcgacggtaacggagat

SEQ ID NO: 540631 - DNA, 1003 bp, Homo sapiens
  misc_feature (751)..(751): n is a, c, g, or t
  misc_feature (791)..(791): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgatgcaaatcttcgtgaagaccctgactggtaanaccatcactctctgaagtggagccgagatgacacccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggttaggatgcttcggtaccgagctcgagtctatca

SEQ ID NO: 540632 - DNA, 496 bp, Homo sapiens
tctttctatatctgaatctatgaccgtatctatttgacacctgtttccgtattcatctctatgcctctgtctctctatatctatgtatctatgcccatatctgtgtctgtacctaggtccatttccattcctgtttcatatctgtatctagatttcctttcccattgcctccctcccttttaatcctggctccatttcaggtgaaaaaccagtatctggctcatagttgaccatatttgtgggaagaataaattcatcattaagtacattcattgatcttctcaattaattcttagtatttctcatgagaaaacaggagacatgaggtttggagaaggagaatttaatgggaagcagaggctgtaagtagggtgatttgttgtcctaggggtgactttagggtttaacgcatcagccctgagccaacactgtaagcaccatgaattacagttttttttgtgtttgtttctttgagacggagtcttattctgttgcc

SEQ ID NO: 540633 - DNA, 2200 bp, Homo sapiens
  misc_feature (828)..(828): n is a, c, g, or t
  misc_feature (1365)..(1368): n is a, c, g, or t
  misc_feature (1372)..(1373): n is a, c, g, or t
  misc_feature (1375)..(1375): n is a, c, g, or t
  misc_feature (1379)..(1379): n is a, c, g, or t
  misc_feature (1381)..(1381): n is a, c, g, or t
  misc_feature (1635)..(1635): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggcaccctgcacctgatgctccatcgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540634 - DNA, 128 bp, Homo sapiens
gaggtagatacactaactactctaatgaattatagtcaatccccacgtacaactcactaaataccatcctacccttgacagtgaaagggaaatagatatttactatctccatctcttaccagatagct

SEQ ID NO: 540635 - DNA, 1716 bp, Homo sapiens
  misc_feature (344)..(344): n is a, c, g, or t
  misc_feature (881)..(884): n is a, c, g, or t
  misc_feature (888)..(889): n is a, c, g, or t
  misc_feature (891)..(891): n is a, c, g, or t
  misc_feature (895)..(895): n is a, c, g, or t
  misc_feature (897)..(897): n is a, c, g, or t
  misc_feature (1151)..(1151): n is a, c, g, or t
atatgatttaacatagaaaacagcttataagtttggctgcaccgattgcgcgactacaacatccagaacgtctctgacttgcacatcgctgctcgcgtctcagaggtgggatgcagatcttcgtgaagaccctgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540636 - DNA, 545 bp, Homo sapiens
  misc_feature (253)..(253): n is a, c, g, or t
tggaagatacagatagggcagagatccctgactccaaattcataattgagtaattttcctgtgattttgttggattaaagcagaaagccctgtggatttctttaatccctgcctcttgctttgtctcatgcctcagttccctgcaacccaatccatttttcttcattaggattatgaacacactgctgcctctcttaaaaaacaacaacaaaacaaaaacctgttactactgttgttactagggactgttgcnggaggtattggtaggggaaggctgctcttcttgcttgtctgctatttagtacagtccctcagtcctacctccatttagaaagtgtgaaaatatctattagggaggacttagtgaaccacattactatagaattcaaggctataggccctgattaaaagtgaacatttaggtcgagcatggtgctcacacctgtaatcccagcacctcggaaggccaaagtaggagaattgcttgtgtccaggagttcaagaccagcctgggcaacacagtgaaaccccatccctacaaaaaa

SEQ ID NO: 540637 - DNA, 606 bp, Homo sapiens
gggtgttgtatgtactggacacactgtggcaccttcactgtgcgcccacgtattgggatggcctcaggcgacatagggtatgtcttcgagtccggccgacaatagacttgccgggcctcttacaatctctctctctggggtcaactttactttgtgtaaggcacagactcctgcttatctcatagtgcctctcagttgaagaagtttccgtagcacgtgtttttggctctgaactcaacgtatgctgagaataagtgtcctagacagactgcacctgctgaactgcgctaatacggatatatcaagtcctcgtggaagactctctcattgcgcttaacgcaccgtacagtcttcctacttaagataagacactcgttccatagacactggcacttctgtgagttctcgcgggaactgcctggacacctgagctcctaggctaagtaccctgttgtacactatacgggcgcttatatagaacctgcctaatacagggcagatgcagattcctatacacgcacacactatcacacactcgcgcatagcctattggttggcgtcagagccctattgtataccgtcccaggctctgggccccttaccgcg

SEQ ID NO: 540638 - DNA, 2014 bp, Homo sapiens
  misc_feature (413)..(413): n is a, c, g, or t
  misc_feature (429)..(429): n is a, c, g, or t
  misc_feature (446)..(447): n is a, c, g, or t
  misc_feature (642)..(642): n is a, c, g, or t
  misc_feature (1179)..(1182): n is a, c, g, or t
  misc_feature (1186)..(1187): n is a, c, g, or t
  misc_feature (1189)..(1189): n is a, c, g, or t
  misc_feature (1193)..(1193): n is a, c, g, or t
  misc_feature (1195)..(1195): n is a, c, g, or t
  misc_feature (1449)..(1449): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgctnatcttcgtgaagaccntgactggtaagaccatnncctctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540639 - DNA, 1997 bp, Homo sapiens
  misc_feature (411)..(411): n is a, c, g, or t
  misc_feature (625)..(625): n is a, c, g, or t
  misc_feature (1162)..(1165): n is a, c, g, or t
  misc_feature (1169)..(1170): n is a, c, g, or t
  misc_feature (1172)..(1172): n is a, c, g, or t
  misc_feature (1176)..(1176): n is a, c, g, or t
  misc_feature (1178)..(1178): n is a, c, g, or t
  misc_feature (1432)..(1432): n is a, c, g, or t
agcctgctactccagagtattgaagcataaggtagtgcactgcttttgaacatagaggttgatcttagtgaggagcatgctgtgatatatggatgcgtcctgtgtgactacaatatccagaaagagtgagcctgaatctggtagttctggcttagagttgggcatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctctcttcagaggtgggatgcaaatcttcgtgaagacnctcgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540640 - DNA, 86 bp, Homo sapiens
gaacaggatgttgaaaagaaaaaataaagccctcctgccgactgattccaagtccccaggagggcttggaatcagtcggcagtcat

SEQ ID NO: 540641 - DNA, 1939 bp, Homo sapiens
  misc_feature (24)..(24): n is a, c, g, or t
  misc_feature (265)..(265): n is a, c, g, or t
  misc_feature (567)..(567): n is a, c, g, or t
  misc_feature (1104)..(1107): n is a, c, g, or t
  misc_feature (1111)..(1112): n is a, c, g, or t
  misc_feature (1114)..(1114): n is a, c, g, or t
  misc_feature (1118)..(1118): n is a, c, g, or t
  misc_feature (1120)..(1120): n is a, c, g, or t
  misc_feature (1374)..(1374): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcaccttctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540642 - DNA, 307 bp, Homo sapiens
cccgcttagaagatcatagcagatgtacagcaacaactgatcctagtgtagatcagttgagctgacacaataagaacacctgaggcgtgctgctggccaggtgtggccaaatatcaatagcttaagtctaatccggacagccagtgcttcctcgagtcaatcatttgactatgtaaatggcagtcaagccagtaccagcattggggttggcactgagggaggtactaatttagcagccaacaatgctaatcgatactcaactgtcagtctgcaggaagaccggctagggtacttcatcttacatcct

SEQ ID NO: 540643 - DNA, 204 bp, Homo sapiens
cgcatatctggctccccaggacaaagtgtggccaggagtgtcgtactctgcaagcacacggataccccggagccgtgcgtattctatgacctccttcacattctgtgctgtgtagattttggtgacagggttgtaggatccctttctcatgagctctggaacagtgaagctctcatattggaaggaaggatcatctaccagatg

SEQ ID NO: 540644 - DNA, 205 bp, Homo sapiens
ctaagtaatacgtcacaaacatagtataaaggcgaattcatatggtcatgtgtatatatatacattgtcatgatatgtgtgtatatattcatatatatcaaacaccatttagtatagcaaaaatggtataacttaatgatataattctaagagtgaacagaaaaacattacagagtataaccaaaaagaatatattcatgcattt

SEQ ID NO: 540645 - DNA, 141 bp, Homo sapiens
ggtctatccatgccttctcgcctgcactcatgaaaccccaataaatatcctcatgtcatacataaagtgtatgacatgagttggctgagatcatagggttgggtgtcctctgagcacgtgcaggcggagggaagacagaaa

SEQ ID NO: 540646 - DNA, 126 bp, Homo sapiens
atttctcagggactatgagatctagttggataactgctcaagtgaaggagatcacatgatggaagaggtttgggatactggcctaagacatacagaaacgtgagttgggtttaggggacagctgtg

SEQ ID NO: 540647 - DNA, 115 bp, Homo sapiens
ggctcacactggttgctggtcagcgcctcccaggatgggaagctcatcatctgggacagctacaccaccaacaagcctcaagacccgcgagggcaacgtcagggtcagtccggga

SEQ ID NO: 540648 - DNA, 402 bp, Homo sapiens
  misc_feature (25)..(25): n is a, c, g, or t
  misc_feature (397)..(398): n is a, c, g, or t
aaaagggtcctgtcaaggtcctacnacaggagaagaaggcttgggctcctcttgtaaagtataaatttaaaatatgtattttaaagtgttaagtaaaataatgcacatttaaaaattaaacacgcccaagtatagtggctcactccctagaatccccaacactttgggaggccgaagcaggaggattgcttggaccccaggaattcaagaccagcctgagcaatatagcaagacctcacctctacaaaaaataactgggtgtggtagcctgcatctgtagtgccagctacttgggatgctgaggcagaaggattgcttgagtccaggaggtcaaggctgtagtgagccatgatcacaccactgcattccagcctgggcaacagagtaagaccctgtnntcaa

SEQ ID NO: 540649 - DNA, 1471 bp, Homo sapiens
  misc_feature (264)..(264): n is a, c, g, or t
ggtcggagatcagccacgagctgtcgggtgattatcatcatgctccatctgagtggactatgcacgcgcgaccttcctctcccagaatgagcgattgctcgcagtgctgtagcccggagtcccttgagaggtcctcagtgatgacctatacgtgacacgtctcggtcgggaagacgcactgatcacaaacgatgtgctgtgttcgcatactcgtgtctcgcatcttcatgtctgccgtctcattgagcactattggccagtcgncgcactaacttcctggtcaccacctagtattgccacagagtatgctaacaaaactgaacaagtacttccttgcacacaaagcactggcatgctgtgggacgatattcatgacgttcatttcaagaagacggtatgcccaaagtcctacgcgcaggagaacgctggtgcacgggcacatgtgacctgacgtccattgcagggcatacacacgcgaacgtcaccgtgattttgcaaagggtcgtgcattgcctccacatgtaggtcagacccacgtaaaccacgcaagtggagacacacatatgcaggatagtgactatcgcgaacaggtatcgtgcggcctatcttgacgtaggacggtgacgcgatagtcgtatttgcattcattgcttctccaaagacatttggtagacacactcactttaaatgggctagtacgcctcgctcgacttggagcccagggccgatgctatttcacccttgtgaaagaaatcctttgaagacaaccattaaaagaaacgatcactattggggaaagacttcgaataatgactggtgaaagtgtcttttttgtgaagaatgctttgagaattgcagccaatttgggcttcccttgtttttgacacaattagaacgcaagggcgaccttctcctttgggaatgcaaaataagcccaactttgaaccgcttcccaccccgaaagagggagtcaacttggggaaaccgtggggaggggacccccggtctttcctgggggccttggggtttggttgacccaaaggcaagggatttcttggggccccaagttccccccagtggttgaagaagccaagcaagatgtgccgggtcattccaaccgagttcctttggcccaaggcccccacacaaagcggttttacaaaagcgtttttcttttgggcctccctttttcaagggcccccccaagggagccctcttcaccccccaatttcatttcccaccccctggttataccctttaaattccccaatgtgaagaaaccccttgggatggcccttgagggcttctttttccaggttcacccctttgtggatgcaatggacacaacacacccaatgttccgggaaaccatgggagcatttacacaagttggcagcagatgagcccctgggtttgcccacaagtctcccattctgtggtccacaagggaggcagtttaagggtccactag

SEQ ID NO: 540650 - DNA, 129 bp, Homo sapiens
  misc_feature (2)..(2): n is a, c, g, or t
tntctgtcaaaacgtttattgcaaaatggagtcttagacaaaggaaagcaaagaaaagttcacatcaaatgaaatgtatgcaccacttggatttctgaaatcactgtggactttgagctggaatatcaa

SEQ ID NO: 540651 - DNA, 222 bp, Homo sapiens
catttctgaaacgggtgcgtgccaccgccgcaaatttccagatgatggtctgtggctgcctgcaatacgactttctgcatcgctgaaaactgcccggcagcctggttgatatcacggcaaacatccgtcgccagctccagcatactttcggtgatatcgtgctttacctctccggccgtgatcttatttttaaccgcgtcaatcagcattgacgagtcgtgg

SEQ ID NO: 540652 - DNA, 748 bp, Homo sapiens
tacatatacttcatggaatggatacatagccataaaaggaatgagatctttctgtcctttgtaacaacataaatggagctggaggtcattatcctaagtgaactaagacaagaacagaaaaccaaatagtgcatgtttccacttacaaatgggaagtaaacattgagtatatatagacacaaagaagggagcaacagacaatggggtctaattgagggtggagggagagaggagagtgaggatttaaaaaaatactatccggtactatgcttattactgagtggtgaaagaatctgtaacaaaaccctgtgacatgcaatttactatataacaatccttgcacttatactctgaactaaaatagaggttgaaaagtaaaatcaaggctattatgaccatgtgctatcctcttttctataatctagttcagttacattaggtaggcattatttctccctgagtgattgagaatatagcccattgaagcccttaggcctgatattaccttagagatgttttaaattaaaagattcattctgtaatagaaatagaattatttaaagtgtggtatttcctctttgattacttcaagtcatgtcctattcttatattttacatgcactgtataggtactaaaatgattctataacattagtgtgcgacatatgtctatatctataacagcacagggtattatgtgcttcaatcttgaagcaaaggggtactttatagggtccagaaacgttgc

SEQ ID NO: 540653 - DNA, 203 bp, Homo sapiens
acgatacaaagaactacaaaggctgggcctaggaaacaacaaaatcacagatatcgaaaatgggagtcttgctaacataccacgtgtgaggagagatacatttgggaaacattaaactaaaaaaatccattcagggttaccaggttgaatacctccagatatcttccttcattctatttcaattgcaagatggggtaatattt

SEQ ID NO: 540654 - DNA, 237 bp, Homo sapiens
cagagccaccaaggaggccagaggcaccaggaggaaccaggtagggggacacgatgaggaccattgaggctcatcgagactgagtgccaggcttgtgagctactatgtggagaggtccacatgccagggatatgcagctgtggaactagagtgaagcacactctgaaggggcaactctagcaggcaccagacacaaggagtgcctgcgcagagacaggctagcagaagaggaccaag

SEQ ID NO: 540655 - DNA, 776 bp, Homo sapiens
cccacgcgtccgaccacgctgtccggatagatgtctgggtgcatacttctaaaggataggaattctcctgcacctgctcatgtggcaatggatagcactgtgcagcctctcagcgcaggatggggcctataatcaggcttggcttggaggcctgacaggtgatctgacatccatctaaatcaaatttatttaaattcatgggaaatcacttcctgcaccgcaaactgagacgattgcattttgtgagtctctatggatctgatgtggagaaaggactgtaaccccattaatgtggggtgtatatggaagtgcatgtagagcgtcctgccctttgaaatcaggactgggtgtgtgtcttccctggacatcactgctctctccaggtcattctcagtgcccgggggtctccttccctcaggcagctccagtggtgggttctgaaggtgtgctttcaaaacggggcacatctggctgggaagtcacatggactcttccaggagagagaccagctgaggcgtctctctctgaggtgtagtagggtctaacgcgggtgtgtgctgggctccaaggaggaggagcttgctgggaacacacgacaggagaagtactgactcaactggcactgaccatgttgtcataattagaatacaagaagaagtggtcggaaatgcacattcctggataggaatcacaggtcacccaggatctcacaggtagtctcctgagtagttgacgggtagcggggactagttacgcggtagttagtgtggtctgta

SEQ ID NO: 540656 - DNA, 572 bp, Homo sapiens
  misc_feature (550)..(550): n is a, c, g, or t
gaaggaaaaaatgcttaatgagtgaagatagcactgaaacatgttgacttttactctaggtttgtttttagatggggttagtattttcccctacgtaatgtacatgtctttaggccacagtattaggagtttgatttttccctgccccaccctcaggtaggtggcagtggtcattgtagcttaatcagacccctgttaagttcctgggcatttcaaggtaaattcacgtcttccttctcacagaaattgaatagacctctcacacacttatttacctccacccaacaaccatgtatccttgggccctttctagattttctctgcttggtgctcatttctactacttgacaagctattctgtacctacttcccacataaacagtgcccaattgttttaattaaaagaaaaaagaaattcctgatattgtccttcccctattagaatcaaaaagtgtcactcactcaagagatgtgaaccatccttgatttagcacgcaaactccactggctcaaaagaaatgacatcaaaagggaaaaaaggtaaaaatgnctggattggacttgcgagggaa

SEQ ID NO: 540657 - DNA, 293 bp, Homo sapiens
ggtatggacctctgttgccttctgggcccgtgttggtgaccctgttgcccctctgccctgctgtggtgagctgaattatttcttggtccgtcccttctagggggcttctcgcttaacctcctgtgttccctgcatgacagctctagctttatactagggcacaaaatttccctctattcttacactcatctgactctggctacatcttttcgagtttccagcttaaagtgtctatctcctccatgacagcctcctactgattaccgtacaggggatacctctaagagatcgac

SEQ ID NO: 540658 - DNA, 335 bp, Homo sapiens
tgacaggtactcatcgaacagcatccaggtctgtgtcctaccccgcagatgatagcacatagccagcgtaacaggctagcactcgcagcggtacatggtgtcgctaatagtggaccaggtagttgcacttggcgtacttgtatgcagtcgtgggtcccatacacgtgacagggtgttacggggcttgcacacctgagggtacaccatgctgctgtcacacagagcatatgagaatcctcagatatcatggaaacaagaatccagatccctgtcatctctgagtagacagaggctccatttggaagagtgtgggttacctctgtccctccccattc

SEQ ID NO: 540659 - DNA, 1169 bp, Homo sapiens
gtacccgtgacggtctccgtgctgcgaagtatctcgctagctctgtcgcccgaatacgcggtgcttctggagaagcttgtgccagacagtcgtgcttagaagagactcacctatgctggagcgtccattgtgtgtcattctcgtggaggaactctagttccactaagtgtagatctagataccctgcttcgaagcaagatgaagatagggtgagatcactaagacagataggacccatcgagagctagaggatgcgcttggcaatgggaagatcctgaaaattgggcagaagggtacttcgaaagagcgtgaagttccgtaatagcaatgatcttacatgtaccgccatctatcatggtgtctctgcggagtcatagaagcaagcatggagcaggcacatccaggatggagacatcaacgcctgtagtaggggaagactgagaacggaggagcctctagctttcttgacagcagagtgggtcctctgatcacgaagcaggcaagacgaagccgctagagaatgggagtgagggggaccacgcgaatcgacgggcgtgatgcgtagagacagcgccaagcgagggataaggcgtctcggacggaacctggcacagcttggagatctcgccgaaggcgctccatagctggagggccgatccaaaggcaggggattcccgtaaaccgtggttcccgcatttgtgaggacacggaaagggccagcgatttatcagcaccaaccgaattccccgtaagctaggccaaagccacgcgtggaaacggcagggtaacgaaatgaacaatcagcccaaagggttgttacaacaccaaaggttgtggacagtttgtaccaagaaggactgacggaaagtttttgacaatgtgcgttggcataagttcgctataaaagcgaattggcttggggcccccgttgaaagaagtaaagggaaatgaaacccaggggctttcgaaaggttcctgggattttttccagcaaggaaatacaggggcaatatgcgttggttttaagttaaaaataacgtgggttttttaaaattcgaacagaagattgtgcacatagaaaagaggagcgtcactgagggggcaactgtataagtatacagggagagtgagacgcggaagaacagagaggggcacttttggacaattgg

SEQ ID NO: 540660 - DNA, 367 bp, Homo sapiens
gcacgcgaggtgtcacccgagcccagaggagcactacctgtgcccccacaccctcttctcaaccacctccacggccacgctgtgtcccataggcagcacgcgatgggtctctccctttccccctttccaggtcaggggagttggacacagggcaagtgtttggttttaaagcgacaggcctttggggcaacacattattgagactcactgtgaattccccgggagtcagactgtgcttgtgctcttcctctctggagggccatgggccattagcaggagcttcacattgagccccaagccagaacccccttcctttacagagagggctttattgcgcacattgggtgccttttagctttgtgtgttg

SEQ ID NO: 540661 - DNA, 532 bp, Homo sapiens
ctgcgagcagtacgcaaggagccccccgccgggccagcgcccgcgggccctccccagggcaagccccgccagcaacctctctgaacagggtggcacccatcccaggaaaaaactaccggaaccccccacagggtctgagcccacgcgccgagcacaacagttcttgcggcgccaagggcgggagaaaaagggaaaaccccagcatccagcctcccacccagaggaacagaaaggggaaatccccccctgagttttgtggcagcagcggcattgccccgttggccgcaaacaggttcgccgcgcttagttgtggattctcgaaatccctccctcgaaaatcagtttacatatttcatgatgaattcccgcgacggtggaccataataacccctctttgtttcctaaaacaacagcccccttcaaataatctctttccaaacagacaagcagactaccgaaccactttggcaaatctctaaacactccatgataatttcagcctctttcttgcacacaaattatcaaaacaaat

SEQ ID NO: 540662 - DNA, 1190 bp, Homo sapiens
tgtttctgccttcattgtcgtcctgttctgtgtgtcattcgatttctctactgttctctcttgttgatcttattcttttcaatctgcttttcgtgcgtgtctctgtgattcctaccgcccttcctcggtactgttttaggtgtttctttatctcgtggcttttcatgatgcctcgcgggggggtcctatacacactgtctcggggttagcccctggtggacgtgcccccctcttgtggaatcttttccggtccctcagtggggccctgtcctctagacgcacgggagccccttcaccggttcccttgtctccattatcccggacgtgcccttgggccttttttgtgttttcaaccccagacaccaccagcagcagaacaccccttggcgcaatttctggccctagcgtgagcgccttgtctctccatccctactcccgtccatgtgcgccccggtggccccgcgccagcccacggccatccgctggagcccacaaccaccggctttcttgtgggcgccccgggtagctcccccgttttgctctttcaaggaggagggtgaatccccaccagcgctttcccgaaggcccccggagcccttgggccccgcggaccaatccgagctgggccccagaccaaccggaggccgaaattggagagagctcggacgaggaacccggtggaatcccagggcccaacggcttcggcggcacccggattgccagaaggtaccagagcctccgaagggccccttcgggcccggaaaggccctgcagcgcccccgccccacacccggtcaacccgcctcgccttgggcctggccgggagccccagaagccccacccggaagccccagcctgcgctggagccccaccgctggagcccagagcctcccccaggaccccgaggaagatcccgggagacctggggcttccgaagaaagctttgctcccaatggagagtgtagcctgagggctggtgttgcctgcctcccctgtgcttgtgccttgtccccaaattaatcctttcagaatgtagcactcacgccctaataaggagcgaatcctacatccacccaggcgggcgctttggccctcccttccttaagcccccgtcctgtgtccttctgaaaagaggtgcagtcactcacacctgcttgcgctcaccatccatccaaagttatttcacccga

SEQ ID NO: 540663 - DNA, 323 bp, Homo sapiens
taaagagacagggtcttgctctgttgcccaagatggagcacagtgacgtaatcagggttcactgcagccttgacctcccaggctcaagggaacctcccaactccggcttctgagtaactgggaccacaggtgccaccaggcctggctaatttgtgtgtgtgtgtgtgtgtgtgtgtgtgtgtgtgtgtgtgtgttacacaccgggtcttaccatgttgcccaggctgatctgtgtgagtgtgtgtgtgagtctgtgtgtgagtgtataaaacaaaccgggtctaaccatgttggccctgctggttgggtactggggagctcca

SEQ ID NO: 540664 - DNA, 720 bp, Homo sapiens
  misc_feature (337)..(337): n is a, c, g, or t
ctaattttttcccccaccggggccacttctggtgggagttccggtcgcccccccccgggcttgtcttgccccacggaggtttccccccccaccgcacacttctggactggcgctgtgataactcccacgctccacagttttctccgacacttcactgcctgttgcctctgtttggaaggccacgcgagtcttccctgtgagagtttttaacgtattgggggccacaaaaattctggaaaagacttatcggaggtcccctctgacacccccaacgcgaattatcaggggaacaccacgccacagtgggcctatggggcacatcacgccaccacgacanctgaagcgggagaaaatgcccacacttgtaattggggctgttaataagaaactcctggctgttgggccacggcaccacagtggctcaaacgctgtatattcccacgcacctcttaggaaggttgaggcggactggagtcaccctcgaaggtccacggagtttgagaccacgcctggcccaaacaatggtggtaaaccccgtcttctactataaaatacccaaaaaattatgcccaggcgtggtaagcgggcaccctgtaatccccgctactcaggaggctgaggccggagaatcacttgaaccggggaggcagaggttgccatgaactgagatcatgccactccactccagcctgggcgaccagagccagactccatctccca

SEQ ID NO: 540665 - DNA, 361 bp, Homo sapiens
  misc_feature (99)..(99): n is a, c, g, or t
tcctagcctttccatgagcaggcaactcccacttcctacacatgaacaagcccagaacagccatggttctacctaacccaagctaggaggcagcacagntttgacccctgcctcctctttccctctcaacctccccccaacactcaccacagccctggccttggggagaagccgcttccaccggaaactaaaaatcaagccactggggagatttaagtgggctggtggccaggacaggtatcacccccacctacaaaacctgccctacattcaccactcacacatgccttcatgggcccttctgaattctcttctccccagtcaggcagaggctctcaaaaggggcgtgcagacaaatcct

SEQ ID NO: 540666 - DNA, 337 bp, Homo sapiens
tggtcaattttttgtacttgaggtttgtccttgagaagaaccttttaggccgggtgcggtggtcacaccttgtaatcccagcactttgagaggccgaggcgggcgggatcacgaggtcaggaggatcgagaccatccctggctaacacggtgaaaccccgtctcctactaaaaaatacaaaaaattagtcgggcgcagttggcggctgccttgtgggtccctggctactcgggagttgaggcaggagaatgttgagccggggaggcggaagctttgcatgagcctgagatagaaccacttgcactccggcctgggcgaaagagcgagactccgtctc

SEQ ID NO: 540667 - DNA, 302 bp, Homo sapiens
atgacgtggctttctggggtataaaatgtagccgatttctgccacctcatgggctacactcttgactcaacgtcatttacgtgggtacttgtcgtcttactttgtagaccttcattcaggatttgctgaagatgctgtatataggctgagcaagatgtggtgatgttgatcggtgtttatcgattacagaacaggctcctctagaaggctctgatgcaccgctaggtcctttgagttttagtctgtggctcgtagtgttctggctagcagttttgttgatttcactattgaggttttgggct

SEQ ID NO: 540668 - DNA, 1912 bp, Homo sapiens
  misc_feature (43)..(43): n is a, c, g, or t
  misc_feature (238)..(238): n is a, c, g, or t
  misc_feature (540)..(540): n is a, c, g, or t
  misc_feature (1077)..(1080): n is a, c, g, or t
  misc_feature (1084)..(1085): n is a, c, g, or t
  misc_feature (1087)..(1087): n is a, c, g, or t
  misc_feature (1091)..(1091): n is a, c, g, or t
  misc_feature (1093)..(1093): n is a, c, g, or t
  misc_feature (1347)..(1347): n is a, c, g, or t
ttcggcggtctttctgtgagggtgtttcgacgcgctgggggtnttgtgctttcatcacatttgttaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcaccttctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggcctcgaggtggaagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540669 - DNA, 101 bp, Homo sapiens
tcctcccattacaccagcccccacacactcacacagcacacttacgcacagatcattgcagcggatgcgatggggctatgacagaagcctcagtgctcgtt

SEQ ID NO: 540670 - DNA, 1782 bp, Homo sapiens
  misc_feature (947)..(950): n is a, c, g, or t
  misc_feature (954)..(955): n is a, c, g, or t
  misc_feature (957)..(957): n is a, c, g, or t
  misc_feature (961)..(961): n is a, c, g, or t
  misc_feature (963)..(963): n is a, c, g, or t
  misc_feature (1217)..(1217): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgcaaatcttcgtgaagacgcgtctactggctaagaccatcgcccttgacgtggagcccagtgagcacgcatctgagaactgtcaaggcaaagatccaggacaaggaaggcattcctcctgagcagcagaggttgatctgtgtgccgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540671 - DNA, 291 bp, Homo sapiens
  misc_feature (17)..(17): n is a, c, g, or t
  misc_feature (36)..(36): n is a, c, g, or t
  misc_feature (186)..(186): n is a, c, g, or t
tgtacagggccaggtgnactgtgtctcacacctgtnatcccagcacttggggagaactagttaggagtgtatgctgaggccaggagttcgagaccagcctgggcaacagagaccctgcctcgacaaaatctttagaaatcaaccaggtgtcatggcacgtgcctgtagccccagctacttgggagntgaagcaggaggatagctagagcccaggagttcaaagctgcaacgacctatgacagcaccactgcactccagccaggaatgaggcagagacagagaccttacctc

SEQ ID NO: 540672 - DNA, 1892 bp, Homo sapiens
  misc_feature (751)..(751): n is a, c, g, or t
  misc_feature (1057)..(1060): n is a, c, g, or t
  misc_feature (1064)..(1065): n is a, c, g, or t
  misc_feature (1067)..(1067): n is a, c, g, or t
  misc_feature (1071)..(1071): n is a, c, g, or t
  misc_feature (1073)..(1073): n is a, c, g, or t
  misc_feature (1327)..(1327): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctctctgagaggtggtatgcagatcttcgtgaagaccctgaccggcaagaccatcaccttctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggagcccaagtgagcacgcatcgacgaatgtcaaggcaaagatcccagactaaggaaggccatctcctcctgatccacgcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540673 - DNA, 1556 bp, Homo sapiens
  misc_feature (978)..(979): n is a, c, g, or t
  misc_feature (983)..(983): n is a, c, g, or t
  misc_feature (986)..(986): n is a, c, g, or t
  misc_feature (990)..(990): n is a, c, g, or t
  misc_feature (992)..(992): n is a, c, g, or t
  misc_feature (994)..(994): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctctctgagaggtggtatgcagatcttcgtgaagaccctgaccggcaagaccatcaccttttttttttttttttttttttataaaaaaaaaaaaaaaaaaaaaaaaaaccggcaagaccatcactctggaggtggagcccagtgacaccatctgaaaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540674 - DNA, 1478 bp, Homo sapiens
  misc_feature (900)..(901): n is a, c, g, or t
  misc_feature (905)..(905): n is a, c, g, or t
  misc_feature (908)..(908): n is a, c, g, or t
  misc_feature (912)..(912): n is a, c, g, or t
  misc_feature (914)..(914): n is a, c, g, or t
  misc_feature (916)..(916): n is a, c, g, or t
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctctctgagaggtggtatgcagatcttcgtgaagaccctgaccggcaagaccatcacctgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgaggggtggctattaattattcggtctgcattcccagtgggcagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540675 - DNA, 1122 bp, Homo sapiens
atggggcctgagccaaggcggtgggtggagcggcgaggtgggcggagtgctgggcctgcggcgggcgagctggatgcggctgcgccttgtcctggagctctggctggtggcggcctgtgaggaggctgctagcggtctggctggcgtgctggtgcccgtgactgagcgtccggaggtggcgggacagaggctgcctgtgtgtgtgacccccgatggcgccggagtagtgttggtgcggcgccatgcactgactccatcgcggcagtcctcaactgagaactctggagaggcacctggagttgctctagggtcgtaactcagcctttgaaacaacgggatgaaagccataaatggaagaagcgattatcctatgacagatggacaactactgcatgcaatgcagggcatgaattcttgggatacagcaccagctgtttgaacggccggaaacgagatttgggatgccttgaagtgcttgcttgcacatgcttttgagagccattgatcatgaactggcacagagcaactcattgatggtgcaaagcataacattagccaacatggtgcacttacaggagtgctacgatgaactggggaacagatatcagcttccagtgtattgcttggcaccggcaatcaacatgatagaggcaaaagagcgacatagagactctggatattcctgagccagcaccaattctggatctgattgtccagcttcgtttgcgcctttccacaggcaaagacctcgagcttgtggttcgacgcacagacacagtattcaccatgacgagacggttgcattgcacgcaacggatgaaccaggtagacagggggataaactggaagagaccctcagggaccaacgtcagttcgaaaacttaggatcccagggagaacttgctgacaagggaactaggcagcagcaccagtgctcagacctagacaccagtggcacggtaagcagggccgagtggagggacaaagtccagaaccgatagaagcggcgcggaacacactcagggagagaacagcgagagcaaccgagagcagcaggggccagaagacctagttgaccgcgacgtagagccaggacacaaacacagggaagactcaccagtt

SEQ ID NO: 540676 - DNA, 527 bp, Homo sapiens
  misc_feature (11)..(11): n is a, c, g, or t
  misc_feature (34)..(34): n is a, c, g, or t
  misc_feature (93)..(93): n is a, c, g, or t
  misc_feature (121)..(121): n is a, c, g, or t
  misc_feature (160)..(160): n is a, c, g, or t
  misc_feature (240)..(240): n is a, c, g, or t
  misc_feature (325)..(325): n is a, c, g, or t
  misc_feature (424)..(424): n is a, c, g, or t
  misc_feature (436)..(437): n is a, c, g, or t
  misc_feature (440)..(440): n is a, c, g, or t
  misc_feature (456)..(456): n is a, c, g, or t
  misc_feature (463)..(463): n is a, c, g, or t
  misc_feature (465)..(465): n is a, c, g, or t
  misc_feature (491)..(491): n is a, c, g, or t
  misc_feature (494)..(494): n is a, c, g, or t
ggccccgggcngcgccctcccccgcggccaggcncgggagggacccaggagcggccgccggccgcagcccagggcccggagggaggaggagcngccgcacgacccaggcagcggggagggncccgcagcccgggcgagcggcccagagacagggcccgcnggaccagggcccgagggcccgcaccggccgccccagccccggcccccaggcggggacagcgacggccggaagagggaganggaggagagcgagggacacccgcgcggcccccgcggggcccggggcggggagaaaggggaacgggcgacaggcgcgccccggganggggccggagcggggcgggggacacccccgggaggggacggcggcgccgcggaggccggcaacgaggacagcgcggccggggccaagcaggggcgcgcngagaggccccgnngcnccgccaacccagaacnggacaancngaggagccaggccagccaggggcggnggngccaccggcgggagcgggagaaggtccacgacc

SEQ ID NO: 540677 - DNA, 584 bp, Homo sapiens
gatatggagtcgcagttcttgtttgtggattgctgtgatcgtcacttgacaatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgcctcagaggtgggagtgcaaatcttcgtgaagacgcgtcactggtaagtaccatcgcccttgacgtggagcccagtgagcacgcatctgagaatgtcaaaggcaaagatccaggacaaggaaggcatccctcctgaccagcagaggttgatctttgccggagaaacagctggaaggatggacgcaccctgtctgactacaacatccagaaaagagtccaccctgcacctggtgctccaaccgtctaagagttcagatccagttttgaggagtagaccctcactgatcagaacagccgcctcgaagtcgatccaatgta

SEQ ID NO: 540678 - DNA, 1294 bp, Homo sapiens
  misc_feature (24)..(24): n is a, c, g, or t
  misc_feature (265)..(265): n is a, c, g, or t
  misc_feature (716)..(717): n is a, c, g, or t
  misc_feature (721)..(721): n is a, c, g, or t
  misc_feature (724)..(724): n is a, c, g, or t
  misc_feature (728)..(728): n is a, c, g, or t
  misc_feature (730)..(730): n is a, c, g, or t
  misc_feature (732)..(732): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcacctgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgaggggtggctattaattattcggtctgcattcccagtgggcagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540679 - DNA, 1705 bp, Homo sapiens
  misc_feature (369)..(369): n is a, c, g, or t
  misc_feature (870)..(873): n is a, c, g, or t
  misc_feature (877)..(878): n is a, c, g, or t
  misc_feature (880)..(880): n is a, c, g, or t
  misc_feature (884)..(884): n is a, c, g, or t
  misc_feature (886)..(886): n is a, c, g, or t
  misc_feature (1140)..(1140): n is a, c, g, or t
tcgccctctgaccgcaggtgatcttgctgtaaacgtgacagctcccgtctgattacaacattcataatgagtccctgtcctctggtccgtcttacatgtggcatgcttatttcgtgtataccctgtactggtcacatactcactctcgtaattggtccgagatgcactccatagtcaatgtcaaggcatagatcctatgacactgaacgctactccctcctgagccagcagaggttgatctttgccggaaagcagctggaagatgggcgcaccctgtctgactacaacatccagaaagagtctaccctgcacctggtgctccgtctcagaggtgggatgcaaatcttcgtgaagaccctgactggtaanaccatcactctctgaagtggagccgagatgacacccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540680 - DNA, 131 bp, Homo sapiens
  misc_feature (86)..(86): n is a, c, g, or t
gtatgtcgaggtattcggatagtctagaaagtgttgtggaaagaatgtatatttactcctacgaatataattacaaagtgaatttnttgtcatgttggtttgagtgtgtacccggagaactagggggaatc

SEQ ID NO: 540681 - DNA, 341 bp, Homo sapiens
  misc_feature (327)..(327): n is a, c, g, or t
aatgtgtatttataaggtattatttccaatgataaaaaataaaaggcataacactttagatgatagaccatttttctttttaaataaggcctgatttttcaaaaagcattgaataggttggtttttaatttccaaagctggccggtttttaaggttccataaaaacaaaaaaaatggtaaggaaggaaggtcaaatcccttttgaaagactcatgggggtacaaaagcaaccatttgggggtatcaagggccaagaactaaaaaaacattcctggtttttttaacattcctttcctgggcctcattaactaatggacataaataaancatctttatttcaa

SEQ ID NO: 540682 - DNA, 705 bp, Homo sapiens
  misc_feature (24)..(24): n is a, c, g, or t
  misc_feature (265)..(265): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcacctgaggtggagcccagtgacaccatcgagaatgtgaaggccaagatccaggataaagaaggcatcccccccgaccagcagaggctcatctttgcaggcaagcagctggaagatggccgcactctttctgactacaacatccagaaagagtcgaccctgcacctggtcctgcgtctgaggggtggctattaattattcggtctgcattcccagtgggcagtgatggcattactctgcactatagccatttgccccaacttaagtttagaaattacaagtttcagtaatagctgaacctctgttcaaaatgttaataaaggtttcgttgcatggt

SEQ ID NO: 540683 - DNA, 1234 bp, Homo sapiens
ccacgcgtcgcccagcccgggccctgccggcccggctgcgcacgcgactgccccgctccaggccccgtctcctgcgccctatttggtcattcgtgggggcaagcgtgcagggagggcgaaacgttgcgcggccgacagggagaagccggagaccggacgccgagcatgcgcacgagtgacgcacgcctctcgccgtccgccaccctcgagctggtcagcccacgcacgctgccagcatcactgccctcggcaacaatgggactcgcgcgcgcgaggtgcttgcggccgacgctgctcctggcggcaccgcttgcaggttgctaagccgcctgctggcgggccgacccatgaacagcgccagcgcatggacgcgccactctgccaaccctagcagaataactgggccttccacacaacatccaggtgctcacagctcacacaggagactctccaaccatagtgccttcctgagccataagcaacctgcaacacgttaccaacaatatcacctgactgaaaacgcaccacaaacgcaccaagattgcccactcacgactcccacgaaactacacaaccggtacaaccaaccaactagaaaaccactacacgccgacacatcaataattaacaacacacacacacccaagaggcactagcatccaaccaacacacaaactacttgacccttccataccccacaccataaacaagatactaccaaccacaaacaccaacccaacggctagataaacaccaccaaaccaccaactcgtcaacaatacctccacacacacaaacaaaccattacaccccttaaacccccaaccacacctacgattacccaaacgacacaatactacgctaggacctatcaccttcccgctctcccccaactcccacaacacccaatcccatcctcccaattaccacaagaacgccaaaactcaaacgtgaatccaaacactactgactacctctcatagcccacaaaacgcaccagcaaacttcgaccttacaaccgccatccaaaatctcaaccaaaattcaatattacaaatatgccacacacaaaaacatgctaaaaaccaccacataacacaaccattacacaaaaaataaacccaacacatccaccactacaaaccatcctacataaagacaaaccatcatgcacaccatagacaaaaacaacaacatacaaatacacaaaccaacaaccaatacagacataaca

SEQ ID NO: 540684 - DNA, 1708 bp, Homo sapiens
  misc_feature (24)..(24): n is a, c, g, or t
  misc_feature (265)..(265): n is a, c, g, or t
  misc_feature (567)..(567): n is a, c, g, or t
  misc_feature (873)..(876): n is a, c, g, or t
  misc_feature (880)..(881): n is a, c, g, or t
  misc_feature (883)..(883): n is a, c, g, or t
  misc_feature (887)..(887): n is a, c, g, or t
  misc_feature (889)..(889): n is a, c, g, or t
  misc_feature (1143)..(1143): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtctgagaggtggtatgcagatcttcgtgaagaccctgaccggcaagaccatcaccttctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctgactggtaagaccatcacccttgaggtggagcccaagtgagcacgcatcgacgaatgtcaaggcaaagatcccagactaaggaaggccatctcctcctgatccacgcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540685 - DNA, 162 bp, Homo sapiens
gaaccaggctcagcatggagaatagaccaactgcacagctcagcagaggttgggacatcccgctcgacgagagagtctcgcggagaagtgaagcaaagaaacttatcttctaagtcatcaatgcttttctctaatttagttactgacctctcaatatcagaa

SEQ ID NO: 540686 - DNA, 416 bp, Homo sapiens
ggcgtcacgataagtgaagagaggtcttgagagcgacaatggattcctcgggcgtacgctgatccttggttaatttggagatcgacaaaacaccaaataccacatgttctcatttataaatgagagctaaacattgagtacaggtgaacataaaaacaggtactacagacactggggactactggagagggtagaagggaagaggggaatggaccgaaaaactacccatcaggtactatgctctctcccgggcaacagggccatccatacccaaattcttagcatcacataatatacccatgtaacaaacctgcacttggaccccctgagtctataataacattggaaattattttaaaaagaaaaagaacacaatggaaagtcgatgataaacctagcagaaatctactcatatt

SEQ ID NO: 540687 - DNA, 328 bp, Homo sapiens
tgctaagtgaaggaagccagtcacaaaagaccccatattatatgatctcatttatataaaatgtccagaataggcaaatccatagaaaccgaaagcagattagtgtttgtctaggactagagggaataaaggggtggggtatgggagaacagaattgatgagtgactgctaatgaatataaggtttcttttggagatgatgaaaatattctaaaattaattatggtgacgggtgccctgctaaatagatatactgaaaacccttgaattgtaccctttaaatgcgaattttatagaatacaaattatatctcagtaaaactgttttta

SEQ ID NO: 540688 - DNA, 352 bp, Homo sapiens
ggtttcacgggcctcccagtccccagcacaccccccgcccaccccgccaagtgtactgtactccccccccaggataaaaaagtgtttgttagggaaaaaaaagggaaaggcaggagccggcccaagcccagggtccctgtttgggccccaaaaagcatttaaccaggccccaacccttcaagggaaaccaaggcctcacccagacattcttgagggaaggaaaagccagactttgggtttgttttttgggggaataatgggtttttttttttaatgtttctttgggaattttgtttgttggcaaattcggggtgatcttttttcataaaaaaaaagaaaagatttaattgga

SEQ ID NO: 540689 - DNA, 128 bp, Homo sapiens
ccccattttctcatctacaaaatggagattataaaaccaacctcagaggaggagttcaggcctgactatgataaccaatgaaaaataactaaatgcagagcagaaggccaatgaaagttcccttgtac

SEQ ID NO: 540690 - DNA, 165 bp, Homo sapiens
atccaaagaaaccttcaaggttttggggggggggggtttccccggggggggaattggttccccccccgcccttttttgaaaaaggggttttttttttttctccccccccccccccctttgggggggggtttccccatccctcccaattaaaaggtatggttttta

SEQ ID NO: 540691 - DNA, 463 bp, Homo sapiens
ggctctgactgtctctctcttgcctgattgctggaagaagaggcatgccggcctctggtgtccaccctccaacccccacaaagttacctcccttagggaggtggtgggggcaaatgactgtcactccctgtgcatggtctgaccccaggctcctcccccagcacggttcggttcctcctctgtagcctgggaagacttctctgtccacctcccaaggggctggagcagtacaagttgttgcaggacagcagcctgaaaagaagggctggttgttcctgcccatattgggagagatgggagcatcctaggtcactggcttttgctgctgtaatggggacccctcccccatctacttaccaccaccctttcccaaccccaaccatgttttttgtgtgtcaattgtgccatttttattttattcctttccctactgtacacggagaaataaaggtgtagaaataca

SEQ ID NO: 540692 - DNA, 184 bp, Homo sapiens
gtagggccctatcctgaagatacagtccacagagactatcacattcacatgaatgcagcagctgcaactctaactatccatctccaagatggaatggtcacaaacacaatgcctcactagcctcaacaaagatcatcccgaacacccagtgacccgtaagtatcaggtagtggcatgccataat

SEQ ID NO: 540693 - DNA, 693 bp, Homo sapiens
aatatcactacacttgatctcatgccagcggcttcggtgcttgactgtattgactggcaagggttattccacaacacagatggagtaaccggagtagcaagccgagccagctatatatacccactagaagagtgagtgatcaaacgcggataagctatgcttttcttcccaagaagtatccatctctgagccaatagaaatggaacaaagtatcttgcaaggactctaaacaggttactgatgcatcacatcagagatgtttaccagagttgaaaacaagaataaatgttctagctgctcagtatcagtctcttctaaatagctacggtgaacccgtgcgatgatacacagtgctactttactccaacttattaccaaatttgccacagaatattgtcacactattgaaggaactgcacaagtatattgaaacttcggagctatgcggtggtgctcacaattgttatattttccatgagactttttggggcgaaccttagaaatctgttgatccacttgggaggcttaacactattgacacttttgactgccagttagaaatgctactggtacctccgtccctgccttatttgtgcctgacggattcactttgagtaactggtgaagcggaaaatccacagcgtcaagaagaggccagcctccgcgtgttgggacactcggtcaagcaggaat

SEQ ID NO: 540694 - DNA, 994 bp, Homo sapiens
tgaggcctgcctgaccgaccttcagcagggctgtggacataccatgattctctcgcgtggcgtgtcgctggtgctgtctggccgtggtaccttgctagcctgcaatggattcaagttcgaaactactggcaacttttgaagagactatcatccagcgaggactaaagtccatcaaaaacatccgagaaaatgtaccaagtctatgaaaatggtagcggcagcaaacatatgcccgagctgcagagagagctgaaaccatgctcgactactactggcattgggatcatacagctcctgtatgaacaaacgctgactatcaacggcggccatgacagacaacgaagcaaacaccctccttactcgcgcgtgtccatcagatcgcaggcactgctgctggctgctcatctcattccatccacttgctcacaacacatgacaccgcgaggcttgcctacaacctcaacacccagcccctggcgcaacgcaagctcattgccttgcctcggccactcggctgaccacaccatccagagagccctacctctatcccgcacctccatccctgacccacgcttcccccgactggcccactccaaccgcacagctggcgcccgcaacagccccccccaccattctcctgcgacgcattcgtggttcaacatccatctcgacccactatgaaccttaccctaaccctccctgggcacatctgatccttctgccctttcaaccgtcatccccctcaaagtcctcctccacaccccctcccaccgctcctgtatcaatatcacccccttctaccgacccagcaccgccaaccatccacacaatcgtcacacccccccctaaaccaccccgacctgcacaagctcccggaccaagcccctccaaataacctccataacgaataccttgcactcaccgaaccgtgagaccaacaaacaggtgccaacgcacaaactcacactgggcccacacacccaccaacacaaac

SEQ ID NO: 540695 - DNA, 391 bp, Homo sapiens
caaagtgctgttctattcaatgtctgtaatctgtagatgacataaccggctaggtcagggctcgatctttaactccgaggtccatggtgtggcgctgggctgtctgcctgtggatgtcatatctgccatttagttttgaattggtccatctttggaagcagaaattgggcataagacaatatagtgagtggtctcctccgttagtggcgcatgcctgtaatcccagttacttgagaggctgagtcagcagaatcacttgaatccggtaggcgaaggctgcagtgagccgagactgcaccattgcactacagcctggtcaacaagtgcgaaccgccatcacacacgcaaacaaaggagcacactatggtaggctgcttggcagttaggagct

SEQ ID NO: 540696 - DNA, 130 bp, Homo sapiens
agagattacactttgaacctcatagggtactgctaaatatactttaaaaagtcatctaataaatgttttagaaatacaacagaatagctgatagaaaaaaaaattgataactaagttgcccgcaatcgaa

SEQ ID NO: 540697 - DNA, 362 bp, Homo sapiens
ccatgtgggcttcacgggttgaactcctgacctcaagtgatccaccggcctcggcctcccaaattgctgacattacaggcgtaagccacctatgcccagccttttgtccctgtatcttagtcagcccgtgaggtaaacatcaccgcagcttaagattaacgaaagtagggctcggatagctaacggttggccgcatagacaaagcaatggtagaatctggaagtgcagatatcgagcatcatggccacttactaatgtggtccattttaggtatttgacagattggtggaaaggcagcctagaggataatctctaatctaaacatttacattaactcagggatgcgcaacaggggggtaccg

SEQ ID NO: 540698 - DNA, 239 bp, Homo sapiens
ggtctggcctcggttattccgtatggcatcaaaggctgccttggtacagttgcccagtgtggcatgtgcagccccgggctgagtgtgtagcagtcatctgataccagccatcatgagcagcttcttaggcacaggtgctggagacgatgccagtgcccctggtgtgcagggatgatggcgtaccatgcacagagcctgcagctggccgtgtcactcttgtcaaggtgacatgtgttggg

SEQ ID NO: 540699 - DNA, 1108 bp, Homo sapiens
  misc_feature (559)..(559): n is a, c, g, or t
  misc_feature (562)..(562): n is a, c, g, or t
  misc_feature (590)..(590): n is a, c, g, or t
  misc_feature (605)..(605): n is a, c, g, or t
  misc_feature (626)..(626): n is a, c, g, or t
  misc_feature (639)..(639): n is a, c, g, or t
  misc_feature (667)..(667): n is a, c, g, or t
  misc_feature (677)..(677): n is a, c, g, or t
  misc_feature (695)..(695): n is a, c, g, or t
  misc_feature (707)..(707): n is a, c, g, or t
  misc_feature (716)..(716): n is a, c, g, or t
  misc_feature (724)..(724): n is a, c, g, or t
  misc_feature (726)..(726): n is a, c, g, or t
  misc_feature (759)..(759): n is a, c, g, or t
  misc_feature (766)..(766): n is a, c, g, or t
  misc_feature (786)..(786): n is a, c, g, or t
  misc_feature (802)..(802): n is a, c, g, or t
  misc_feature (809)..(809): n is a, c, g, or t
  misc_feature (812)..(812): n is a, c, g, or t
  misc_feature (822)..(822): n is a, c, g, or t
  misc_feature (832)..(832): n is a, c, g, or t
  misc_feature (845)..(845): n is a, c, g, or t
  misc_feature (850)..(850): n is a, c, g, or t
  misc_feature (853)..(853): n is a, c, g, or t
  misc_feature (858)..(858): n is a, c, g, or t
  misc_feature (871)..(871): n is a, c, g, or t
  misc_feature (877)..(877): n is a, c, g, or t
  misc_feature (882)..(882): n is a, c, g, or t
  misc_feature (891)..(891): n is a, c, g, or t
  misc_feature (893)..(894): n is a, c, g, or t
  misc_feature (909)..(909): n is a, c, g, or t
  misc_feature (917)..(917): n is a, c, g, or t
  misc_feature (937)..(937): n is a, c, g, or t
  misc_feature (952)..(952): n is a, c, g, or t
  misc_feature (969)..(969): n is a, c, g, or t
  misc_feature (991)..(991): n is a, c, g, or t
  misc_feature (994)..(994): n is a, c, g, or t
  misc_feature (1007)..(1007): n is a, c, g, or t
  misc_feature (1009)..(1010): n is a, c, g, or t
  misc_feature (1012)..(1012): n is a, c, g, or t
  misc_feature (1016)..(1016): n is a, c, g, or t
  misc_feature (1020)..(1020): n is a, c, g, or t
  misc_feature (1025)..(1025): n is a, c, g, or t
  misc_feature (1029)..(1029): n is a, c, g, or t
  misc_feature (1033)..(1033): n is a, c, g, or t
  misc_feature (1035)..(1035): n is a, c, g, or t
  misc_feature (1040)..(1040): n is a, c, g, or t
  misc_feature (1058)..(1058): n is a, c, g, or t
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctccgtctcagaggtgggatgcaaatcttcgtgaagacgcgtctactggctaagaccatcgcccttgacgtggagcccagtgagcacgcatctgagaactgtcaaggcaaagatccaggacaaggaaggcattcctcctgagcagcagaggttgatctgtgtgcccgganaanacagctggaagatgggcgcaccctgtgntgactaacaacaatnccagaaaagatgttctcaccnctcgacactcttnggttgctccccgtccttcaagaggggtngcgggattgncaagattctcttccgtcnatatgacacctntgatctagngtgagagnanccattccacctcttccgtagcgttgggaggccncaggttntaccaccacacttctgacgnaattgtttcaaagcgncaaaagnatncccaaaagantaaaaggganacgggtcatttanctgcnctngtatnccaagacaagacncgtttngtatnctcttttgncnngagaaaataacaagncttggganaggaataggtgtgacgtcancccctcgtgtcttgnatgttatcacaacattncccaagaaaaaagaagttcgcnacnctttagacaaccntnngnttanctanccgtncttncaananaggtngggtggaatagacaaaanttctttcccgttagaaatgaacaccttcatctgagggacaaaagaagcca

SEQ ID NO: 540700 - DNA, 317 bp, Homo sapiens
gaccggtacagcaggactcgttcaggttacttcatggcagctatcccacagacgcagaagcgtgcgtgatactatcctcctagccaaatgctcaactaagaccaagtcctcgctggactgctcagggtgccagacctcatccattccaaaatatgcccggtgctatccgcccagctgctcctaggccaccatttagtactatgagaccagcttcttcacaggttccacgagtcatgtcaacacagcgtgtggctaacacatcaacacagacaatgggtccacgtcctgcagctgcagccgctgcagctactcctgct

SEQ ID NO: 540701 - DNA, 142 bp, Homo sapiens
ggccttttttggggtactgcccctgtgtgccttttgccaacgcctcctgtccccccctaagcctggtgggggtgaggggctccgggtcccttctgtatataactcccctcccccagaaaaataaatgtccctgccaacgtca

SEQ ID NO: 540702 - DNA, 1282 bp, Homo sapiens
  misc_feature (24)..(24): n is a, c, g, or t
  misc_feature (265)..(265): n is a, c, g, or t
  misc_feature (320)..(320): n is a, c, g, or t
  misc_feature (377)..(377): n is a, c, g, or t
  misc_feature (408)..(408): n is a, c, g, or t
  misc_feature (704)..(705): n is a, c, g, or t
  misc_feature (709)..(709): n is a, c, g, or t
  misc_feature (712)..(712): n is a, c, g, or t
  misc_feature (716)..(716): n is a, c, g, or t
  misc_feature (718)..(718): n is a, c, g, or t
  misc_feature (720)..(720): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtntgagagtggtatgcaacgtgagacctgaccgcagacctcatctggaggtggagcccntgacacctcgaaatgtgaggccagatccagntaagaggctccccccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540703 - DNA, 359 bp, Homo sapiens
aagtgtcagatccagagtctgaagtaagaccacgttctcttcttaggcctgggcaagttactcttccaggtcatcaattgtcataaccagtttagcaaccgtcctctctgcaaattcagcacgggtctcagcctcttacagtttgtcagacagaagtttcatttcttcttcatatttgtcctcctttacagaatacttttcagatgcaacctccagagatatcagatagtaagataacattcttgagttcttcttccaggtcaccacatttaagttcagacacctccgcacgctcctctgccctctccagctcaccctccaggatgaccagctaacaaactacctcctcgtatttgcgg

SEQ ID NO: 540704 - DNA, 1231 bp, Homo sapiens
tccttcgttactggagccaggcctacacgccagcaaccatgtccacgggacctgcagctggtatcgatcttggcaccaccatactcttgtgtgggtgttttccagcacggacaaagtcgagatacattgccaatgatcagggaccaccgaaccactccacccctatgctcgcctttacggacactgaacggttgatcgcgtgatgccgcaaagaatcaagctagcaactgaaccccaccaacacagccctccgactgacaaaccgctctgactggacgccgactcagacgactgctgctcgctccaggtctgactactgaaacacttgcaccctcctcatgcgtcggcgcacactgcactgctggccacgcgccccaaggctccaaacgctccccactaccaacgggcaccagcacccacacaacgcctaccatatcccaccacgcacggcagccctccctccctggctctcatcgcaccaccgcactcgacggcgcaacactcgacaagcaccgccataccctccgcggcaccgacgcgcccaccgcaagtgccacgtgcgcccgaccccgcgccaagccaccgacccacacgctgcacctcctccagagccaccagcgcatacccaccaggcatccccgagcaccccactctgcacgggctcaacaacagaccactgagcaacctcactacacagacacaaaactgcccgccaggcccacagccttacgcagcaaaagaacaacaaaggccccggcccaccaaagacaccgcgcctccccaaccggacacagagcaccgctgcgccactcttcgaagccgcaccaccctgccaaccaactggagcgactgcgccactcaccccaccgcaacgcataaaaggagctcaacacaacaatcgcccccaccacagccaccacccgccgcgacagcacgaccacaataaacgccacagcttcaccccactaattgcaccggcgtgagcgcacaaccagggggggggcacacgccccaggactgctgcgtaacgcacaaacaggtccagcgacttcgcagccggggcaggaaagccgcccatcacctggacgcagcacagacggaccggagccagacgccgcggagacggacaccagcgacacgcgccgcagcgcgaccgccacaaccgtgcaggccgcgagacggcacagcaacccgcaaggacaaaggtgcagaaaacaggagaacgcgcaaa

SEQ ID NO: 540705 - DNA, 1376 bp, Homo sapiens
  misc_feature (24)..(24): n is a, c, g, or t
  misc_feature (265)..(265): n is a, c, g, or t
  misc_feature (798)..(799): n is a, c, g, or t
  misc_feature (803)..(803): n is a, c, g, or t
  misc_feature (806)..(806): n is a, c, g, or t
  misc_feature (810)..(810): n is a, c, g, or t
  misc_feature (812)..(812): n is a, c, g, or t
  misc_feature (814)..(814): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcggggggggggggggggggggggggggggcgggggggggggggggggggggggggcacctggtcctgctctgagaggtggtatgcagatcttcgtgaagaccctgaccggcaagaccatcacctgcctggaaggtggagcccagtgacaccatcgaaaatgtgaaggccaagatccaggattaacagaaggcatccctcccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggtaagcataaaanncagnaanaaanananaaaaaaaaaaaaaaatgggggggggcgtcaaaaggccccaggggggccgcaataggaccgccgttgtttgttgacaatgggtgcggaccacaacaagcggaggggtgagataaaagggcaatgggcagggcgacggtgtaaaccccaccatcgagggccggcgggggaacaatcggcgactggcgaaagctgggcgaacgagcgaccgatgactgcgggggggcggcaaactatggggaataagccctccatcctaaaagatgaaggctttagcgaaaatactagcaaaagtcttctgcgcgcgtgaatacagggcgtggtgccaccaaacgccggcctataagacatggggctgcagaaacatgcggacaaccacggccaggtcatccgaggacatttgccccccgcgcgagatagaaaatccctgtcccaaaagaaaggccaccctgatggagatcacgtgaacggaggactgtggccgaggaagcttggactggcccgccgagaggccttgaagcagcagtactgtgaacaacgtgtcgcgcgcgatgacatgaccgac

SEQ ID NO: 540706 - DNA, 815 bp, Homo sapiens
  misc_feature (411)..(411): n is a, c, g, or t
  misc_feature (625)..(625): n is a, c, g, or t
agcctgctactccagagtattgaagcataaggtagtgcactgcttttgaacatagaggttgatcttagtgaggagcatgctgtgatatatggatgcgtcctgtgtgactacaatatccagaaagagtgagcctgaatctggtagttctggcttagagttgggcatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctggaaaacagctggaagatgggcgcaccctgtctgactacaacatccagaaagagtccaccctgcacctggtgctctcttcagaggtgggatgcaaatcttcgtgaagacnctcgactggtaagaccatcactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgcaagacccgtgactggtaagaccatcagctctcgacgtggagccgagtgacagcattgcacgaatgtccagggcaagatccacgacacacggaacggcactccctactgaaccagcactactgtcgcacccgctcgccggagtcacatgctggacagatgcgcgctctccctgtcacgact

SEQ ID NO: 540707 - DNA, 662 bp, Homo sapiens
gctctcatgtgcctgctcgtcgcgtatgagatctgtctaaaggccttgagatggaaattgctgaagtaccgtcgtgattactgggggataacgatacgcgtcgacaccaggacatcttccaatcttagtgcacatatagacatcatccgcaacgtggatagggtagattcatcccgagaatggttgcaattggttgagtgtagtcaggaacaatggtgtggctcacagcgcgagactgcgagcccgtagtctcctgcaatagtcaccattcgggcgggataggcctgctgggggcataggttggcgctcacgtaacttaccattgcatctgtgctcacgtgccttctctgcaagggcggccgtatggattacaacaacctccacgcctctaatgcgcataaccaggggtttcgtccttcagtactccgggggggtggatggctcgggggctctccgctagttttggcggagaggcgcacgtggcaccattggatggcacgaatcgagtggagcggactcgtccgtctcgtccctgcgtgatggattgcgccaaggtgggtagccttgcttgcctgggtagcctgtgggcccgccctgtggggagtcgcccttggttggccagatcgatgcccttgtggggctcctcgagtgactgagaaccg

SEQ ID NO: 540708 - DNA, 1375 bp, Homo sapiens
  misc_feature (3)..(3): n is a, c, g, or t
  misc_feature (6)..(6): n is a, c, g, or t
  misc_feature (16)..(16): n is a, c, g, or t
  misc_feature (22)..(22): n is a, c, g, or t
  misc_feature (27)..(27): n is a, c, g, or t
  misc_feature (44)..(44): n is a, c, g, or t
  misc_feature (49)..(50): n is a, c, g, or t
  misc_feature (59)..(59): n is a, c, g, or t
  misc_feature (254)..(254): n is a, c, g, or t
  misc_feature (540)..(543): n is a, c, g, or t
  misc_feature (547)..(548): n is a, c, g, or t
  misc_feature (550)..(550): n is a, c, g, or t
  misc_feature (554)..(554): n is a, c, g, or t
  misc_feature (556)..(556): n is a, c, g, or t
  misc_feature (810)..(810): n is a, c, g, or t
ttnttntttttttttnttcatntcttntttaattatcccttatnttttnntatcctttnactctcgaggtggagcccagtgacaccattgagaatgtcaaggcaaagatccaagacaaggaaggcatccctcctgaccagcagaggttgatctttgctgggaaacagctggaagatggacgcaccctgtctgactacaacatccagaaagagtccaccctgcacctggtgctccgtctcagaggtgggatgcanatcttcgtgaagaccctaactgttaagaccatcaccctcgaggtggaagcccagtgacaccattgagaatgtcaaggcaaagatccaagacaaggaaggcatgcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540709 - DNA, 184 bp, Homo sapiens
cattcattccatcgccttaacgattgcgcgtgttccgttcattatcccctggtacgtccatgtaattaacccatgttccacgacgcatacatcatcgtcaaatcaacacacaaagtccacatattttaagtacacccccctcatgcaccaatccgggggcggccgtccaagacagtgcgcgata

SEQ ID NO: 540710 - DNA, 1360 bp, Homo sapiens
  misc_feature (177)..(177): n is a, c, g, or t
  misc_feature (200)..(200): n is a, c, g, or t
  misc_feature (525)..(528): n is a, c, g, or t
  misc_feature (532)..(533): n is a, c, g, or t
  misc_feature (535)..(535): n is a, c, g, or t
  misc_feature (539)..(539): n is a, c, g, or t
  misc_feature (541)..(541): n is a, c, g, or t
  misc_feature (795)..(795): n is a, c, g, or t
atctttgtgaagactttgactggtaagattattatttttgaagtggagttgagtgatattattgagaatgttaaggtaaagatttaagataaggaaggtatccttcttgaccagcagaggttgatctttgctgggaaatagctggaagatggatgcaccttgtctgactataatatntagacagagtttatcttgtattnggtgctctgtcttagaggtgggatgtagatctttgtgaagaccttgactggtaagaccatcacctttgaggtggagcccagtgacaccattgagaatgtcaaggcaaagatccaagataaggaaggcatccctcctgatcagcagaggttgatctttgctgggaaacagctggaagatggacgcaccctgtctgactacaacatccagaaagagtccactctgcacttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540711 - DNA, 693 bp, Homo sapiens
  misc_feature (24)..(24): n is a, c, g, or t
  misc_feature (265)..(265): n is a, c, g, or t
  misc_feature (320)..(320): n is a, c, g, or t
  misc_feature (377)..(377): n is a, c, g, or t
  misc_feature (408)..(408): n is a, c, g, or t
aaattttataggacgattggcttngttgggtgagcttgttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaagatccaggataaggaaggcattccccccgaccagcagaggctcatctttgcaggcaagcagctggaagatggccgnactctttctgactacaacatccagaaggagtcgaccctgcacctggtcctgcgtntgagagtggtatgcaacgtgagacctgaccgcagacctcatctggaggtggagcccntgacacctcgaaatgtgaggccagatccagntaagaggctccccccgaccagcagaggctcatctttgcaggcaagcagctggaagatggccgcactctttctgactacaacatccagaaagagtcgaccctgcacctggtcctgcgtctgagcctgaggggtggctgttaattcttcagtcatggcattcgcagtgcccagtgatggcattactctgcactatagccatttgccccaacttaagtttagaaattacaagtttcagtaatagctgaacctctgttcaaaatgttaataaaggtttcgttgcatggt

SEQ ID NO: 540712 - DNA, 678 bp, Homo sapiens
atcctcacctgtgtgctccagccccatctgtgtgctcatctccacctgtgtgctcatcctcacctgtgtgctccatccccacctgtgtgctcatccccacctgtgtgctcatccccacctgtgtgctcatccccacctgtgtgctcatccccacctgtgtgctccgtctcagaggtgggatgcagatcttcgtgaagactctgactggtaagaccatcaccctcgaggttgagcccagtgacaccatcgagaatgtcaaggcaaagatccaagataaggaaggcatccctcctgaccagcagaggttgatctttgctgggaccagcagaggctcatctttgcaggcaagcagctggaagatggccgcactctttctgactacaacatccagaaagagtcgaccctgcacctggtcctgcgtctgagccttcgcctcagaggtggcatgcagatctttgtgaagaccctgacaggcaagaccatcaccctggacgtcgagcccagtgttaccaccaagaaggtcaaacaggaagacagacgtaccttcctcaccacagtatctaaaaagagccctccttgtgcttgttcttgggtgtgatgggggaggtgtcttagttttccctatcttttaagctgttaacaagtttcattgcactttgaataaagttcttgcattcc

SEQ ID NO: 540713 - DNA, 217 bp, Homo sapiens
ccatatcagcctcgctccatctgggacctcaaacacgaggccctaacgcatcctggtcctctccccagctccccagtacaccctccatccctcaccttcctccactctaagggatatcaacactgcccagcacaggggcccagcaatttatgtggcttattataccatttcttaatcaagatgcacatttcatgtcattctctcaatcaaagctctg

SEQ ID NO: 540714 - DNA, 1234 bp, Homo sapiens
  misc_feature (29)..(30): n is a, c, g, or t
  misc_feature (40)..(40): n is a, c, g, or t
  misc_feature (42)..(42): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (58)..(58): n is a, c, g, or t
  misc_feature (65)..(65): n is a, c, g, or t
  misc_feature (74)..(74): n is a, c, g, or t
  misc_feature (78)..(78): n is a, c, g, or t
  misc_feature (80)..(80): n is a, c, g, or t
  misc_feature (84)..(84): n is a, c, g, or t
  misc_feature (86)..(86): n is a, c, g, or t
  misc_feature (97)..(98): n is a, c, g, or t
  misc_feature (102)..(102): n is a, c, g, or t
  misc_feature (114)..(114): n is a, c, g, or t
  misc_feature (117)..(117): n is a, c, g, or t
  misc_feature (122)..(122): n is a, c, g, or t
  misc_feature (127)..(127): n is a, c, g, or t
  misc_feature (146)..(146): n is a, c, g, or t
  misc_feature (150)..(151): n is a, c, g, or t
  misc_feature (155)..(155): n is a, c, g, or t
  misc_feature (162)..(162): n is a, c, g, or t
  misc_feature (399)..(402): n is a, c, g, or t
  misc_feature (406)..(407): n is a, c, g, or t
  misc_feature (409)..(409): n is a, c, g, or t
  misc_feature (413)..(413): n is a, c, g, or t
  misc_feature (415)..(415): n is a, c, g, or t
  misc_feature (669)..(669): n is a, c, g, or t
gccttccttatcttggacctttgccaatnnaaaacggcantngggncntnttttgggncgctttntgtcggcantttnanaatngnagcacctcgtnnaaantctttgttgtgnaanccttnccccncaggtttatcccattttgnccannatanaattttnaaggcaaagatccaggacaaggaaggcatccctcctgaccagcagaggttgatctttgccggagaaacagctggaaggatggacgcaccctgtctgactacaacatccagaaaagagtccaccctgcacctggtgctcttggtcctgcgcttgagggggggtgtctaagtttccccttttaaggtttcaacaaatttcattgcactttcctttcaataaagttgttgcattccccannnnaaannanaaananccaagaataaaggaaaggcaattccgtccgtgatcagcagagtgtttgctcttgggcgcgcaaacagctggcaagactggtcgtaccctgtactgagctacgcaccatccagaaagagtccatttttgcacctggtactccgctctcatgatggtggcgatgcaaaatcttgcgatagaagacgcgtcaactgggcaattgactcagtcagcccctctgacgtgtcggaagccgcgaggttgagcacacaatcngcggacactgtcaaaacggctaaaagagtcccttttgacagatcggacaggggcatttacccttccacttgaacccctttcaaggaagggttttgaactcctgtgtggtctgagaaaaaataccaggccgtggtaaaggactggggcccgcatactcccgttgattccttggagcgtaccataacggtccctatgtacacatgtcagttcctaacacccctttgtctatcctcttggcgctggcgtcccggctcctttccatacaaaacaggtcggggggacaacttgcccaagaaatttttattcagggttgtaagtagaaacccgccttggaaccttgtggggtttcgaaatggaaaccccaatgtttcatgaacgattccgtgccggaacacgagtattgggtgaaagccccacagatagtgttggaatcctatcgtccaaattttttgcacaggaaaaactttggttcccacaacgcggcgcgacacaaaagagaacttcctcccaaggacactcacaactggggcaaacagcgggcgcaatcttctccccattatacccg

SEQ ID NO: 540715 - DNA, 900 bp, Homo sapiens
  misc_feature (900)..(900): n is a, c, g, or t
tcgtccactcagtgctcaatggtgcccaggctggagtgcagtggcgtgatctcggctcactacaacctccacctcccagccacctgccttggctcccaaagtaccgagattgcagcctctgcccggccgcaccccgtctggaaagtgaggagcgcctctgcccggcgccatcccatctaggaagtgaggagcgcctcttcccagccgccatcccatctaggaagtgaggagcgtctctgcccggccgccatcgtctgagatgtggggcgcgcctctgccccgccgcccgtctgggatgtcaggagctcctctgcccggccgcgacccgtctgggcaggtgaggagcgtctctgtctggccaccccgtctgagaagtgaggagacctccgcccgggcagccgcccctgtctgagaagtgaggagccccttccgcccggcgagtcaccccgatctgggcaggtgcggagccgtctacgcccgggctatgttgcccggtcggggcagggcaggtggggcggtcagccccccgtcctggcgttggccgccccgtccgcgaggtgcgcgtggcgggcggcatcatgcccccggcccgggcacagccgccccggtcctggggagcggcgtttgggggggcgccttctgcccctgggccggccccttacgtggctaccgatgatgggacgccccttttgcctgttccatcgcacccaattttgggagtgttgttccccagccagctcgatttggcgcacgggggccactgctgcgacttggcgcgtcttcggtggcataccacaccggcgggccacggtcggcgccagattcgacgacatcgggactgcttgcgcggctcctgctctccacgcgcagttgcccttgcgcgccttccatctgcgcctn

SEQ ID NO: 540716 - DNA, 1528 bp, Homo sapiens
cgagtgtcaggactgccccatgcgctccctgtttgtcgcgcctggttatactcgctattggtgtcgcctccccctggcgtgtgtagacgcgtcgtcgcgtcggctgcttagtgggtgcccagcttatggggtgtcgccacaaggctggctttcgtgatccagtgtgatgttgtcggtcgagttcgctcgtgcgtgtatattgttttcgtcctgcggtggggcgacagcacacgccggcgcgtccgcttctgttgctcgttgggcggtgtattgtaagttggtgggaacccccgcctttgttgtgtggtttgtggaggccttccgccccgcgggtgtgtgttgaggattgccttgccgtgtgtgagtcgctctttttgtatggtagggtgatactgcacctccacggtggggaggtacatttctgtcttgttggtgagggccaccaatggccggaaggggggctttgctcccagcggggtgccctccctcagcgcgccctgtctgtgtgggaggaccacaggggcgcgccttctgtcgcgcccaccgtggtggttctgtgttcttgtcgttggggtcctccactgcgagagagggggcaccagccggtggcctctttcttcgccgctttcacgctcgggagaagagtgtctctcgccctctggtagggggtgtgtcgcctctgggggggcgtttgggtagtaggagtgatatccacgcttttaatagagagggtgtaggacacacctcggtgatatggagagtgtggtggtgtgcagcacagccggttgggttgtgagagtgtgttgggacgactaaggtgtgtggtgtgtgtgtgtgtgcacagacaggttgcctcacggccgcgcgacgcggccctgtggtctctctcttcactacgctcttctgctcacatcaggaggtgttgtttcttctggcgcgccctctgtggctctcgtgagacactctcctacggcggcgctctctctctctctccccgtgagagcgccactctgtgtgtgggggggtgtcgcgactctctctgagatatgttttctcacacagagaggtgtgcgcgctctgtatgtctccgctagtgggcccctctgtgcgcccccctctctcttctgtgtgtggtctgtgagactgtggtgagagacacacaggtgctcatcgcgggcaccaccacacacctctctctctccacaggcccctctgacacagcacacagatgagtctatactgcgcaccctcgtgagacacagccactctctctctctctttgtctatagagaagtctctatatgttataattttgtgcacttttattaaccaccttctatgcgccctcgcgcctctttttgggggacacacaagttggtgtccctcgttcctctgcggggtggggccctcggcacgaaacccctgcctcgaagagaccccggttttctcgcccggtgcacgggccgcccccgcccccccccccctgcctcgcagttagttttaccattaaaaccttgttttggtttta

SEQ ID NO: 540717 - DNA, 377 bp, Homo sapiens
gggaggcgtctagaggatcccatgctcaggcaggtacgaggacttcaggtctaaaacaccaaaagcagatggcaacaaaagccaaaattgacaaatgggatcttattaaactaaagagcttctgcacagcaaaagaaactaccatcagagtgaacagacaacctacagaatgggagaaaattttggcaatctcctcatctgacaaagggctaatatccagaatctacaatgaactcaaacaaatttaccagaaaaaaacaaacagccccatcaaacagtgggtgaaggatatgaacagacacttctcaaagacttaactcttttttttatttttttttgggaaacagagtctcacccggtggtcccgggccggagag

SEQ ID NO: 540718 - DNA, 100 bp, Homo sapiens
catcgagctcggtccgccaagcactcttttcttcattggtcatgtatgacacataagctgtttttttctgcaattggccagccagactgacgaaattgta

SEQ ID NO: 540719 - DNA, 252 bp, Homo sapiens
ggggggaggggagggggagggggggggggggggaggggaggggggaggggaggggggggcgatgaggggggggggggaggaggagggggagtgggggggggggggggggggggggctggggcggggaggcggggagggggggacgggcgggcggagggggaagcgcgctcggggtcatacacctatcccccattctcctcctatccctcaacccggacatcattacgggggtttcctcttaaaaaaaaaaaa

SEQ ID NO: 540720 - DNA, 335 bp, Homo sapiens
  misc_feature (3)..(3): n is a, c, g, or t
  misc_feature (29)..(29): n is a, c, g, or t
  misc_feature (101)..(101): n is a, c, g, or t
  misc_feature (206)..(206): n is a, c, g, or t
ttnttttccaaacaaacatggattctctnccgggtgcagtgctcagcctttaataccagccttccactttgggagtctgaggtgggagtattgcttgagcncaagagttggagaacagcctgggcaacatggtgagacctggtctttacaaaaatttttttggccggacgcaagtgtcacgcctgtagtcccagcactttgggagnccgaggcgggttgatcatgaggtcaagagatcgagaccatcctggccagcatggtgaaaccccgtctttactaaaaatacaaagattagctgggagtggtgcgtgcgcctgtagtcccaactacttggg

SEQ ID NO: 540721 - DNA, 144 bp, Homo sapiens
  misc_feature (95)..(95): n is a, c, g, or t
ggcaccatgtgctggcacttaaactggactttccaggctgcagaactgtgagaaagaaatgttggtgtttataatccacccagtttatggtattntgttatagcagctcgaatggactaaggcacccagaataaaccatttttt

SEQ ID NO: 540722 - DNA, 817 bp, Homo sapiens
tcctggcagaaaccaacggggataggattcaaaactaggtgacaaactcatggagaaatccaacctgggctgaatggtctggagaggctggctactggttatcaactatcacaagataaagcactcgggttatcacctgcccatatcctccttagtggtcacccaagactatttggactctgatgtgggttaattggataacttttctggctccactttacaaggtttggtttcctacatcttattacctggggacacaaaatggggcagatgtggttggagagctggatggacaataaaacgggagaacatctagaggaatttggagacgggaaagaaagccaaagctggattttccaatctctatggctggatctccaacctggcagaaaaagctggatatataggaaatcttcttccatattgtgatgaagtcactccatttacgacataacacacaagggaatcaccgtggcttttttttttaaacccaggaagagttgtgcgggggacctgtgcccaatccggtgtgatacagatccgtgagggaataatcagggatgggcccagtggcagtgtgtcaactatcacaaggtaggcgcgcgcagaattttggaggagggagaccctccaaatttctgggagaacctttgtgttggccactcggaaaaacaggttccggggaattccactattttcacatgtggaagggggccctatggggagtgtccccaagatgtccagatccgaccttattctctcccaaagggtcaatggggttggtacattgtagcagggtgtattttccaggtcacat

SEQ ID NO: 540723 - DNA, 902 bp, Homo sapiens
tgctcagtggtctcattggcgcgaggctgctgccccagggcccatgtgccctgatgggtgtttacaccctcccgcggctattttgccagcttggtgcccgcccgaccccggggaatctcttttctcgggatagccccggggttccccccccgcccccgtgctcctttcgcgccgtttgcaggactttcttccccgtcagcggttctccgccatgcacgcgtttcgagacccccacgggagcttacacccggccccaaggccctccgatagaactccccctcttccttgggccaaaatggcggttgatattcctcttgggccaacagtctccccccggttacaccatttctgtagcccacgattgatgatcaccagactgtgggaccctcccccgacttgtccccccccagcagggaaccaccacaacgagaccctaagtgcaaacaccactgaggacagtctaatttgccacacacttttccccatataacaaaaaggggcaaattccgtggctcctaatctcccccccctgattttttctaagaaatcggccctttcgtgataaaaaaagaagtaatcttcccccactgcccgcccctggcaagaaacaacacccgggtggcccctcgtcccacaaaaaccccggcccctttcctttttgctcaccatgttcccctcactctctttatcccccgactctcccctccactacaccccctatttcctcgccttacgcgctataaaaccacgatccagtagacttctatcatccgcactacactatagccccgcctagaggtcaacccctagccccctcgacccgaggctcatgtcgagctccacttgtagcgagcaaccgtcgcggcataacttcatatagcatcacaggataagaagtacat

SEQ ID NO: 540724 - DNA, 811 bp, Homo sapiens
gtctccttgcggtttccttatcgcacgtttccgaaccgaggggattggctactcgcctttggcttggcggtctcttgtgctcggtggtgtccgaataactgctggaaggcccctcggtttctctggaggggagcggggcggtagcgagtattatgtgacgtggagcaggctgctagcaacagttcggaggtgcctgtagtggctgattaagaaacgagtttgtaacagattgcctgggtgatggagtgtgacgttccaaaaccaggattttccttgtagtctgtatttgtacgcaggcaatgtactaggacgatatgacttatagcacagctgcttttggccactgtcctctggaatggctggaggagtatatattgttcaaccagtattcgaacagtatgccatgggatcagaaggaattacacagaaaagatgcacgtggtacaagaatcagaagacaagaacacgtttatactacatggccgttaggcctggcgcagtggctcacgcctgtgatccagcactttgggaggccgagcggttggatcaggtggtccggagttcaatacagtctgacaatcgtgaaccctgtgctatagaaccactaagtcgccaggctggggaatagcctgaatccactagtggaagctgagcagagattcttgaccggaggccaggggacgcacaacacgtggcacggtgcaaacaccttaacagggagacccaccggacatctggtgtaccactcccatcaaagtcaggggtcacaaccggagccgggggaaacactcatgacgcacgcaccaccaac

SEQ ID NO: 540725 - DNA, 368 bp, Homo sapiens
ggccagctgatattgtggaggcgggcgtggtggctcacacctgtaatcccagcactttgggaggccaaggcgggtgaatcatctgaggtcaggagttcctgactaacctgggcaacatggtgaaaccccgtctctactaaaaatacaaaaatcagcctggtgcggtgatgcgcacctgtggtcccagctactcaggaggctgaggcaggagaatggcatgaatctgggaggcagagcttgcagtgagccaagatcacaccactgcactccagcctgggcgacagagcgagactccatctcaaaaaaaaaagaatcagtaaaagatataaaggagaaaaggactgaaccacaaataggcaatcaagctt

SEQ ID NO: 540726 - DNA, 239 bp, Homo sapiens
  misc_feature (209)..(209): n is a, c, g, or t
tacattccatgctatcaaaaatggcaaagaattggaaaataacattatgccaagaagacgtcaaggtgctatttcaaactttaaaaaacaaaacaaaacagatgccacttttgacccatgagagagaaaatattcattattaaagtagaccagactgttcctcagtcccttaaacactctacagtttgaatgatcaaaaaagcctcttnagtgtgcatgtccaagcctgacgttcctgc

SEQ ID NO: 540727 - DNA, 907 bp, Homo sapiens
  misc_feature (23)..(23): n is a, c, g, or t
  misc_feature (66)..(66): n is a, c, g, or t
  misc_feature (93)..(93): n is a, c, g, or t
  misc_feature (119)..(122): n is a, c, g, or t
  misc_feature (125)..(125): n is a, c, g, or t
  misc_feature (128)..(128): n is a, c, g, or t
  misc_feature (133)..(133): n is a, c, g, or t
  misc_feature (219)..(219): n is a, c, g, or t
  misc_feature (266)..(266): n is a, c, g, or t
  misc_feature (283)..(283): n is a, c, g, or t
  misc_feature (303)..(303): n is a, c, g, or t
  misc_feature (305)..(306): n is a, c, g, or t
  misc_feature (312)..(312): n is a, c, g, or t
  misc_feature (318)..(318): n is a, c, g, or t
  misc_feature (340)..(340): n is a, c, g, or t
  misc_feature (349)..(350): n is a, c, g, or t
  misc_feature (358)..(358): n is a, c, g, or t
  misc_feature (643)..(643): n is a, c, g, or t
  misc_feature (710)..(710): n is a, c, g, or t
  misc_feature (907)..(907): n is a, c, g, or t
acagggttggtgggaatgtaaantggtacagctgatttggaaaacagtctggcagctcctcaaaancttaaacagttattatataacccagcnattccacgcctgggtatataccaaannnnccnganaccangtccacacaaacccttgtatacaaatgttcacagacgcattatacataatctccaaaagtggaacgggcccaaacatccatcagtngaggaatgaataaatattgtctgtctagacagtgaattactattcancaataaaaggggatgangtactgatatgatgtgtcangnnagattntttttnttttctttatgctttttgtttnttgccaatnncaaaatancccacacattttatgatttcatttataagatatatccagcataggcaaatctataaagacaaagtagatgagtagctgcctcagggtggttgttaggtaatggggagtgactactaagtatgagagtatgagatttctcatggagtatgacatttctattctttatttcggtaaaatattcataacaaatttcaccatttcaaccatttttaactgtgcaattcagtggcattaagtccattttttctttattcttcttcccactatcatttctaaactcatcanggcaggcatggtggctcacactgtagtcctagcactttgggaggccgaggcgggcggatcacctggngtcaggagttcctgaccagcctggccaacatggcaaaaccctgtctctactaaaaatacaaaattagctgggcatggtggtgtatgcctgtaatccccactactcagggagctgaggcaggacaatcacctgagcccgagaggcagagactgcagtgagcagtctcaaattccaggctcaagcgatcctgccatctn

SEQ ID NO: 540728 - DNA, 1263 bp, Homo sapiens
tggggggaaaaaaagggggggtgtataaaaaaaaaaaagtgttttttttttttattattatggagggaaaaaaaaaaacattttttctataaaagagaggagggggggggggttttttttttttatatataaaagagaataaaaaaaaaaaaaaagggggggggcgcaccatacaaaaaatatacccgggggggcgcgcacaaaaataccgggcgccacccccattttgtgtggtgaaaaggggcggcgcccacacagaggggcggcgcttttaaaaacagaaggaggggcgggggcggtgaatatataaacagcacgcggcgcggcggcggcgaagaccacagaggcaagcacgagcgggagacaacagtgagaggaggaacggagaacctctctagtgcgaggggagggcgtgcgcccaacagagggcggccacacaacacctcacaccaaagaaaatataataccccaaaccgcagagaggagagagcatacaacacaactaacaagaaggaaggatataacaacggcgcggcagacaccacacacgagcggaacacactagaggaggagcaggcgcgagaacaaacagggcaggcgaaaccgggcacagacactcgacacaaacaacagaaataatcaatacacgagagcggagagacaaactatagagcagaaaacacacagacgaacagacaacacacaccaacacgcacgacacaaaacaaacaacacaaaacaaacacaacgaaaccaagcaacaaaaacacaaagcaacacaacaaacaacgaaaacaccacaaagaaaaaaaaaaggaaaacagaccaacagaaagggcgaaaagaagcagcgaacgcaacaaacacaacaacggaaaccaaagagaaaagcagcaagaagagacaagacaacaagaaacggaagtaaagaagcaagagagacgagaaggaggaagagacgggcgaagggctaggaaagaccaaaagagcagagaaggagaagaagagaaccaaacgagaaaacacgaagaacgaaaaacgcaaccagaaccaacaatcaaaagagaggaggagaaaaagagaacaaagcagaacgagacgaacgacaaggaaggagaaagataagaaaggcagaggaaaagagaaataagaacgagcaagaagaagaagaagggacagaagagggagaagagagagagaagagagaaaagaaaaaagaaaagaaaaaacacagaagagaacgacaaagacaaacaacaaaga

SEQ ID NO: 540729 - DNA, 286 bp, Homo sapiens
  misc_feature (87)..(87): n is a, c, g, or t
  misc_feature (114)..(114): n is a, c, g, or t
  misc_feature (147)..(147): n is a, c, g, or t
atttttttttaaggagaatggcccagtctttttctaagtccatataggggaggtgatagtattgttttggtgtaaattatgtaatgnaaatttttttaattttcgctttaaaanttttttattttgttttattttgaatgatgagcnttggtgcccccccttcccctttttttgtcccccaaattgagatgtatgaaggtttttggtttccttgggagtgggtggaggcagccagggtttacttgtacattgatttgagaccagttgaataaaagtgcacccctta

SEQ ID NO: 540730 - DNA, 183 bp, Homo sapiens
ccgagatggcaccactgcactccagcctgggcaacagagcaagactctgtctcaaaaaaaaaaaaaaaaaaagaaggtgtgtgtgtgtccttttttcttctcattctattgacagctggtttggccttgttttccattttttaatatttctgatgattgtcccatttcaatacgcaaagagct

SEQ ID NO: 540731 - DNA, 612 bp, Homo sapiens
  misc_feature (1)..(1): n is a, c, g, or t
  misc_feature (555)..(555): n is a, c, g, or t
ngcgtctgtgaataatgctgcaagtgaagcatgagcgtacaggatacctcaagcatactgatttcatttcctttggatatatagcccagtagtggaatagctgaattgtatgataatcgctattttcaagttttttgaggaatctccatactgttttccatagaacagtagtgtacaggccaggcccggtggctcacgcctgtaatcccaaaacttggtggggggccgaggcaggcgatcacgaggtcaagagatcaagaccatcctggtcaacacagtgaaagcccatctctactaaaaatacaaaaaaatgagctgggtgtggtggcacgtgcctgtagtcccagctactcgggaagctgaggcaggagaatggcttgaactcgggaggcggagattgcagcgagcccagatcacgccactgcgctccatcctgggcaacagagcaagactctgtcctcacaaaaaagaaaaataagtaaataaactctgtcttaatcactcagtaacttatgtatacttctctttggttggaaatgtagtactgctcatatntcagaacaccgtcttcgagggtgttctgaaatattggtgttgaggctggtggtgata

SEQ ID NO: 540732 - DNA, 925 bp, Homo sapiens
gccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggtcgggcagctgggctcgggcggcgggagtagggcccggcaggaggcagggaggctgcagagtcagagtcgcgggctgcgccctgggcaagaaggccgccctcggtccagcaaaacctgtgctgccaccggccggatgaagcccgcgtggtctcgctgctgtgggcgccgcgcttgctctgcgggccaacgggaagccttctgccggccgcggggtcaggcgggccacaaaggtgtgtttggctgactttcaaggcatcccttgtacaaaatgcctacttccatgaattgtccagccgaagttgagctttcaggagggcacgcctggctgtgtgaagaagtgagggaaggagtcctcctcagctttggaaaattgaagcagaaccagaaagttaataggagaggcatgtgtgcaaaaactggacaaaaccccgggacagggattctgatgggattctgaatagggccttgaggaatggagatgccaaacctctggtgctgccagatctctaccagtgtctggatggaagcatccccagtacggacctggtcaaaatgaaccttctgggagtggacagtgtgtgttggtgttcaccaccatgcaacctggcttggggccctcctttcactggaaggacacgggcgatgagccctttttggtttacacgattatccacacctcttaaaagtttttatacacga

SEQ ID NO: 540733 - DNA, 729 bp, Homo sapiens
ggagtacactctaaaacactgatcaatagtatattatagtaagatacagtaaaccagtaacacactttattatcgattatcaagtattatgtactgtacagaatggtgtggtgctgtgctatccaggaacacatttattatcattatcaagtattgtgtactgtacagatatgatgtgtgctgtgctatccaggaacacatttattatcataatcaagtatgtgtactgtacagaatgatgtgcgcgtgtgctatccaggaacacatttattagtcattagtcaagtattgtgtactgtacagaatggtgtgcgcgtgtgctatccaggaacacatttattatcattatcaagtattgtgtactgtacagaatggtgtgcgctgtgatatccaggagacacatttattatcattatcaagtattgtgtactgtacagaatggtgtgcgctgtgctatccaggaacaagtttattatcattatcaagtattgtgtactgtacagaatggtgtgcgcgtgtgctgttaatgcaacgtggcgagcacaggtagacttttacacgaagctatcacttagacacactgcagtagcaatagcaagtcggccatctaggcaacatgtttctcagggcccattccttatcatcttcatgggaccgacatcctatatgcagtgtgtcaattgtaccaagattgtccttatgcgatgccctgacttattatttgcaagg

SEQ ID NO: 540734 - DNA, 994 bp, Homo sapiens
ggatgagatgatcagggaggctgagattcgatggcgatgggcatggtcaattatgaaggagtttagtacagatgatgactgcaaagtgaaggccccccgggcagctggcgatgcccgttctcttgatctctctcttctcgcgcgcgcacatctctcttcaacactcccctgcgtacgcccggttctagcaaagaccaattgattgacgtgagaatctgataaagcaacaggtagagattttgtcccaaaggctgcgatgatgtgctctttctctcttcttgccctgaggtctctctcgggtatgccccctcatctcttccttttgccctcgcctcgttcctatccatcgtctttcagaggcctgatgcgattcatgaatgttgagagccctcccacaggatccccttggggagcctctgccctcctccagcccggatggcatctcctccatctgggtttgtgtacctcttgtttcgtcatcttatttcgggtgctgtgggtggctgcacaacccctgtacctgggacctgctgggagaggacaagaggccctcccccaggcagaagagcatgccctttgccgttgcatgcagcattgcctgtgataccacgtgcagatcccagagctgtaggggcaggcgtgccaaaaagaggcattcaaaggactgaccggggcgttgaggaatagtgggttgactggattgtggccatgaggcgtccaagggaccaggcacagaaggggactgccgtggacaacaatcacatcccaatggctgttgtccgaaaccatggaatgggttctgaagatatgccgggcggggacggcattgccccccgcaattgaatcgccaactaaaggtcgagagctaaccgggaaaaccaaggccacaaaaaaccacgcaaggcacaaaagaggggagacggagagacgacaatccaccgaaaagaagaaaagagaaaaaaaacagaatcagaagagaaacacaaacaacacg

SEQ ID NO: 540735 - DNA, 200 bp, Homo sapiens
tccgggatatacctttcctttcccccttgggaataatacccagggaaagagagaggtaggtacgggaccggccacccaccagccaatatattggcggccggcgggaatatccacattaattcctaatggtggtctaatcaggaattcggctattggaaccttcctcaaaccaaggaaacctttccggatgggaaccccat

SEQ ID NO: 540736 - DNA, 992 bp, Homo sapiens
  misc_feature (843)..(843): n is a, c, g, or t
gcaagaacctagggatcagagtgcctgcgggaaatatcccgtcggtatcatcatcggtgctggatagaaggataaagcagtcaggcattgtgcgccatgcggtgggaccacctagcaatctagaccgatcacgtggatattcatgcttgcctctataactcctcgcgccacatggcgctgccagaccagggtgcgctacatgcgaggttcgagctgcttcagcaatgaacctcaaccgtggcaagtccccatcggacttggatgacacgtactgacgacacagagctgagagcagtgatggaaatctggggggcctgaaagcacgtcatccacgaagcgtgaagtaacgtggtccgcggctgaaagggagacgtgagcgtatcccttaccaaaggggcctgggcatgcctgtgcaattctggtccttggttaattatactgtagtatgtactaactcgtgcagcgaattgtgccaggttggtcgtctaccatcgactcatggctggagagggcttgatgagacctgaaggttatacggataccgaaggcttgtgagacaaagtcctcggcgcgaaggcaagattttagggtccgtgcttgggtctagagcgcgtcactacgctagcgctggtggagtcctcacttcatacaagactccacgtgttgcgattaccactttgattcttgatctagggctgttttgtctccaggctcaagtgaaaaccctgaaagttggtttggatcctgcaagggaattaggcgcgcctctagggagtccctgggttcgtcgagaccgaagaaggtcgcctaggattaggtgatccgggatcgatgaaaacgagntgtaaaggccctggggtgcaaggcaagagctgttgagctaggtcgtccacttgaatggcctttgagatgggccacatacaatgagctgggaagaggccacgggagcgggctgcaagaagaacctgggggcaagcaaacacctcgattta

SEQ ID NO: 540737 - DNA, 281 bp, Homo sapiens
tctcatcatccagtccccgtctgggtggtctgtcgtcatctgtgtgacgccagcttcccctgccatcatcaccaattcgcctgggaggcctatcatcatctgcattacgccaggaaggacggtcatcatctgttcctctacgagaaaatctatcttcatcgggaccacgtctgggccctctgtcatcatccaggccacgcctggggatacgatcatcatccggtctaagagaagactctctctcttcatcgtcaccccccaagcgcctcagccgtcgacgc

SEQ ID NO: 540738 - DNA, 117 bp, Homo sapiens
tctacatgtgtaccgtgcacaccaatgaacattcatcaactggccctggagtgaattcttccgaaccctcatagcggcactcctctacctgatcacctccattgttgtccttgtttg

SEQ ID NO: 540739 - DNA, 87 bp, Homo sapiens
tcgatacggcttttgtttcattaagtatgggtcttattcagaagaaatgggcagtgtttgttgttcaatcccttctgtcgtcttctc

SEQ ID NO: 540740 - DNA, 436 bp, Homo sapiens
aactgctgacttcccagttttgctgagtccagcttgccaagcataatagggggccaggtgcagtggctcagcctcccaaagtgctgggattacaggtgtgagccacagcacccagcctgggacatgtgttttaagggtgcaggccactagctaagcaatgaacatgtccttatctcagcagccttttgctacctcttcttttgtggtatgtccccatgtcactcagccattaccagtctcagccacaggttcagaacaatttgtggaatcccctattagcttctgaaatatttgtcactacaatgagtaggtgcccaaactaaacacagaagatttctgtttccatgacgtgcccatgaaaactgaaaatttcgagccagaaatcaaatgtttacaaatgcaaataaaattctgtgtttgttgtaccttttaaaaa

SEQ ID NO: 540741 - DNA, 214 bp, Homo sapiens
tacagagtctttgcaactcggcatttctatgaggttatcaaccacaccttgactcgtctttgtgtgtgtgtgtctgtgtgtgtcttgtgtatagtttctctgtgattggaaaccctgtgcgggatgacataggagaatctgttccattagtcttgtctcctaacaggataagttgaggcaatgtgaaggggaatgtgtgcccttagagaaactg

SEQ ID NO: 540742 - DNA, 495 bp, Homo sapiens
  misc_feature (1)..(1): n is a, c, g, or t
  misc_feature (20)..(21): n is a, c, g, or t
  misc_feature (358)..(358): n is a, c, g, or t
  misc_feature (387)..(387): n is a, c, g, or t
  misc_feature (402)..(402): n is a, c, g, or t
ngttcgtaactcagccactnnaagggaagctccaaatccatcacagtcaaagtctctgactggatattaccctgaattctactagttcctccaattccattttctcccatggaatcacgaagagcaagacccactctgttccagaagccctataagctggaggtggacaactcgatgtaaatttcatgggaaaacccttgtacctgacatgtgagccactcagaactcaccaaaatgttcgacaccataacaacagctactcaaactgtaaaccagggtaacaagttgatgacttcacactgtgggacagtttttccaaagatgttcagaacaagacttccccattcatgataagggntcccacccctctttaacttgttccttggntcatggcctggcctnttttcacttgggcagggttattgcagttcattaggattttcacatgtagtaggtttctgaggggttaaccaccagagttttcaggttatgtta

SEQ ID NO: 540743 - DNA, 103 bp, Homo sapiens
catacctctttcccgaatcccgcagtattgtgaattgctcagtaagaaaaatgtgtctgtgcacaacaggagactagaaagaaacctcagtgcctccagtgaa

SEQ ID NO: 540744 - DNA, 252 bp, Homo sapiens
  misc_feature (163)..(163): n is a, c, g, or t
ggataagagaggtagaggtatatgtcaaggcagagccctatgaggaaggaagagttttcaaagaatacgaggaacatagtgctgagagtggggctgccttcagcaccgtagaccgaaggtagaggaggatatttcgcatgtgggaggtcctgtgtgcgttcantccacccttttctgcctgcttcttcctcgaagtgcctcaacctgtagatgctcactctcctgcccttccctcaacccatctgggtctaa

SEQ ID NO: 540745 - DNA, 392 bp, Homo sapiens
ggagagagagagaactagtctgagttttggtttttctctttttaaaaccctcatcaatagatggagcactctacagaaatagtcaaaccaaatctacaaaatgtcagtatcaggcgggggttcaaagccaaagtgatgttgggactgtaagggtgaacatattagtgggcggatgacagcagataagtgaggaaagttgacccaactaattgacgtgaagtccggggaaccctgtggctacaaaaaatgttgagccgtaaatgccgtcggaaatggtgaagggagactcgaagtactctgaggcttgtcaggagggtaaaatagagacccagtaaaattgtcaatgagcagtgcttgaattattgggtatcggtggtttctattagactatg

SEQ ID NO: 540746 - DNA, 893 bp, Homo sapiens
  misc_feature (63)..(63): n is a, c, g, or t
  misc_feature (76)..(76): n is a, c, g, or t
  misc_feature (98)..(98): n is a, c, g, or t
  misc_feature (104)..(104): n is a, c, g, or t
  misc_feature (108)..(108): n is a, c, g, or t
  misc_feature (115)..(115): n is a, c, g, or t
  misc_feature (122)..(122): n is a, c, g, or t
  misc_feature (140)..(140): n is a, c, g, or t
  misc_feature (144)..(144): n is a, c, g, or t
  misc_feature (162)..(162): n is a, c, g, or t
  misc_feature (174)..(174): n is a, c, g, or t
  misc_feature (183)..(183): n is a, c, g, or t
  misc_feature (186)..(187): n is a, c, g, or t
  misc_feature (202)..(202): n is a, c, g, or t
  misc_feature (205)..(205): n is a, c, g, or t
  misc_feature (209)..(209): n is a, c, g, or t
  misc_feature (212)..(212): n is a, c, g, or t
  misc_feature (220)..(220): n is a, c, g, or t
  misc_feature (233)..(234): n is a, c, g, or t
  misc_feature (236)..(236): n is a, c, g, or t
  misc_feature (246)..(247): n is a, c, g, or t
  misc_feature (272)..(272): n is a, c, g, or t
  misc_feature (274)..(274): n is a, c, g, or t
  misc_feature (295)..(295): n is a, c, g, or t
  misc_feature (303)..(303): n is a, c, g, or t
  misc_feature (306)..(306): n is a, c, g, or t
  misc_feature (308)..(308): n is a, c, g, or t
  misc_feature (312)..(312): n is a, c, g, or t
  misc_feature (330)..(331): n is a, c, g, or t
  misc_feature (333)..(333): n is a, c, g, or t
  misc_feature (343)..(343): n is a, c, g, or t
  misc_feature (348)..(348): n is a, c, g, or t
  misc_feature (372)..(372): n is a, c, g, or t
  misc_feature (383)..(383): n is a, c, g, or t
  misc_feature (433)..(434): n is a, c, g, or t
  misc_feature (436)..(436): n is a, c, g, or t
  misc_feature (450)..(450): n is a, c, g, or t
  misc_feature (455)..(455): n is a, c, g, or t
  misc_feature (462)..(462): n is a, c, g, or t
  misc_feature (475)..(475): n is a, c, g, or t
  misc_feature (487)..(487): n is a, c, g, or t
  misc_feature (493)..(493): n is a, c, g, or t
  misc_feature (497)..(497): n is a, c, g, or t
  misc_feature (500)..(500): n is a, c, g, or t
  misc_feature (508)..(508): n is a, c, g, or t
  misc_feature (511)..(511): n is a, c, g, or t
  misc_feature (514)..(514): n is a, c, g, or t
  misc_feature (521)..(521): n is a, c, g, or t
  misc_feature (539)..(539): n is a, c, g, or t
  misc_feature (542)..(542): n is a, c, g, or t
  misc_feature (548)..(548): n is a, c, g, or t
  misc_feature (557)..(557): n is a, c, g, or t
  misc_feature (571)..(571): n is a, c, g, or t
  misc_feature (574)..(574): n is a, c, g, or t
  misc_feature (576)..(576): n is a, c, g, or t
  misc_feature (585)..(586): n is a, c, g, or t
  misc_feature (588)..(588): n is a, c, g, or t
  misc_feature (606)..(606): n is a, c, g, or t
  misc_feature (612)..(612): n is a, c, g, or t
  misc_feature (623)..(623): n is a, c, g, or t
  misc_feature (633)..(633): n is a, c, g, or t
  misc_feature (642)..(642): n is a, c, g, or t
  misc_feature (652)..(652): n is a, c, g, or t
  misc_feature (655)..(655): n is a, c, g, or t
  misc_feature (661)..(661): n is a, c, g, or t
  misc_feature (664)..(664): n is a, c, g, or t
  misc_feature (669)..(669): n is a, c, g, or t
  misc_feature (682)..(682): n is a, c, g, or t
  misc_feature (697)..(697): n is a, c, g, or t
  misc_feature (705)..(705): n is a, c, g, or t
  misc_feature (713)..(713): n is a, c, g, or t
  misc_feature (720)..(720): n is a, c, g, or t
  misc_feature (726)..(726): n is a, c, g, or t
  misc_feature (731)..(731): n is a, c, g, or t
  misc_feature (733)..(733): n is a, c, g, or t
  misc_feature (739)..(739): n is a, c, g, or t
  misc_feature (741)..(741): n is a, c, g, or t
  misc_feature (747)..(747): n is a, c, g, or t
  misc_feature (752)..(752): n is a, c, g, or t
  misc_feature (765)..(765): n is a, c, g, or t
  misc_feature (769)..(769): n is a, c, g, or t
  misc_feature (771)..(772): n is a, c, g, or t
  misc_feature (775)..(775): n is a, c, g, or t
  misc_feature (777)..(778): n is a, c, g, or t
  misc_feature (789)..(789): n is a, c, g, or t
  misc_feature (798)..(799): n is a, c, g, or t
  misc_feature (808)..(808): n is a, c, g, or t
  misc_feature (885)..(885): n is a, c, g, or t
ggcggcactgaagtgtctactgacattaggaagatggtgccccggccttggagtggctccccnggcccggagcgcncgccgccttcgtccccggcgtncccccngacnctccccnatccggnttccagccgccccgcgcnaccnccgccccgcccccatgcncctccccccgcngcccgcccngcnncggcccgcccccccncgncccncgncccccacncgccgaaccccgnncnacgcaccccnncgcggcgcgatgggacccccctgancncactccggtagccaccccctnacccacgnccncnatgncgccccccctttgccctnncnaccccccccnccttnccccccccggcgcccccgcctctnccccccccccncactgcccccccacccacccaccccccacccacccaccgcgcacccttcnngnccccgctcgatccnccgcnccttccnacccccctccccnccccctgtgggnccggcnctgncgnctaccccngtnggnggcctgncgcgctggatgttcttcnggngccganccgccctgngcctgggtgggctnttncncgaccgctnnanccgccgccttttcactgncgcctncgagggatcgncccctccacncactttttncgcaaccccnccntttagnctnggacnttttaggtgttcnggcacaatgggtctnatgtttcnacctgagntgccgantcccanatttntnttccgncncattcnttttnggggttccccttnttcnannatntnnggccccgcggncctccactnnccgcacacnattcgcacccactttccaaccgccgtggggcccccccccggcgggggcgcacctcgtggcccaattgggggcacttntcctccca

SEQ ID NO: 540747 - DNA, 402 bp, Homo sapiens
tacaagtacaacgcatcaatcttttataacactaaattatgtctgagcagttaaatgagagcagactatttatatttccggctcttcttatcttacaggcagatctcttcaattctctaccctggtttggtacaccagactagtgcccctgtttgtggtgctgggcgtcgctgcgatccaagacctggtggacgaggtggctcgccataagatggatgcggagatcaacattaggacggtgtgacgtctttaaggatggcagggttcacagttgcttagtggaaagacattcaagtgtggagacgtcattcgtcgtgataaagagttgatgttgttccagtcttgatattctccggtctgtcgaggctctgacgcctaaaagagccatctggtatgtgtgaa

SEQ ID NO: 540748 - DNA, 193 bp, Homo sapiens
tgccacagagaaacgcgccaagatcgtaagaagctgagactccatcggtaaaggcgacgaagtgctgaccaccggcgtgctgatcggtcgcgtgaccaaatgtggcctgacaccggcatcatcgccatcgcgctgaacgacaccacggaagtgatgatcaagcgtgacttcgtggcggccgttctgccgaaag

SEQ ID NO: 540749 - DNA, 166 bp, Homo sapiens
gcggtacgacagtccgtgccgaactcggcaacgtgcccagcgatagaactaagatcgagaacgttcccagaagcatctgacgccctctgtggactgaacgagtgcttagtctgataacttttcaggtaggaacagctccgcaactaacttccacactcaggatgcc

SEQ ID NO: 540750 - DNA, 243 bp, Homo sapiens
cacgagggtggagggactgaagcccaaggacctagtcggccaaccgtggcgcttggccttcgcgctgcaggatgccggctggtggctgcggcaggacatcatctggcacaagccgaacccgatgcccgagagcgtgcgcgatcggtgcacgaaggcgcacgagtacctgttcctgctgaccaagaacgagcggtactacttcgaccaggacgcaatccggacgccgtacagcgctgaaaccaa

SEQ ID NO: 540751 - DNA, 151 bp, Homo sapiens
  misc_feature (122)..(122): n is a, c, g, or t
tcctaaacggtctgttaccggatcattaccacgctaagcgtgaaacgatcagcggagcgtgggaacgatcaacttcctataatccaggatcatgtgcggcagaaaccggcttgagtccttgngtgatcaatgctattggtcctctcgcacc

SEQ ID NO: 540752 - DNA, 728 bp, Homo sapiens
gcacaaaaagaggtgatgacaggacactctggtggaccgaatcttgcgagccgctaggatgtcgctccggattcgtgagtcttcgctcgtagcacgttggcgctgcgtctgtgccgcttggcctctacgtacctgatacccctcttgaatactggcagcactctggactcattgatctacatttggaggactgtcgtggctcctttgtctacacaggaaggaataggaattcaaagtactgtgagcgtacgtgggagaccgtctatctatccgtcgctcacgttttggcccgcgggctgtagatgttcggctacgccagtccaggatgggtgtccctgtgccagtcttgcccactgtgtctatgcacatccccctcgacctcagcaccggagggcattctccgattgccaagaagaccaggacatggagtccgacgcgggaggctggtatcgtcacgctggccatcctcatctggccccaacgttctcctacattctctagaagagactgctcttcctgccctacctggtcttcagcatcctggccacggcactgttaccatcaggctgggaatccccctggttaccattcccatggccttctcccttgagagacagtttcgacagccaggcttcagcaaactgccccagaggactgccaagctcaacctcctgctgggacttgctatgtctttggcatcattctggcgaccagcaggcagtctggcg

SEQ ID NO: 540753 - DNA, 218 bp, Homo sapiens
  misc_feature (17)..(17): n is a, c, g, or t
  misc_feature (22)..(22): n is a, c, g, or t
  misc_feature (37)..(37): n is a, c, g, or t
  misc_feature (40)..(40): n is a, c, g, or t
  misc_feature (46)..(46): n is a, c, g, or t
  misc_feature (51)..(51): n is a, c, g, or t
  misc_feature (83)..(84): n is a, c, g, or t
  misc_feature (86)..(86): n is a, c, g, or t
  misc_feature (96)..(96): n is a, c, g, or t
  misc_feature (120)..(120): n is a, c, g, or t
  misc_feature (139)..(139): n is a, c, g, or t
  misc_feature (146)..(146): n is a, c, g, or t
  misc_feature (198)..(198): n is a, c, g, or t
tattagccatctgtatntgttntaatttccttctttntgntccaantttgntgggtgggaggaggatttagtctcttcctganntngaagagctcntttactatttcgggaaataacganttggattgtcaaccattanagctatnttttacacacttttcaacttctgtttttgttataagaatgtgtatgattgtnacatgtccaagtataaccat

SEQ ID NO: 540754 - DNA, 112 bp, Homo sapiens
ggcccaagaaattttctgtttgtcatggaaaagtaaaagtggaatattaaaacctttcagtttagttctgtaaagtccggaatttttccaaaaaattaaaaaatgggctgga

SEQ ID NO: 540755 - DNA, 624 bp, Homo sapiens
  misc_feature (587)..(587): n is a, c, g, or t
ggagcacgtgcccagccagggacggaccctcattcctcccaggggccccagacctctgtctctctcggataagtctccatctctgcctgtctctgtctctgactctgcatctgtctgttactgacgcactcagcaaggcctcctgccctgagagaggctccgcccactacctgccactttccccatccagctgagtctttgtgccacgaagactgcgtgcagaaggtgactgtctcagtgcagcatgctcatctcaggtggtgagttggggtccacgacggtgaggaccctctgcagaggagggagctcatctgagacacttatattttactcacacctgatcctcgtcagcaggcactcgactccttgaacttatggccgccatgtgctccccgaatgtcctgtgtgatgacatgaggaagctgaaggcccgaatgcaccaggccatagaaagatgctatgatagcatgcgacgactgtgagggctacctcggagacagtgacggctgattatgacgagcagcacccagagctcacatgtctacttagaacagaatgagatgtgatacggtgccgaggctacagantccactgtccacgatgttgatgaatcccgaacccggg

SEQ ID NO: 540756 - DNA, 1103 bp, Homo sapiens
aaactaccccataaaagaccaacacatggcgacagcgaaacagtactcatatcaacattgtcgtcattggacacgtagattcgggcaagtccaccactactggccatctgcatctactaaatgcggctggcactcgacaaaagcaaccattgcaaaaactttgacgaagagaggctgctgcaactgggcacaagggctccacttcacacgcactaaattgacccttgagagctctatgcgactaacaccctgcaacaggcctgaagccgttgcaacccgctggatactccacccacttgcactactcctcccctctgatggcgaacactatctgacagacaccagaacacacgactacctatctgatgaaacgataactccatgtctagcaacttgccaccctccaagagaaaccaacaagcacggacccctctaaactccacacaacacatccagcatggaacttcaacccacgcgaggaacccaacatccatccaaggcgagccatgacaccctcgcatggccctagaactcccccttggacctccagcgtccagaccctcgcaacaggagcggtagctcaggagaccagaacacttcccgcaaccgcacctaggagataactcacacaccaaacgcacaacaagcgaaacccagccacacccccgaacgcacaaccaaagtagacccactaaccgtacgaaccataaacacaaaccaacactggagaccatgcaggaagaaaagcaacaccgataccacctcgaaccccgagcacgcctccaccacaccacacaaccagcgcaaactcccccaccctagaaacacccacacccaccatcaacacagctcccaagaacagaaccaaccacctgaaacgcaacacacccgccccacccccagcaacacacaacacgaccaacccaatacgactcaacagccaaaacaccatccgcgacacaccaaaccccccccggaaccaccgcgaccagcaccaccacagcgcccccagaacccaacaatgagcacagagacaccgcgactgcaacacaaacacacaaccccagaacccacccaccacaagcaaggacaccaaaccaaag

SEQ ID NO: 540757 - DNA, 904 bp, Homo sapiens
tacacgcttaattcacttaattttcctggtataaaaaccctatgtggtacccacagcgggagccgagagatccgcttgcacggaaaactcgggtgggggtctagacgaagggggtcaggtgaactccggatagggagactgggtgaatacagtctctattccagaaggtcgggggctcaggtagctgtaggtctctagaaagggcatcaaagggggcctgggcaaagtttgcccagggtgggcaggtgcagccccgggctgaggtgtagcagtcatcgaataccagccatacagtgagcagcttctataggcacaggtggcggagacgagtgccagggccccgggagtgcagggatagaggctgtaccaggcaacaagagccgaaaggaggcctggtgcaaccttgacaaggggacacgtgtgggggctaggccagatctaggtaccccacagaagcctacatgcaacaacgggggaccgacggagaagacgcttgggcccaaggatgtgatgtggcccacacgagaattggaggagagagaacacacactcacatgtgagaagcacatataaagaaccccaaaaacatagacagttgcgcctatagtgagtagacccgcccgaaattgaggccaaaacaacaaagtgacccgtaatgaaacacccgtgagagaggcccaccgtgggaccggggcaacagcagaggaggacagacgacgacaccatgagcaactgtgggggacaataacaactcatcacaacaacaaacatctcacgatacccctcatgagacgaaacgacagggggccccacgcaggagaaaagaaaaaatacacgagagggaaccacccttacgaattgacctaaaaacggggggccacggggaaaaaaaacgaaggacacg

SEQ ID NO: 540758 - DNA, 142 bp, Homo sapiens
catggcgcactgagtaggcgccagctgcgtgcagagcagtcgcctcgcaggagacagggcgtgtgagccctgtggcaaagcccctctctcttttagtcttagagtatgctctgtgatgaacagttacagcttcaaggaagga

SEQ ID NO: 540759 - DNA, 143 bp, Homo sapiens
cggggccgggcggcaccgcggtgcgcaagcgcaaccgttcggtgggtcggggatcggtcgcctgagaggtatcacctcttctgggctcagggatggacaccaagaagcgccgtggctctacgccatcatccgagttccgtgca

SEQ ID NO: 540760 - DNA, 111 bp, Homo sapiens
gaacaagcatgcaaccagcatctgcaagttaatcactggcatgtagttggaattatccccagctcagctgcttctccttctagacaagtgaggattctctgagagcaagag

SEQ ID NO: 540761 - DNA, 125 bp, Homo sapiens
tctcatagacggatccccatcagaaaagagacagaaatagcctatcagtgtcagtaatctagattataagcaaaactagcaatatagtcaggtagggcagtacatatcatacacggtgcacttcg

SEQ ID NO: 540762 - DNA, 440 bp, Homo sapiens
  misc_feature (66)..(66): n is a, c, g, or t
tgcagttcagcctgggcaaggcagagtgagactctgtcaaaaaaaaaaaaaaaaaaaaagaaaganaaagaaagaaagaaagaaagaaagaaagaaagaaagaaagaaagaaagaaagaaagaaaaagaaaaaaagaaaaagaaaatcagtgataggtgagacagctcatgcctgtaatcatagaactttggaggcagaggtgggaggatcacttgaactcaggagttcaagaccagcccagataacatagtgagtcttcttatctactgaaaagtatttttaattatgctacagtgctagtgtgtgcctctggtttcagcttatttggcaggctgaggtagaaggatcacttgagcatcggagatgaaggctgcaatgagctgagatggtaccactgcactccaggctgggagagagagtgagactctacctcaaaaaa

SEQ ID NO: 540763 - DNA, 6313 bp, Homo sapiens
gatgaccattgctacatgtgcaaagtgcaaaagtgttcacaagatctctcttcaagatttgcagaagggtacagggaaggacggtatgtatgtctgcttccagtgcagcctcggtgcagctcctcccaattttcattttgtgagcaataatcccagtgcgactcatgttggaaataaaactgaaaacttctcaagttctgtcaatagcaaatttaaggtaaggaactttaagccaggcaaatactattgtgataaatgtcgattctctacaaaggacccgctgcagtacaaaaagcacacccttcaacacgaggagattaaattcatttgttctcactgcagctacatttcgtatacgaaaggagagtttcagaggcatttggtgaaacacacaggcatatttccttatcagtgtgagtattgtgactatggtgctattagaaatgattatattgtcaaacacacgaagagagtacatgaaagggcaggtgcgaaacggccagtcaaagctgttgccaagctggagccaaaaagaaccggaacttcaaaacaaaacccagagcttctaaaagcttccaatccacggactacatttcaaaataagtggtcagaccaactgtcaggtttctctctccatgcaaataaagacaaaatgcacaatatcatgttgttacctgaaccaaaggaataccaaaaagatgtagtttgtattccaaataaaatgaccctgtctgagccaaatgaagtcaacctatttgagaacaaaaatgttgaagtagaagtgttatcccctgcaaaagaacctgttcagccaggtatgccattgacagttgttgcaccagcagaactagttgtccctgcaaactgtttagcccagttgatagacgtgaaggttgtcaatggtacacagcagcttgttctgaaactgtttccgctggaagaaaataattgccttgaagctgggagggataatggaggtaattctgaacgtatggtgaaagagaagggttcaaatgaacaagaaaaagtactttctgcagaaaaaacaaagtcactgacagttgacgggaatgttggaaaactcgtaggcattgatagttttcaaccttcagttcagaaacagcttaaaaatgtgaaatgggtaaggtcttatgattttattatgccaaattctagtgtgcacaacaatggaaaatccttcattaattcggaaacaattgaggattttcagaaaaaaaataatttgtatccacatagaactgcttttccttccgttgccttaaaaggtcattctctagcatctgtatttaaaaacagtgttttacgtagtcttggagctgcatcaaacccttttccatataaagctgctgtttgttttgctgaaagtggaagaaatttacacagtaactcacagcagttactcccatttgctgcatcacctgcaacctgttccttctctggagaaaagggcttattgcctgtaagtgaaaatgacttggaatctacaagtaaagtcaatattcctgtaaaagtggtttcctctaataggaagcaggaagataaccagacagaggaacacaaggcagtttcaactgtaggccagatttcctctcaacataagagtgagtatttacatataaacataactggagaagatagatctcaacagcctggggataagcctttggaattaaagaattctgaaaggactaacaacactaatgatggcccagtcatctcatcagtattttctctgagctctggatctgaaaatgtccccgagggcattaagtggaatagctcaacgtctaaaataaagtcaattgaactgttgcgcagaaagatagctcagttaattgagtcctgtgggaagccgtcatctttggcttcaaatagtgcacatcgtcgctctgtagggcaggcatcaaagggaacttcaaaagctacctctgaaggtattcaagaaatcaacgtgtcactcactggtcttggccattccacaggtactcttcagaaacctccgaatgatggtggtattactggtaatagacagcttactcatcaacaaatatatccacactttgcagatggcagtaataggaaaaccaaaagcagagtggtccaggaggctcatgttgccacgccagtgttaatccccaaaggggctgtgttgagggtcttaattcctctgagaatgcccacatcatagaggctacatgtgaagcacctgtcagcataccttgcagtgaaagacagttaataaaaccaattccattttgccctgtgagacaggcggactcagacttacagcctttaagaagtgaaagggggccaatagatatgtccccaaatatcgagacacctctgcggcctaaactgagaaaagagagtgctgtctgtagcaccatccatagaaaaactggcctcttgtatggacagcaaggaagcagtgaattaaataagcaagggagactgctttccagaagtctttctataagtagaaataaaaccaaacaagtacacttatccaggaagaaaaacaaaattcaagctgaacctagccgctgtctcaaggatccttcaatttttcaggtagcaaggcaactaagactgatagcagctaagccagatcagttgattaagtgtccccgtcggaaccagccagtcattgtgttaaaccaccctgatgtggactcgccagaagtgaccaatgtgatgaaggtaataaataaatacaaaggcaatgtcctcaaagttgttttatcagagaggactaggtgtcagctaggcatcagacggcatcatgtacgcctgacctaccagaatgcggaagaagccagtcaaattaaaaggcaaatgatgttgaaaatgaaactcaaaaatgtctctccactgaaccaaaggaatacaggtagtggattccttgcctgatgattcttcacagtgtgtatttaagtgctggtcttgtgggcgactgtatgaagaccaggaagagtggatgagtcatggccaacggcatttgatagaagcaactagagattgggatgttctttcctccaagggcaaataagtaaacagttactctttaaagcaagttatcttttagtttattctggtttggagtccctccaccaagattcagtagaagaaatacagactgtagaaatgagaggactgctaattcttcagaactgtaggaatattgggagctaggagtctgaacctgaagtatgtgattggaccccagaatgtatttgaaggctctgaaattgtacatgcaaattggtacatatgcatttttctggagagagcctgtgaaactgaacagattttcagtgggatctgagacttttctttgtttagcaccccgttttctgagtacatactgatctttcataatccattcagaggggcagattgagaatgttttacacatgctcttcatataaatgctacagaaaaacctttgttttggtgtgcacatccattttgtttttgctttaatttgtgttctgagtatttggtgcacaatggaaattatattttctactttactgtcttcaatttggttatagagaaatggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattcctgtcttaggcgatttgtggggtgcagtgaatgaaactaaagagttgttgcacctgaaaaagacaccagtgattgtttattgggtagtcgattggagactttgatttttttttttttttttttcacatgggaaagtcttagattccagtagatggaattgcaatcctttgcagtttgttctcattacagataatcaacatttcttttgtataattcaatacatgatcatcaagttaattggtaaatttttattgaaatttaaaacttgcatttttatatatgtgtatgtgtacacataaaaatattttttaccatatgaaaattgcagtagctaattttctgatttcctattttataatgatacatgggctggaaaaatgtagaacgtttttatattctagaaatttattttggaagtacatttttataagggtctaatctcacttttggaaaatgaaagcacaggaatgatggggtctggtttatgtgaacaagtgagtagaaacccctttggatcattttattactgcatttttatttggtgctttttaggaagtagatctttggtaccacttcactacgtaaagtagagcattcgaagttttatccatgttatatattgtactcctgtggcatgaaaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagttaaaaaaaaaaaaaacctgacccaaagtatactctgatagactatattatattcaattttgtatccccagtcgagaacatcttgtaagccttcattaagggccacctgctgtctgttgaactagactgaacaaaatatattttctcacaagctccatccctttttctttaggacatgttatatataatccatctcagaagttgaagatgtgatgttgctcggcctttggaataatttttaaatctgtaaatgtctatatgagcagaaacaaaacattgtgtaacatgttttaagcattattgtaattcctgtgttaacagtttgtgtgtctgctgctctggttttgaaacatgtttgtatatagatacaggagttggcataaattttgttaaataaagcaacaaaaattttctttgccctttgaaaaaaaaaaa

SEQ ID NO: 540764 - DNA, 171 bp, Homo sapiens
ggtgatctgagaggccccggtcacaacaggcgaggagggtacttactattgcgaagcaggaaaagtcatccctattgcctggtggtgccggcacttaatatgatggggtggaattggtcagtataccgctcgtgctggtgcaaaattaaataaatatttctcttaccttat

SEQ ID NO: 540765 - DNA, 5880 bp, Homo sapiens
gatgaccattgctacatgtgcaaagtgcaaaagtgttcacaagatctctcttcaagatttgcagaagggtacagggaaggacggtatgtatgtctgcttccagtgcagcctcggtgcagctcctcccaattttcattttgtgagcaataatcccagtgcgactcatgttggaaataaaactgaaaacttctcaagttctgtcaatagcaaatttaaggtaaggaactttaagccaggcaaatactattgtgataaatgtcgattctctacaaaggacccgctgcagtacaaaaagcacacccttcaacacgaggagattaaattcatttgttctcactgcagctacatttcgtatacgaaaggagagtttcagaggcatttggtgaaacacacaggcatatttccttatcagtgtgagtattgtgactatggtgctattagaaatgattatattgtcaaacacacgaagagagtacatgaaagggcaggtgcgaaacggccagtcaaagctgttgccaagctggagccaaaaagaaccggaacttcaaaacaaaacccagagcttctaaaagcttccaatccacggactacatttcaaaataagtggtcagaccaactgtcaggtttctctctccatgcaaataaagacaaaatgcacaatatcatgttgttacctgaaccaaaggaataccaaaaagatgtagtttgtattccaaataaaatgaccctgtctgagccaaatgaagtcaacctatttgagaacaaaaatgttgaagtagaagtgttatcccctgcaaaagaacctgttcagccaggtatgccattgacagttgttgcaccagcagaactagttgtccctgcaaactgtttagcccagttgatagacgtgaaggttgtcaatggtacacagcagcttgttctgaaactgtttccgctggaagaaaataattgccttgaagctgggagggataatggaggtaattctgaacgtatggtgaaagagaagggttcaaatgaacaagaaaaagtactttctgcagaaaaaacaaagtcactgacagttgacgggaatgttggaaaactcgtaggcattgatagttttcaaccttcagttcagaaacagcttaaaaatgtgaaatgggtaaggtcttatgattttattatgccaaattctagtgtgcacaacaatggaaaatccttcattaattcggaaacaattgaggattttcagaaaaaaaataatttgtatccacatagaactgcttttccttccgttgccttaaaaggtcattctctagcatctgtatttaaaaacagtgttttacgtagtcttggagctgcatcaaacccttttccatataaagctgctgtttgttttgctgaaagtggaagaaatttacacagtaactcacagcagttactcccatttgctgcatcacctgcaacctgttccttctctggagaaaagggcttattgcctgtaagtgaaaatgacttggaatctacaagtaaagtcaatattcctgtaaaagtggtttcctctaataggaagcaggaagataaccagacagaggaacacaaggcagtttcaactgtaggccagatttcctctcaacataagagtgagtatttacatataaacataactggagaagatagatctcaacagcctggggataagcctttggaattaaagaattctgaaaggactaacaacactaatgatggcccagtcatctcatcagtattttctctgagctctggatctgaaaatgtccccgagggcattaagtggaatagctcaacgtctaaaataaagtcaattgaactgttgcgcagaaagatagctcagttaattgagtcctgtgggaagccgtcatctttggcttcaaatagtgcacatcgtcgctctgtagggcaggcatcaaagggaacttcaaaagctacctctgaaggtattcaagaaatcaacgtgtcactcactggtcttggccattccacaggtactcttcagaaacctccgaatgatggtggtattactggtaatagacagcttactcatcaacaaatatatccacactttgcagatggcagtaataggaaaaccaaaagcagagtggtccaggaggctcatgttgccacgccagtgttaatccccaaaggggctgtgttgagggtcttaattcctctgagaatgcccacatcatagaggctacatgtgaagcacctgtcagcataccttgcagtgaaagacagttaataaaaccaattccattttgccctgtgagacaggcggactcagacttacagcctttaagaagtgaaagggggccaatagatatgtccccaaatatcgagacacctctgcggcctaaactgagaaaagagagtgctgtctgtagcaccatccatagaaaaactggcctcttgtatggacagcaaggaagcagtgaattaaataagcaagggagactgctttccagaagtctttctataagtagaaataaaaccaaacaagtacacttatccaggaagaaaaacaaaattcaagctgaacctagccgctgtctcaaggatccttcaatttttcaggtagcaaggcaactaagactgatagcagctaagccagatcagttgattaagtgtccccgtcggaaccagccagtcattgtgttaaaccaccctgatgtggactcgccagaagtgaccaatgtgatgaaggtaataaataaatacaaaggcaatgtcctcaaagttgttttatcagagaggactaggtgtcagctaggcatcagacggcatcatgtacgcctgacctaccagaatgcggaagaagccagtcaaattaaaaggcaaatgatgttgaaaatgaaactcaaaaatgtctctccactgaaccaaaggaatacaggtagtggattccttgcctgatgattcttcacagtgtgtatttaagtgctggtcttgtgggcgactgtatgaagaccaggaagagtggatgagtcatggccaacggcatttgatagaagcaactagagattgggatgttctttcctccaagggcaaataagtaaacagttactctttaaagcaagttatcttttagtttattctggtttggagtccctccaccaagattcagtagaagaaatacagactgtagaaatgagaggactgctaattcttcagaactgtaggaatattgggagctaggagtctgaacctgaagtatgtgattggaccccagaatgtatttgaaggctctgaaattgtacatgcaaattggtacatatgcatttttctggagagagcctgtgaaactgaacagattttcagtgggatctgagacttttctttgtttagcaccccgttttctgagtacatactgatctttcataatccattcagaggggcagattgagaatgttttacacatgctcttcatataaatgctacagaaaaacctttgttttggtgtgcacatccattttgtttttgctttaatttgtgttctgagtatttggtgcacaatggaaattatattttctactttactgtcttcaatttggttatagagaaatggccattcttttactccctccctggttttgtaatactcccgagtgttccgtatagcacaaagagttttgcttttactggccattttaaagaatgttttcaactgcttgcctgaatttactcctttcacagcaagtgttagaagaaagataacattttcaaatacttagcttttgctttctttaaaatacattggtttatgacatatgggaagggaacgtacctttttgcaaagacaaaaagagattacaaaaggaaaatatctaaaactattttctctttgcccttaccactcccagaaacataagtgaccaatttaaaatgctagggaacaggcttacaacataggtaaaactcgcaaacacagttcaaggtaggctcataaagttgtgaaaagggtttcatatgccctttagttttcatttgggattcatccaaagaccatgggtggatgctgtcttctctcttcttgatccctttgattcatggacactagactccctttgccatttcttctgaaccggccctcctgtggactagcacaacttccttgcccactgtttcttcctttctgtgcctttgagaccccttaaggttttccctcatgcgattactagaaaatggcaggaatcaacaaaatggagacctcccactgtttttgctaaagttacaggaacacgatccctagttttcattgatagtaacgctgtttctaatttgtcttaaccacattcatgcttaccctgctgctcagctttctcagggaagcaactccaggaacactccttccactcccctctctaccaacagatgtcaggactgtcatttatctacacatttgtgttctttagaaaaaggcccaccccctgcacaagcacagcctcttgggcagataggtggctgggtcagtgcttaagacaggattctagtcttcacttgcctgtgcagctgggcgctgaccttccaggtagagcacagatggcacaaccccgaggcagccccaacttgcatttccctccctccaggggctattcctgtcttaggcgatttgtggggtgcagtgaatgaaactaaagagttgttgcacctgaaaaagacaccagtgattgtttattgggtagtcgattggagactttgatttttttttttttttttttcacatgggaaagtcttagattccagtagatggaattgcaatcctttgcagtttgttctcattacagataatcaacatttcttttgtataattcaatacatgatcatcaagttaattggtaaatttttattgaaatttaaaacttgcatttttatatatgtgtatgtgtacacataaaaatattttttaccatatgaaaattgcagtagctaattttctgatttcctattttataatgatacatgggctggaaaaatgtagaacgtttttatattctagaaatttattttggaagtacatttttataagggtctaatctcacttttggaaaatgaaagcacaggaatgatggggtctggtttatgtgaacaagtgagtagaaacccctttggatcattttattactgcatttttatttggtgctttttaggaagtagatctttggtaccacttcactacgtaaagtagagcattcgaagttttatccatgttatatattgtactcctgtggcatgaaaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagtt

SEQ ID NO: 540766 - DNA, 1191 bp, Homo sapiens
tgggagctatttttcatgccacaggagtacaatatataacatggataaaacttcgaatgctctactttacgtagtgaagtggtaccaaagatctacttcctaaaaagcaccaaataaaaatgcagtaataaaatagctcccaagatatagagaggagaggagtgaagaaaaggctgtggtttttttttgttttgttttgtttgccacttttttatctcctattcctcaccacatagtgctttttcctgaaaagctggactgagaattggccttgaatcaggtcagagtgttaactgtcaacatgaagtattttcacttcgcagcatcaactttcaagcataagtaaaaacacaacttgcatactttgatggagcttaattgtgtgagtagaatatgtagcaaagctttttaggattttcagaactagaatactttttaaggaattaaaagtgtttctggaagtcaaaaatgggaaagcaaaaagtagctgtcctccctaaagagctttagaagatagcttaacctgtaggtacatgttatgaaataaacacatttctaacaatacaagggagtaggggcagacctgtgttgagtatttgtgtgggttcttaattttgaaggacctccaatcactacattttgttaatactgccaataaaatcattttcaacttattttttaaagtaggttttcttactttggtggaccagaagtgagagattgttatatttaggatataggcaaatacagtaaaagttaaaaaaaaaaaaaacctgacccaaagtatactctgatagactatattatattcaattttgtatccccagtcgagaacatcttgtaagccttcattaagggccacctgctgtctgttgaactagactgaacaaaatatattttctcacaagctccatccctttttctttaggacatgttatatataatccatctcagaagttgaagatgtgatgttgctcggcctttggaataatttttaaatctgtaaatgtctatatgagcagaaacaaaacattgtgtaacatgttttaagcattattgtaattcctgtgttaacagtttgtgtgtctgctgctctggttttgaaacatgtttgtatatagatacaggagttggcataaattttgttaaataaagcaacaaaaattttctttgccctttgaaaaaaaaaaa

SEQ ID NO: 540767 - DNA, 143 bp, Homo sapiens
gttacagaagtttcgttccagacatggtcctggcttctgctcggaagcgaggcaggcatcgtaggaggtgagagttcctcaggtgaccgtccaagccggtccacctgacagccttcctaggatcaaggctggcatgacttaca

SEQ ID NO: 540768 - DNA, 170 bp, Homo sapiens
  misc_feature (6)..(6): n is a, c, g, or t
aaaaanggggggttttttaaaaaaaaaaattccccccccccctgggggggtttttttttttcccccccccccaaaggggggggcccccccccgggggttggggggggattttttttttttttggggcccttttttacccccccttttttttgtgggcggggttttcccca

SEQ ID NO: 540769 - DNA, 694 bp, Homo sapiens
cgtcgctctttacttgcagtccccggtcctgtgtccggttccccagttcgggggcactttggtggtttaatccccgcaggttttgtgtacactcccgtacgccctttggtgaggagacttttaaatggttcttttgatctcttgtatctggatgcacgctccggagttattgaggccacccgttagtttcacgttatctccaggttaactgggagaggttctgtggcccgctgtgttatctgtacctgcccaccacaggatgtaccccttcccattgaagaattttgaagctgttggttgtcctgcgtgcggcggcccagtgtacctataaccctggtgtgtttcgtggcctccatttgttttgcctgggcacaatgttagtatggccctgtgtgcactcagccagtgggacacacacctgtagagtggccagcgagggctgtgtctagctatgaagtgtggatctcaagagccctgtccagtagagtagaagtcttcctttcccagtgtgctttgcccttcgtttcttaccctgctggggaaagtaccaccgtggataccccttttctgacccagagagaagccaaatctccacggtcaaaatagtgccccaaacggttgagttttgactgcttggaactggaatcctttcagcaacagattttctttgcctcaaataaaagtgcttttgtga

SEQ ID NO: 540770 - DNA, 177 bp, Homo sapiens
tatctagagtatcccctccacacagcactaggatgcagccacggacacgcaggtggctggtcagcgcttgtgctggttctcactactcttccagatttattctctccaacaaaaatgtcggagcttgtgcaacacgggattatccagtcatgctcatttgatgttctacttccacgg

SEQ ID NO: 540771 - DNA, 351 bp, Homo sapiens
gggttagacttgttgcttcctgatcatgacggatgttgagcatggtttcatttgtttattggacatttgtatattgtcttttgtgcattgtctattcatgtccttagcctactttttgatgggattgtttcttttttcttgctgatttgtttgaattccttgttgattttgaatattagtccttcatccaatgcatagtttgtgaagattttctcccatgctgtgcattgtctgtttgctccttacttcttttgctgtgcagaagctttttagtctaattaagtcccatgtatttatctttgtttttgttgcatttgcttttgggttctctgtcatctgggtaccgagctc

SEQ ID NO: 540772 - DNA, 401 bp, Homo sapiens
tagttgggattacaggtgccccccgcccccacaccatgcctggcttaattttcgtatttttagtagagatgggcttttaccatgttggccaggctggtctcgaactcctgacctcagatgatcctcccactcggcctctcagagtgctgtgattacgggtgtgagccaccatgcctggccattcttaagatcaaatggctacaaagttggcggctcaaggaactgaactagacattggaaccatctagggctcagtttataaccgatatgctatacggctgatgggagagtcaaatgaggacatgtgacacgtgtatgtagacacttctcatgaaacgttagccatctcatataactgagatagaacattctgcggacactgggatggcctagtagagcag

SEQ ID NO: 540773 - DNA, 158 bp, Homo sapiens
gcactgcaatacgaatcatgtctggtcgccgtaaaggccgtaaatgctcgatgaacggtggggctaaccgccatcttaacgtgctctgcgataacatccatggcattacataaccagatattcatcgctaggctctgctcggtggcttaaagcgcatt

SEQ ID NO: 540774 - DNA, 161 bp, Homo sapiens
  misc_feature (102)..(102): n is a, c, g, or t
ggacgagcctgctccgacttgttgttgtgtcgtgtccctgtgttgtgtctgcgtgtagatttatttgtttatcccgctttagggttcgcggaacctctgtgncgcttgttattttggggaagtcaatattctttaaacattgccggggctcatcatccatc

SEQ ID NO: 540775 - DNA, 209 bp, Homo sapiens
  misc_feature (16)..(16): n is a, c, g, or t
  misc_feature (26)..(26): n is a, c, g, or t
  misc_feature (43)..(43): n is a, c, g, or t
  misc_feature (46)..(46): n is a, c, g, or t
  misc_feature (72)..(72): n is a, c, g, or t
  misc_feature (79)..(79): n is a, c, g, or t
  misc_feature (111)..(111): n is a, c, g, or t
  misc_feature (115)..(115): n is a, c, g, or t
  misc_feature (138)..(138): n is a, c, g, or t
  misc_feature (145)..(145): n is a, c, g, or t
  misc_feature (155)..(155): n is a, c, g, or t
  misc_feature (167)..(167): n is a, c, g, or t
  misc_feature (173)..(173): n is a, c, g, or t
ttataaatcaaaaatngtcaaggttnagcatattctgatatgnagntcacaaggtggtatcgttttagattnctatganggctttcatttgtacatccctttgaataaatntatncagatttaaaatgttttgaattnaacttgnttagaaaagnctaatgattaanacaatntttgaactactgctatttataatttgttacctctaa

SEQ ID NO: 540776 - DNA, 134 bp, Homo sapiens
  misc_feature (40)..(40): n is a, c, g, or t
  misc_feature (71)..(71): n is a, c, g, or t
  misc_feature (99)..(99): n is a, c, g, or t
cggtctgttctcagattcctaatcattccagaagtattanacgtcattgctgcaaacctcggcaggtgctnatcgaggggcttaatgaccaccacaggnagctcagaccccaaccctggatcccaggagaaagg

SEQ ID NO: 540777 - DNA, 813 bp, Homo sapiens
agtgtcgcacgaaagcccttcactccaggccgcaattaaggttctaggtacgaggcctgtgctgtgctgtgatgaggttgcagcgcagcttcgtggagcatagtgctgcagtgactgcagtgcaagctggcacgggcaccggccgacccttggaaagccggggtccccggagttgcagctcccgtgagctccgtgctggctgtgctccacctgtgcgaaagatgatcccgtgagtgtcctagtgtgacccacgcagcctgtgcggcgctatgttgcggggcctgcttttttgggcaatggtgctggctttgccaatgtgcttcgagatctacggacgcggacaccaaggaggtgttcgcgggcaagattagtgcctaagtctctgctgctcaagccgcaccagagggagaagatgtccattggaaatatccattcaccgcagcctcgcccaccagcacgtcgtaggattccacggctttttcgaggacaacgactatcgtgtatcgtgggtgtaggagctctgccgccggaggtctctcctggagctgcacaagaggaggaaagccctgactgaggcctgaggcccgatactacctacgtgcaaattgtgcttggctgccagtacctgcaccgaaaccgagttattcatcgagacctcaagctgggcaaccttttcctgaatgaagatctggcaggtgacacataggggatttgggactggcaaccaaagtcgaatatgacggggacaggacagaccgttttggactcttattaactagctccgaggtgctggcacgaagggccagctcacgt

SEQ ID NO: 540778 - DNA, 116 bp, Homo sapiens
ccgttcgatactggaagcgatgtacaagaagctggagaagcgatgagaaacttatttctatgggacagagtcttttttcttttaactgtggaaggaatgtctatataaaaccgtga

SEQ ID NO: 540779 - DNA, 264 bp, Homo sapiens
ttttttttttggcggggggggggttttttttttggaaatatttttttagtttaattacccctttggggggttgggcaaaattaaaattttttaattttaagggttttcccccggggtttttgggggtggggaaaaaaaaaagggaaaaaagaaaaaaagttttttcccggggtttgtttttttttttaaaaagaaagaaaaaagaattttttcctggccctttttcagacttgccgtttaccgcctttaagggttttcccccga

SEQ ID NO: 540780 - DNA, 284 bp, Homo sapiens
cacccaggcgcacttctgcacccggcccacttctagtagctgatggtcttaccagtcaggatcttcgtgaatacccgtgacatggtaaggcaccatcactcttcgcaagtggagccgagtgacaccagttgagaatgtcaaggcaaagatccaagacaaggcaaggcatccctcctggaccagcaggggttgatctttgccggcatccaccgcctggaagatggctcgctccctgttcctcgacttactgcatccagcaagtgcgcctggggtgcgcaccccgg

SEQ ID NO: 540781 - DNA, 231 bp, Homo sapiens
atacatggtgagaagatgaaccgggagatatggagtccctggcgagtgtgagtcctagcattgcaggaggggagaccctggaggagagagcccgcctcacttgatgcctgcagattgaataaccacgaggcttaggaggaggaagttctccaatgttctagtctccagagcactatgctcaagaagccctgtattcaggaggctaccatttaaagtttgcagatagagctg

SEQ ID NO: 540782 - DNA, 865 bp, Homo sapiens
  misc_feature (21)..(21): n is a, c, g, or t
  misc_feature (35)..(35): n is a, c, g, or t
  misc_feature (89)..(89): n is a, c, g, or t
  misc_feature (92)..(92): n is a, c, g, or t
  misc_feature (110)..(110): n is a, c, g, or t
  misc_feature (158)..(158): n is a, c, g, or t
  misc_feature (167)..(167): n is a, c, g, or t
  misc_feature (173)..(173): n is a, c, g, or t
  misc_feature (218)..(218): n is a, c, g, or t
  misc_feature (242)..(242): n is a, c, g, or t
  misc_feature (257)..(257): n is a, c, g, or t
  misc_feature (308)..(308): n is a, c, g, or t
  misc_feature (486)..(486): n is a, c, g, or t
  misc_feature (488)..(488): n is a, c, g, or t
ggcaagcgcagacagacagancttgagagagcgcncgcgagatggcagcctccatgatcacctcgccgattgtggcgccgacgagcgtnccntccctctcccgccggggntcctccttcgccgtcgtctgcagcggtggcaagaagatcaaggtcganaagcccctnggactnggaggcggcttgacagtcgacatcgacgccaacggcaggaaggtnggcaagaagggcgtgtaccagttngttgacaagtacggngccaacgtcgacggctacagcccaatctacacgccagaggaatggtctgantctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctncntagctacctcctgtgaatgtatgcaatcaacgatgcaaagtaattgatccgaacaaaaaaaaaaaaaaaaaaaaaacaaaaaaaaaaaaaaaaacaaaaaaaggggggggggccccccaaaatcccccgcagagggggccccccaattatacgacgtctccccgcaaatgtcgcgtgcgaccaaagagggggcccccacttgatagaggcggcacccctattataaagacgcgcgaacaggcgcaggggggcgcgaggagaataaacacaggcgggagcataggcgggggacacactgctgccaagcggcgaccaccggggagaaaacacccctcaacgcggggggggggcacacatcaggcggcccacttcacaga

SEQ ID NO: 540783 - DNA, 216 bp, Homo sapiens
tccccttcctgtcagatcagtatacagttggaggtaaactaccccatcctcaaaccccggaaagcaaagcaaatcaggaaaaaaagtggaggttagcaacacccctgtggccccaaaggacaaccattttgttaattattgattccagtgacctgactccctgcaagttatcgcctgtaacatttgtaataaaggttttttgacatgaaaactgga

SEQ ID NO: 540784 - DNA, 669 bp, Homo sapiens
  misc_feature (21)..(21): n is a, c, g, or t
  misc_feature (35)..(35): n is a, c, g, or t
  misc_feature (89)..(89): n is a, c, g, or t
  misc_feature (92)..(92): n is a, c, g, or t
  misc_feature (110)..(110): n is a, c, g, or t
  misc_feature (158)..(158): n is a, c, g, or t
  misc_feature (167)..(167): n is a, c, g, or t
  misc_feature (173)..(173): n is a, c, g, or t
  misc_feature (218)..(218): n is a, c, g, or t
  misc_feature (242)..(242): n is a, c, g, or t
  misc_feature (257)..(257): n is a, c, g, or t
  misc_feature (308)..(308): n is a, c, g, or t
  misc_feature (486)..(486): n is a, c, g, or t
  misc_feature (488)..(488): n is a, c, g, or t
ggcaagcgcagacagacagancttgagagagcgcncgcgagatggcagcctccatgatcacctcgccgattgtggcgccgacgagcgtnccntccctctcccgccggggntcctccttcgccgtcgtctgcagcggtggcaagaagatcaaggtcganaagcccctnggactnggaggcggcttgacagtcgacatcgacgccaacggcaggaaggtnggcaagaagggcgtgtaccagttngttgacaagtacggngccaacgtcgacggctacagcccaatctacacgccagaggaatggtctgantctggtgaccgctacgccggcggaacgaccgggcttcttatctgggccgtcaccctcgccggcctcctcggcggcggcgtcctcctcgtctacaacaccagcgctctcgccggctaagagagcatctacgtgtaacacagggccgggtctctgcttgcatgcacgtctctgtaatctncntagctacctcctgtgaatgtatgcaatcaacgatgcaaagtaattgatccgaacagatggtttatgtgtatgtacgtaacgctgtaacgatatacttcctactttggaaactggtacaagggcggcatctctggcagcccaaacaacaacccaacacacacccacaacaaaaccaaagggc

SEQ ID NO: 540785 - DNA, 343 bp, Homo sapiens
  misc_feature (85)..(85): n is a, c, g, or t
  misc_feature (227)..(227): n is a, c, g, or t
  misc_feature (233)..(233): n is a, c, g, or t
  misc_feature (241)..(241): n is a, c, g, or t
  misc_feature (247)..(247): n is a, c, g, or t
  misc_feature (250)..(250): n is a, c, g, or t
  misc_feature (256)..(256): n is a, c, g, or t
  misc_feature (303)..(303): n is a, c, g, or t
  misc_feature (315)..(315): n is a, c, g, or t
gagcccagaggttgccaaggacccctctgacatccggcctgcttcttctcacatgacaaaaactagcccccatctcaaatcattnttaccaaaaatctctccctcacttaaaacggtaagggccctttctccctcacttcttcttcaaatcctttaatcccaatcaataggccaggggcaggtttggaggggtggggaatttaaaacccaaaaaccccaaggcttancggccnggggaatnggaaanttnaattanggccaagggtttccttaccccggtacccaaaccccctttaaacccantaaaacccccantttccttttaaaatttttaaaaccttaa

SEQ ID NO: 540786 - DNA, 374 bp, Homo sapiens
gggttttccccggaaagtgttccaaagcagggccgcaagggcgggcccttccgcctccccggcccccttcgttgtgggaaaacaggtttcgagaaacccaaagttttcgccttgggggtccccccccaggggctggggttgcccgtcccaaaaagttttccccggggggggggtttgggggggaagggcccccccccggtccccggtttccgcctggccccccccccccctttgggctttggcccttttttccccggggggccccccccctttgggggcccccgggtttttttttcccccccccccccccccccccttgggtttttttttggtaatgttggggggggatggattaattaaggggtttttttcca

SEQ ID NO: 540787 - DNA, 1407 bp, Homo sapiens
  misc_feature (1121)..(1121): n is a, c, g, or t
ggccccctgcccctcgccgcccgccgactgcctgtggccgggccgaggatgcggctgcagcggcctcggcggccaggcttgctcccctcctggcactgcctgctaacttcgcccgcgtacgtccccggttcgccctgcctgggcctgcccgtctccccggcgccctccgggtcgggtcctccaggagcgccaggcgactgagccgccgatgatgcccatccggccgaatcgtccgacgcgcccgaggctccacgagctgacgcccagagaccccgaagacacaggagccacagacactcaaggcggacaatgcatgacgcactcgtgcacctacgatgggcacggacacatggcatggctggggacgaccagaggcccacgggagcgcggaggcacatgggggcaggagcaggacaagagcgccaagtacccagaatggagacaccggacgcccattggcattcccagaagggacaggaaaagcctatgggacagccagacgtggcccgagacccacacacaccacaggtatagagagacccatggccggaagagagcaaggccatggaggattggccggaacggaaaggccacgagggagcacattaggctggctagcaatgggacaaaggacaaagcacacagagagataagagacagacaccactatgaggggacacatataatgacacgaaggcaatattggccacaccaattggcatacaacgggaattggataaacaaaacacaccacgcccaccaggaactagcccgggggaccaacagaaggagccccattggacagaaccgtcggaaaaaacgaccaccaggacacccccaagacagaagagacgacggcgaaaagaaaaaaggacaccacccgatgaggagagacaaaccaagactatgacgacgttacacaaagccgggaggaccaaagcacgcggcaagcatcttgattgcaccattcggcgacaggaccgtagcgagccgggcgagaggaacctcagggcaaggggaccacacatgcagccaaagagggaacacaaagagacccctagggcacaggaccacccatgccattcgaacacccacatatggacgaacacagagacaagagngagagatgggaaacacacaaacaccaccacagaaaagacacaacaaagggacagtacacaaggcgagcacaccagtgcgaataaggcagtaggcaaccagactagaacaccgaggcaagaggcatagaccccatagaccaagaacaaagacacaaaagtattccagccgcaaaaaaaaataaccgaacagaaacacgagaaagagcaaccaaagagagtaagaaggagcaacaacagtagatgaaacagcagacacacacaatcgggaggagagaaggacacccac

SEQ ID NO: 540788 - DNA, 180 bp, Homo sapiens
ttcttgaatgcttgtcaaattaagaaagttaaagtgcaataatgttgaagacaataagtggggtgtatctgtttctaataagataaactttttgtcttgctttatcttattagggagtgtatgtcaggtataaaacatactgtgtggtataacaggcttaagtaaatactttaaaaagga

SEQ ID NO: 540789 - DNA, 159 bp, Homo sapiens
agtcggattgtgggttttcctcgtctcatcggtgatcgcctatcccgcgatgtacctgttccagatctattcatcaacacattggccgaatcagccaatgcaaggactaccctagcgtcatctcaggttatctgggaaagaactggggcttttttatcg

SEQ ID NO: 540790 - DNA, 2161 bp, Homo sapiens
taagccagtggctgcctttttctgagcccgggccggggccgaaggcgcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggaggcggcccaggggtaccccaagatggctgctggcctgaatgccacaggccgccccatcgccttctcctgcagctggccagcctatgaaggcggcctccccccaagggtgaactacagtctgcaggcggacatctgcaacctctggcgtaactacgatgacatccaggactcctggcggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaagggatcctggatgcctaagggatcctgcgtccctggatgcctaagggatcctgggacgcaggattcacaaggaaaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcgtgtgattggcttttctacccatagagggccttgcagcctgataccacctgggagtgagggtcacaaaggagaccttggctccctcaggtcaccaataaacctgttctttaatc

SEQ ID NO: 540791 - DNA, 2089 bp, Homo sapiens
taagccagtggctgcctttttctgagcccgggccggggccgaaggcgcccgtaggccctcgggactcccagcactgcagagggtgtgaggtctgacatccaagacacgttgtttcgtatttctgaaggaagaactcaagctccgggaagtgatggctggggatggggcgggcaacttggggaccgagtgtacgatccacgcctaaggttgagggcggccgagctagccaggcagccgtgaccccagtgcttttcagacgtttcttagcttccagagcccaacacatacagctgatacacgcagaccagatctggtcaggtcctcggaagctgagtccagagcgatgctgctgaagacagtgctcttgctgggacatgtggcccaggtgctgatgctggacaatgggctcctgcagacaccacccatgggctggctggcctgggaacgcttccgctgcaacattaactgtgatgaggacccaaagaactgcataagtgaacagctcttcatggagatggctgaccggatggcacaggatggatggcgggacatgggctacacatacctcaacattgatgactgctggatcggtggtcgcgatgccagtggccgcctgatgccagatcccaagcgcttccctcatggcattcctttcctggctgactacgttcactccctgggcctgaagttgggtatctacgcggacatgggcaacttcacctgcatgggttacccaggcaccacactggacaaggtggtccaggatgctcagaccttcgccgagtggaaggtagacatgctcaagctggatggctgcttctccacccccgaggaggcggcccaggggtaccccaagatggctgctggcctgaatgccacaggccgccccatcgccttctcctgcagctggccagcctatgaaggcggcctccccccaagggtgaactacagtctgcaggcggacatctgcaacctctggcgtaactacgatgacatccaggactcctggcggagcgtgctctccatcctgaattggttcgtggagcaccaggacatactgcagccagtggccggccctgggcactggaatgaccctgacatgctgctcattgggaactttggtctcagcttagagcaatcccgggcccagatggccctgtggacggtgctggcagcccccctcttgatgtccacagacctgcgtaccatctccgcccagaacatggacattctgcagaatccactcatgatcaaaatcaaccaggatcccttaggcatccagggacgcaggattcacaaggaaatctctcatcgaagtgtacatgcggcctctgtccaacaaggctagcgccttagtcttcttcagctgcaggaccgatatgccttatcgctaccactcctcccttggccagctgaacttcaccgggtctgtgatatatgaggcccaggacgtctactcaggtgacatcatcagtggcctccgagatgaaaccaacttcacagtgatcatcaacccttcaggggagtgatgtggtacctgtatcccatcaagaacctggagatgtcccagcagtgaggagctgggacatgtgacaggctgtggtggcaccactgagcctagaccatggagccttggcatgcccagggcaagtggggaggttctctgctccccaggcctgctcggtgactgaccccatcatacccaaagtgcaatctcacggccaggttctatgccctgtccaagcgtaaaccctcttggaaacttcttttggggcaattttcctgtggccttcctggcctctacttccatgtgcgcagccccacagacgttgctgagcaactcgccagcctcctgagctccatgcccatcaggactctagcctctgaccttgctgttgactctgaaatcaggatttggaagttttcgaattaggagtagagagatctgacctcttgccaggaatgcccatggatcgtgtgattggcttttctacccatagagggccttgcagcctgataccacctgggagtgagggtcacaaaggagaccttggctccctcaggtcaccaataaacctgttctttaatc

SEQ ID NO: 540792 - DNA, 202 bp, Homo sapiens
gacgtacgccgagtgcggaaaaaggccgcacctgctacaacaacacacagatcaatctcgacgccgtttcgcggtttaccgccagtgtccttgaccagtgtccttgaacaggtgggtattcagaccaccgcacaaaccacggtcacggctcactaccacataacccacacgcttgacggcgcggtcgatcatgaacgggtgg

SEQ ID NO: 540793 - DNA, 851 bp, Homo sapiens
ggtgatcttctgttctagggagaacagtgtctcatttgcagaaaggcagacaggcacctgcggtatttgtgacatgccatgacaagtctctgaataagaagtcaggctgaccactgggcgacatctacagaacaaagaacggcatgtgaattctgtgcacgaatgaagctggaggacagtaacttttacaaagacatacccagtgtccggcgcgtgtctcacaagtggacttttcctgaactattaactcccagccctacccttgtcacgttattcttcagcgagacagtctcaagcacttacacaaagtggcctacattccaatttatggcggtatacgtggccaaactaggcaccatccttccaacgctcacacacagacccagtgcgactcatggaacaagttgcctgctcctcggtccctttgacgacacacgacactacacctcgctcctgacggcgcaggacgtacactactaacgggctcctctccatgcttggccgtactcggggcccatacgcccttattaccttcggctcacgaagcacttcctaatttagtaactgtgggcaattcgctagggacatcttataccggccactgcgatgggcctttacctccaacagcctttgtacatcctaaaagatcttctcacaggaatttaccacgtagtaagacatggccgtatgtacccgtgcaggggccaacgtacagttcaggacattcacgtcgtaatcacccaggctcacgcttattgtcaactgcaacttggttcacagtgcatagttgggatttcccccttccatgtgcctaacttgggcaacatcgtgggcttcccaggcacaggtcc

SEQ ID NO: 540794 - DNA, 145 bp, Homo sapiens
cctgcaagccgacactagagtatccccgcggcagctgactggactgaacccctcctccctactctcctgtgccccaggacccctgcctgctggggaaggggctcctggggtatgaaagtataagactggaagacaccaagtaccg

SEQ ID NO: 540795 - DNA, 176 bp, Homo sapiens
ctggacgcaggatatgcaggaactctgtactttctgctgtgatctacaactgctccaaaaaaataaattcttctgtaaaatatatctatgttgtccctcagcgtctatgggggactggttcaatggacctcctagagataccaaaatccacagatgctcaagtccctttctgttgt

SEQ ID NO: 540796 - DNA, 1006 bp, Homo sapiens
  misc_feature (404)..(404): n is a, c, g, or t
  misc_feature (1001)..(1001): n is a, c, g, or t
gagttggagtctctgtcacccaagctggagtgcagtggcgcgttctcggctcactgcaacctccgcctcctgggttcaagcgattctcctgcctcagtctcccgagtgtctgggactagaggcgcgcaccgcacgcccggctaatttttgtatttttagtagagacggggtttcactattttggccaggctggtctcgaacatctgacctcaagtgatccgcccacctcggtttcccaaaatgctgggattacaggcgtgagccaccgcgcctggcccgggtgtcttttttcgaaaggataaattggcataggtgggatttcctcctcaatcttgagaaaatggccgagtgattagacaaataatagtaatgttttgcaatatcttgaagtgtacctcttgttnccagttttggtgttttcttaaaaaggagcattcttcggaaagttaaaatgtcacgtcttaatttcagttttcctaatcaagatttgataattgaagagtgttttcttatctagttcttaatctggctcactatacagttgaagacactgaagcccagggaagtttttttgcagtacataggtttcctgaatattttctatcagaatgtccttgttcctattattagactgggaaaaagaaattagactgattaaaattctatttggatgaaattaacagcttttggcaagacgtttgtagtattgacttactatctgaatttagcgttggtaacggaaagcgacctgtaaaacaagaaccaagtacgctggaagccgccttgcagggggcaacactgggtttggcttcagctgtgcaacttggagcattttagcttggtaacactgatcccctttcaggtgagtattgggcttgtaatttgaatttgaatgagaaaccgtaatgtggctactggtaaggtaaaacggataaatgccccagaccaaaacagctcgctttcttgctgtccaatttctattaaaggttcctttgtttccnaaggt

SEQ ID NO: 540797 - DNA, 1208 bp, Homo sapiens
  misc_feature (1143)..(1143): n is a, c, g, or t
  misc_feature (1146)..(1147): n is a, c, g, or t
  misc_feature (1152)..(1152): n is a, c, g, or t
  misc_feature (1157)..(1157): n is a, c, g, or t
  misc_feature (1159)..(1159): n is a, c, g, or t
  misc_feature (1168)..(1168): n is a, c, g, or t
  misc_feature (1176)..(1176): n is a, c, g, or t
cggccgccattcccctcccccacgctggcgggtaaggctagagaacggtttcaaggaagacgcatgcgcatgaaataattataaaccgctaagactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctagtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattcanggnnatgangtggnangatgggcanatgattgnagaaactcaaaggtcagaaagttgtccaatcg

SEQ ID NO: 540798 - DNA, 603 bp, Homo sapiens
cggccgccattcccctcccccacgctggcgggtaaggctagagaacggtttcaaggaagacgcatgcgcatgaaataattataaaccgctaagactccgaagttcaatattcgcgggaaggcgcaggcgcaacaaaaagcccggcgggtttatgggtgggggtgctgagcccaaaacccaagcgtgtaataatccgccggcgggaggtgggctggctcttgaaattacgcatgcgccagagctctttgtgacgcaacggggcggtgcgggcagctggctgcgcgtgcgcagaactcgcacaagggaccttatttaggttgcgcaggcgcccgctggccatttcgtcttagccacgcagaagtcgcgtgtctaggtgagtcgcggtgggtcctcgcttgcagttcagcgaccacggtgggtaccgtttttgcgaggattgtttgtccccatatctctgggagggccacggggaccttggcgagctgcaggctgccgtcgagagccgcgagtggttcgctgaatctcggcaccgccgctgaggcctgcaggccgcgccgactctattgtgtgagaagtcggaggaggcggagcggaagcggccgc

SEQ ID NO: 540799 - DNA, 2430 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 540800 - DNA, 2631 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttctttaagaaaactttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgcactccgtcttgtctgtgcttcagtgtcatgtggactgagtcttggtgctctgtgcccacctggggcctagggccacatctctggcttggcagttgaggctgttgcgtagatgtcttcagtcttccctccagtgcaactgaaggtaaactcgtctttggggccctggtggaagggctgtatgtcatttggctgcacaggacctgatctgaactgcctgtaactcattaagcacttgcacaaaacaaagggggaggcgccagtgccctcactgcatgcctgcatgtctttgaggccttcatgcttggctcccaaggtgccggaggcaagggaggtgtgatgaatatgtgggtttcttctagctcataagctcattgggttccgatg

SEQ ID NO: 540801 - DNA, 2409 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttcagtttaacagtttctgcaatacaagcttgtgatttatgcttactctaagtggaaatcaggattgttatgaagacttaaggcccagtatttttgaatacaatactcatctaggatgtaacagtgaagctgagtaaactataactgttaaacttaagttccagcttttctcaagttagttataggatgtacttaagcagtaagcgtatttaggtaaaagcagttgaattatgttaaatgttgccctttgccacgttaaattgaacactgttttggatgcatgttgaaagacatgcttttatttttttgtaaaacaatataggagctgtgtctactattaaaagtgaaacattttggcatgtttgttaattctagtttcatttaataacctgtaaggcacgtaagtttaagcttttttttttttttaagttaatgggaaaaatttgagacgcaataccaatacttaggattttggtcttggtgtttgtatgaaattctgaggccttgatttaaatctttcattgtattgtgatttccttttaggtatattgcgctaagtgaaacttgtcaaataaatcctccttttaaaaactgccaaaaaagcaacgaaaaaaaaaaaacacatgggggggggcccggcccgagaaatttaaaaacctcgtggggggggaccagggggatggaaggccccacggccaaggacccgggcgaaagggcgggcccccaaaaaaggcgggggcgcggtcgacaccagggggggccggcccacggccggcac

SEQ ID NO: 540802 - DNA, 1748 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaacctttttttttttttttttttttttttttttttttttttttttttttttttttttttttttttttttttttccctctccatttctgtcttcagcatcagacctaaataaccaacatcagcatacaacaaacc

SEQ ID NO: 540803 - DNA, 2197 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttaaaagaaacttttgagtttaaacagggttttttggaatcacagggtgggtggatattagggcgtaactcaaagggggaaacctcgggagtggtgtataaaagactttaggggcaggtattttggatacacagacttcatcttagagtgtgtaacacgtgacaggttgtgtaaactatatatggtaaactgtaaggtccaggttttcaaaggtaggttataggaatggaacttacgcccagaaggcgtattagaggaacaggcgtggaatttaggtaaatgttgtgcccttggccagttaaattggacactggtttgggttccctgtggagggaaggtttaattttaggcacacaattgggggggtgttactataaggcgaacattgggcggtgtgtgaatcacgtgttattaaaacggggggcaaattaagcgctttttagtaaggaagtgtggcgcacacaatagaattgtggtgtgggtgaaaagggcgagaaacaagtgatgattgatggtggaggggaatctttgtagaaaaaagtgtgcgcatatggggggatt

SEQ ID NO: 540804 - DNA, 1969 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttaaaaaaaatttcggttaaccggtttcggcaaaaacaagctgtgggattaaggctaccctagggggaaatcaggctttgttttgaaagacttgaggcgcccagatatttctggatctacagctatctcagtctgaggagtgtcacagtgaaaccctgagtaacctaatacctgttcatccttagtcccacgctttcctcaacggtagtctgcggatgtccttagcagaaaggcgtattaggtaaccgccgctgaactctgttaattgtccctgtgcccgtaattgaccctgttcggtgccgttaacacatgtcttttttcgcaccttttg

SEQ ID NO: 540805 - DNA, 429 bp, Homo sapiens
  misc_feature (6)..(6): n is a, c, g, or t
  misc_feature (29)..(29): n is a, c, g, or t
  misc_feature (214)..(214): n is a, c, g, or t
  misc_feature (237)..(237): n is a, c, g, or t
  misc_feature (241)..(241): n is a, c, g, or t
  misc_feature (270)..(270): n is a, c, g, or t
  misc_feature (272)..(272): n is a, c, g, or t
  misc_feature (278)..(279): n is a, c, g, or t
  misc_feature (285)..(285): n is a, c, g, or t
  misc_feature (291)..(291): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (332)..(332): n is a, c, g, or t
  misc_feature (334)..(334): n is a, c, g, or t
  misc_feature (336)..(336): n is a, c, g, or t
  misc_feature (341)..(342): n is a, c, g, or t
  misc_feature (351)..(351): n is a, c, g, or t
  misc_feature (354)..(354): n is a, c, g, or t
  misc_feature (356)..(356): n is a, c, g, or t
  misc_feature (362)..(363): n is a, c, g, or t
  misc_feature (367)..(367): n is a, c, g, or t
  misc_feature (372)..(372): n is a, c, g, or t
  misc_feature (380)..(380): n is a, c, g, or t
  misc_feature (382)..(382): n is a, c, g, or t
  misc_feature (386)..(386): n is a, c, g, or t
  misc_feature (392)..(392): n is a, c, g, or t
tgcccngagtgcggcaaaacctttactgntcgttcaaatctaactattcatcaggtcatccatactggagaaaaaccttacaaatgtccggaatgtggcaaggtcttcagtcacaagtcatccctagtaaatcactggagaattcatactggagagaaaccttacaaatgtaatgagcgtggcaaggtcttcaaacacaggtcatatctcatgnggcaccagcagactcataccggngagnagccctatgagtgcagtgaatgtgggaangncttctnngagagngcagcnctgattcaccactatgtcatccncacnggngagaanccntntnantgccnngagtgtggnaangntttcanncacngatcntacctcangnggcnccagcngattcaaacaggtgagaagccaatcactagtgaattc

SEQ ID NO: 540806 - DNA, 909 bp, Homo sapiens
ggtcgttggggggctctggattggggtgcccccgccccttggcggggggccaccgttttccgtcgttgtgttcgctggggaggccgtgcggggcagcgtccaggtgggcctgtctgcactagttactgagccccttccggcgggggtcgtatattctttttccatcgcccactctctcgcgcgtgcggtgtgcccaccccactgttatcttttggtgtcccccccccgcccgctgtgtggtgtgactcactccccccccctcgcgctgaggcacaaattaattgattgggtttgtccacccttctttttgttagtccggcgcgcccctccactcctactcagacgatgtttctctgttgggtctccctccccccggtgattgtttttggcgggcgcgacactacacgggggtgacacacattctgtgggcgcgctctgcggaccactccctctctcacccagctttgtttttttgtggctgccacgcactacgaccgtctctttctgtgtggtacgcacctcccaccctcactactccctctctgctgctcgcaccccgcctcgattatagagacgtgcgggggcggttctttcccgcccctccacagtggattgtgtgttcagctagcgccctccgcacggcggtggtgggtgcttctcccgcccaaatgatcttcggtagatgggagggcggcaattcatgctgtcgtgctagtatataattgctgccacccgggatcgacgaaacacatattaactgcgataggagaaagcaattttttctgcctcttgaccccctctccctctttttcccccacaaattttttttttgattacaccccctcgtcccctctttttttttcccgccttttcccccctattttttttcccccttttttttttccccca

SEQ ID NO: 540807 - DNA, 533 bp, Homo sapiens
cagcacctccaagttggctgagactttaacagcgggacagcctgaaggtaggcttgactggtcacagatttctactctttcccaagcaatgacaccaaaaggatattggccaatccctttcccccttcattcttcttggggggctttggggaatggaagactctttctggttttcctgctgtctgggatggagtagcagatgccaaggaagggcgtggagaagggagaggaaggtatgataatatttagttttcttcttttcatgcttaaacagatagaaggaattttcagagcaaaatctggtttcaagtgtatggccatttttcaattaaagtcacttattaacctctatgtacataagcagaatctcctgagtctctctgaagacacaaagagaaaagatttccttcctccctccgactctctccaaatccccaagggacactcataagcgggtggagagggtgaaaagctcacaaatgtgaaggcagaagtcaccttgcacctttctggcacgaaaactttgaagtctt

SEQ ID NO: 540808 - DNA, 298 bp, Homo sapiens
acgtgctgactgtaagccagtataataagataaaacaaaaggtacttgtaataatagtcattaaaatatgctattgcatgcatttagaaaccaagacacaaataaaaatatacccagcagtattgtctatttagagcagctagaaacctatcagagctttcacaagatttgtctacttcactagtagctgctataaaggtaggtagaagtttccatacctatacagtaatattatatttaaaaatagtaaaatatgtatattcatagtataggacaaagcaagcctagctatattttt

SEQ ID NO: 540809 - DNA, 1690 bp, Homo sapiens
tggcgaattcggcacgagggccacgcagaagtcgcgtgtctaggtgagtcgcggtgggtcctcgcttgcagttcagcgaccacgtttgtttcgacgccggaccgcgtaagagacgatgatgttgggcacggaaggtggagagggattcgtggtgaaggtccggggcttgccctggtcttgctcggccgatgaagtgcagaggtttttttctgactgcaaaattcaaaatggggctcaaggtattcgtttcatctacaccagagaaggcagaccaagtggcgaggcttttgttgaacttgaatcagaagatgaagtcaaattggccctgaaaaaagacagagaaactatgggacacagatatgttgaagtattcaagtcaaacaacgttgaaatggattgggtgttgaagcatactggtccaaatagtcctgacacggccaatgatggctttgtacggcttagaggacttccctttggatgtagcaaggaagaaattgttcagttcttctcagggttggaaatcgtgccaaatgggataacattgccggtggacttccaggggaggagtacgggggaggccttcgtgcagtttgcttcacaggaaatagctgaaaaggctctaaagaaacacaaggaaagaatagggcacaggtatattgaaatctttaagagcagtagagctgaagttagaactcattatgatccaccacgaaagcttatggccatgcagcggccaggtccttatgacagacctggggctggtagagggtataacagcattggcagaggagctggctttgagaggatgaggcgtggtgcttatggtggaggctatggaggctatgatgattacaatggctataatgatggctatggatttgggtcagatagatttggaagagacctcaattactgtttttcaggaatgtctgatcacagatacggggatggtggctctactttccagagcacaacaggacactgtgtacacatgcggggattaccttacagagctactgagaatgacatttataattttttttcaccgctcaaccctgtgagagtacacattgaaattggtcctgatggcagagtaactggtgaagcagatgtcgagttcgcaactcatgaagatgctgtggcagctatgtcaaaagacaaagcaaatatgcaacacagatatgtagaactcttcttgaattctacagcaggagcaagcggtggtgcttacgaacacagatatgtagaactcttcttgaattctacagcaggagcaagcggtggtgcttatggtagccaaatgatgggaggcatgggcttgtcaaaccagtccagctacgggggcccagccagccagcagctgagtgggggttacggaggcggctacggtggccagagcagcatgagtggatacgaccaagttttacaggaaaactccagtgattttcaatcaaacattgcataggtaaccaaggagcagtgaacagcagctactacagtagtggaagccgtgcatctatgggcgtgaacggaatgggagggttgtctagcatgtccagtatgagtggtggatggggaatgtaattgatcgatcctgatcactgactcttggtcaaccttttttttttttttttttttttaggggttggagggaaaaaaccccggggggaatccttctaaagtcaacctg

SEQ ID NO: 540810 - DNA, 335 bp, Homo sapiens
  misc_feature (6)..(6): n is a, c, g, or t
  misc_feature (29)..(29): n is a, c, g, or t
  misc_feature (120)..(120): n is a, c, g, or t
  misc_feature (143)..(143): n is a, c, g, or t
  misc_feature (147)..(147): n is a, c, g, or t
  misc_feature (176)..(176): n is a, c, g, or t
  misc_feature (178)..(178): n is a, c, g, or t
  misc_feature (184)..(185): n is a, c, g, or t
  misc_feature (191)..(191): n is a, c, g, or t
  misc_feature (197)..(197): n is a, c, g, or t
  misc_feature (220)..(220): n is a, c, g, or t
  misc_feature (224)..(224): n is a, c, g, or t
  misc_feature (227)..(227): n is a, c, g, or t
  misc_feature (233)..(233): n is a, c, g, or t
  misc_feature (236)..(236): n is a, c, g, or t
  misc_feature (238)..(238): n is a, c, g, or t
  misc_feature (240)..(240): n is a, c, g, or t
  misc_feature (242)..(242): n is a, c, g, or t
  misc_feature (247)..(248): n is a, c, g, or t
  misc_feature (257)..(257): n is a, c, g, or t
  misc_feature (260)..(260): n is a, c, g, or t
  misc_feature (262)..(262): n is a, c, g, or t
  misc_feature (268)..(269): n is a, c, g, or t
  misc_feature (273)..(273): n is a, c, g, or t
  misc_feature (278)..(278): n is a, c, g, or t
  misc_feature (286)..(286): n is a, c, g, or t
  misc_feature (288)..(288): n is a, c, g, or t
  misc_feature (292)..(292): n is a, c, g, or t
  misc_feature (298)..(298): n is a, c, g, or t
tgcccngagtgcggcaaaacctttactgntcgttcaaatctaactattcatcaggtcatccatactggagaaaaaccttacaaatgggcaaggtcttcaaacacaggtcatatctcatgnggcaccagcagactcataccggngagnagccctatgagtgcagtgaatgtgggaangncttctnngagagngcagcnctgattcaccactatgtcatccncacnggngagaanccntntnantgccnngagtgtggnaangntttcanncacngatcntacctcangnggcnccagcngattcaaacaggtgagaagccaatcactagtgaattc

SEQ ID NO: 540811 - DNA, 272 bp, Homo sapiens
aacaacaacgtaactatactaacatctcagacgctcaggaaatagaaaccgtctgaactatcctgtgccgtcattattctactccaaatcgccctcccatccctacgcatcctttacataacagacgaggtcaacgatccctcccttaccatcaaatcaattggccaccaatggtactgaacctacgagtacaccgactacggcggactaatcttcaactcctacatacttcccccattattcctagaaccaggcgacctgcgaacctatga

SEQ ID NO: 540812 - DNA, 345 bp, Homo sapiens
gtgggacccagtccacagctattactgcgccaactgacctgaagttcactcaggttacacccacgagcctgagcgcccagtcttacaccactccaagtgttcaggctcatctggatatcgagtgcgggtgacccccaaggagaagaccggaccaatgaaagaaatcaaccttgctcctgacagctcatccgtgtatgtatcaggacttatgttgaccaccaaatatgaggtgagtgtgtatgctcttaaggacactatgacatgcagaccagctcatggagttgtcaccactctggagaatgtcagcccaccaagaaggactcgtgtgacagatgctactgagac

SEQ ID NO: 540813 - DNA, 200 bp, Homo sapiens
cttagaagtcttgccgagcccagatatggcagccctgggggtgccaggaacgacttcttcaaggacagccctttgcggtagcctcttttgaaaaaattgcagaggtcaacagttaccagaggactggacctgagcagatttccttaaattttcaaagaaaagggaggagaagaatgtctgtctctctgtaagtcagagag

SEQ ID NO: 540814 - DNA, 1969 bp, Homo sapiens
  misc_feature (1)..(1): n is a, c, g, or t
  misc_feature (180)..(180): n is a, c, g, or t
  misc_feature (1714)..(1714): n is a, c, g, or t
  misc_feature (1877)..(1877): n is a, c, g, or t
nggggaagcgaagagacagaaagacaagagaggcagagatgaggaaagaattggatgtgtgttgacagtgattgatgaagtcgtgtggattgcacatggagtagagtgaggttctgttcttgatcgatcgtcatgcactgtgaggatgtcgttggcatgtcttggatttgcatggattcnatgatctgatcgtgtcgatcgtgtgacatgattgtcgattgttagtgcaatctttgatatcttcatcgaatcgaatcacatctgtggtcaagcgagatgattcgacatatgctgatttcttcttcagtggagttcgtttgacttgtctgctgaagtttgttctgtgtatgcaaactactgtgtcatttatgttcgatttgatcagtttgcattcgtccatatgacgaatttattgtatgagggagtgcaacacgctccacatcgcgagcgacgcgaggggggaggtagaatcatataaacggaacgcgttgttgttgtgtgtgagccacgcccctgccatgtggtgtgcgctgtctcgggagtggagcccgtcgccacgtcaccgcacccgcgcgcgggtgtgtggttggagccgcccccgccgctgctatcggcagagaccccccccccgcggcgggctgcggagttgagcgaacatgcgcgctgccttgacgggatgaagtttgttctgactaccttattggtacgcgccacggggggtcgccgcgatggtgtatcagcacaggtgtgttgtgctcaccatccccggggacgaactactgcgtgtgtgtggagcgccacctgtttgtggcgccgctcatttttttgttggggcagcaccgacccccgtagttagtagccacaacaaaagggtggtgttgtgacgccacacaaagaaaagcacacccgcgggcggggtgtggggttgcctcccggcgcttcgctcggagggagtgtgttcctccgccccgcagggagatgttgtttgtgcggttggcagcacagcacacaccgaccaggaggctgggctcaccagcggggggagctgttcctcgtcagctgggtgtcgtctctggtctggtagcacacagtagtaactatgcccgcagaatgtggttttgtctactgttgtggggtagaagccacccccaccgcaacacggtgggggtccccctcggcggtagtcgtctgcttccgcctcgatgccgcgcggaaagcaggagggtgttgtttctctcgtctacagaagaggggtgttttcatcgccacacacacagcagcaactgttgggagggccgaccagaaggagcgcagacccgcgggcggaagaggtggctccccgtctccccccgcgctggatgtacttctctcgcgcgggggggcacacacaacgtggtggtgtatccctccgcagcacaacacgacgactgctgcgcatctgtgggagccctcttctcgcggggcgcggtgctctcaccacgcgcagaggacacgacgcggctagcgcagcgcctgctctctttgcgcacacacgcggtcgcacacacacgcacttcgtcgcgcgcacacatattttcgcgcgcgcggcgcgcgcgcacgagggagcgctcgtctgctctttcacacgcacgcacagcgtcgtctttgtaggcggcgcgcactcttgttgtgcgcacgcagcgcgccctttgcgcgcacactctactctctcccngcgccaccggggttttacacatccccacacttttttatcacacacacatgtacaccgcgcgcgccacactgttgtggatgtgagcccaaatccacccttgtgctcttataagaccccacgggagcccaccgcctgttttgctgtgtggctccacccccgggantacccccccacccactggttttttatggcccccccaccccccacacctttttgttgggggaaaaataaacgggttataaaattaaaacaaca

SEQ ID NO: 540815 - DNA, 283 bp, Homo sapiens
acattgttgctcgtcaacctgggcagcatatattaccacatatcgtcggcatatactgtcgctacgatgggcagctcatcagacaaggcgctacctgccaaacgaggcaagggctggagcgcacaagttctatagggtcctgctgaagggtgcaacgtgatggaatgaggtcattgtgcccgccggttgttcgtgattagctgtctctaacaattgttcataccataattgttcatcattgttctcaactaggggctctccccaatctggggacccttcctta

SEQ ID NO: 540816 - DNA, 93 bp, Homo sapiens
ggatttgctggtgcagtacaactaggcttaatagggactcgaattcgagcaggaaacagggaaactttggaatttgaaatatcacacccaaaa

SEQ ID NO: 540817 - DNA, 386 bp, Homo sapiens
cgaacaggacaagccaggagagggctatgggtcccactctacagatgagaaaggacagactgcagaaatgttccataaccgtcttataagtacaacagctcgaagtagtccactaggcctggaagccaggtctatgagactacaacgcctgtgccattgtgcatcacataccatgagtagacattaacataccactgaggtaattcctaccatattattaccaccttatgtggctttaaatcgactcattctttttaaattgagctttgtcacaggggtaatatcaatgagatcttgggttttgatgagctacttatttttctaatacccattgaaataaaaccacgatcattaactgtgttaaaagttcggcaatgtaccaccta

SEQ ID NO: 540818 - DNA, 982 bp, Homo sapiens
cgactctcagcccagtctttaaatcctcgagacctggaagatactagagtgatggtggctatccatagaagtaagatggaataatagagcgagtaatagaatggtgcgagaatctcgggacaattatgtaagatatgatatcctagtaatagccgttgcaactatttcacctgaatacttgagtgtcctaatgctcctcaggcctggcagaactatcttcattatcgtcacaacgtcaataccttgaatgtaatgggcccatgtgcgatgcgttcaccccctggaatcccaacaacttatggggagggctggagtgtgcaggcggatctactttgaagtgcctaggagatgtggaatacagaccatggaccatgtggtgaaaaccggagattcatgcatggagaggcatgggttaatcgggcttggtgtgcctgaacctgtcggtatcgcagtcatccatcaggtcgtgatagggtgacatccaggctgtctgcttgaaaacccagagaggctgatagtgtatgtctagtgtccctattcggtctatgtgggctagacaatgccattatgcagcaaagataggtgtaaggacagaaagtgcctctcaagtgccgcaactggtgtcagaatcaaggagatagggactacagtgtacttggccgcatgtatgagccaatgaaccatctggagatgtgacgggtcgaagcgagacgctcactcgcgaggcgcccgactggcgagtggcacggtccccaaaggggttctcctccagaaaatgaatcctaggacgaaaggcagagcacctccctggaataagcggtaatggggacagggccggggcatcccagaacaccaacacgggggaaggaaccgacagagcctttgacaaaagggggagtgtacaaggcgacggcacaaaaaaggcgggcaacaccgggagggagcacggcagcaaacaggctggggcacgacacaagcaccc

SEQ ID NO: 540819 - DNA, 298 bp, Homo sapiens
tagggaggtaagcaaccggtctatagacacatagctaatctgtggcgtggaagagatctgctgtctgagctcaagtctgtcttgggctaccagaacgccacaggttctctactttgcctctgactcattttctgttgtgggtaaatggctgtctattggacttgcaattgatccccatactgggcatataaaatccagatggacccctgtatatattcgtgttctccatagcttgctaattaaaggacaaagcgcgagaacttgtgatacattttctacaaagaaacaggagatttta

SEQ ID NO: 540820 - DNA, 203 bp, Homo sapiens
  misc_feature (21)..(21): n is a, c, g, or t
  misc_feature (26)..(26): n is a, c, g, or t
  misc_feature (33)..(34): n is a, c, g, or t
  misc_feature (39)..(41): n is a, c, g, or t
  misc_feature (44)..(44): n is a, c, g, or t
  misc_feature (47)..(47): n is a, c, g, or t
gagcagtcatcctcccccttncccgngcagggnncaggnnntcngtnctgggggtggtgggcggacaataggatcactgcctgccagatcttcacactttatatatatatatatatatatatatatatatatatatatataaataaaaatgccacggtcctgctctggtcaataaaggatcctttgttgatacgtaaaaaaaa

SEQ ID NO: 540821 - DNA, 992 bp, Homo sapiens
gggtcgcttccctgcgcaaagtgagcagtagccaacatgtcagggtgcggagtcatattcacaaaaccgagggcgatgaagacagcagaggaagaacaagacgagaaccttgaacggcaagtggagactatgaatatttgatgcctccaaggttatgtttgaatctcaagagtgaagatgagtagacacgctttggacattacaggagatatcatcagcatagcagaggatgagtgacctcagggttacacctttgaggacactccagcaagctagaagacctgttgcggaagggtccgcgcaaaggagaccaggaagcgagcactcagcaggttcagacgctgaagcctccaccagaaggatatagggatgaatctcctgtaggcgcagttttcataactctgggtccaagaaaaggtctcctcaacgcctccttccaatatagagctctcatcggggcaacacaaacatgacccagtgaaaatccaaagaacccgggacccttttaaataccaaggtccaggcggcttgccttctgcttagcggtgtaccaatgagggctctcaagatctaatgcggagatcgcccagattgataccttggacgcacaagaggcaacacaagaacgagctaaaaacgggttgattgatcccaagggttagattgctccattgggtttccaacgccgtggggtatctgctggaggaaagagcaattaccttgaggcctccctggttcgagtacccatgaaggatcagctgcagtattggagagccaacccagattacagtgtctgctcatcaactgcttgtaatgacttgtgtcgcatttgtgcagcttccaccgatgagaactcttctatttgtggggtggtcacagaaaaatctgagcacaacatcggagctccagtcacccgggtagaccctgtgtagaggcctaggaaagtaccaacagcagaaccggcatgatccacatattcaagagacatagga

SEQ ID NO: 540822 - DNA, 381 bp, Homo sapiens
tatccactcacgcattatttcaaaggtttagggggtggaaaaaaaaaaattggtgggaaaggttctttatcaactcgattttcctccccactttaagaacagaacaagcatctttcattttaatgagctgtggaaaaaagaatattttttttgaagaacaaaagggtggtaataaaatgctgggggcgtagacaaaattttgggcactttgtagttttgcttactgatctttaagactcaacagggacttattgtgggcaaaactgttgggttctgatccctacccagccagctacatcactgacttccagaagccaccaaaacattgctatgacttcagctttcaagggggaaaaagaatttgccaaccatcccttttcc

SEQ ID NO: 540823 - DNA, 180 bp, Homo sapiens
  misc_feature (21)..(21): n is a, c, g, or t
  misc_feature (26)..(26): n is a, c, g, or t
  misc_feature (33)..(34): n is a, c, g, or t
  misc_feature (39)..(41): n is a, c, g, or t
  misc_feature (44)..(44): n is a, c, g, or t
  misc_feature (47)..(47): n is a, c, g, or t
gagcagtcatcctcccccttncccgngcagggnncaggnnntcngtnctgggggtggtgggcggacaataggatcactgcctgccagatcttcacacttttatatatatatatatataaataaaaatgccacggtcctgctctggtcaataaaggatcctttgttgatacgtaaaaaaaa

SEQ ID NO: 540824 - DNA, 176 bp, Homo sapiens
  misc_feature (9)..(9): n is a, c, g, or t
tccctaagngacgattcataggactaattccttttcgaattctatgctttttcctagctgcaaggccagagatagcgtgattatgacgtctctttccaggcacccctcttcctctatgagtcagactagtcttaccaaaaccagaattctgttgaattccccatcgcacttagaca

SEQ ID NO: 540825 - DNA, 715 bp, Homo sapiens
ctgcctggtttaccgagctgtgcccagacataccagccttatacaaagactggattaaagagatgatctacgtgctccttggtcggcaggcccaacaggctgggaaataattgagttggaagcactggcgggtccgggggggtcttgaaccacatgggtatacagcgcgctgtagtggcagagctataacctaggaatcctgtctagactatgtaagaacagatacaagattgcacgcatctatggaaaagactagatctaggacatataggaagagccgacaccccctctttgcctgtgtattagttgtttgtccaagaacgaacacaatttcatctttaattaggcccacagaaccctctagaaccctatggagattaactgctagaccaaggaggtacatgctctttggccactagataataaccttgttcagagagtgaacagtgcaacacccatacatagcctcaaagcacacaccatttaggcatggcgtcaagctcaacacgctcttcctaaaaaaaaaaacagcaaacagattattatcctaagtcggccggttgagttcaatgcaactagtgactggagcaggcttaagcatgcggccccgattcaggctcactgggccaattccccttttgggagtcgaatgccattcattgcccagcgttttaaacgtgtgactggaaataccgaagggccccaccgacgccct

SEQ ID NO: 540826 - DNA, 283 bp, Homo sapiens
cacgaggtcgataaccacattagcctgtaggctatagatctgtatcgcctattaaaatctgtccaaaactcccccgaaaactgaccaggtgcagtggctcatgcctataatcccagcacttcaggaggccaaggcaggtggatcacttgaggccacaagttcaagaccagcctggacaacacagcaagccgctatctctacaagaaaaaaaactaaaaaatttaataaaaaagggccgggtgtggtggctcacacctgtaatcccagcactttgggagactca

SEQ ID NO: 540827 - DNA, 391 bp, Homo sapiens
  misc_feature (28)..(28): n is a, c, g, or t
  misc_feature (66)..(66): n is a, c, g, or t
gagatctccttcacaacatacagtctanatgtaccatagatctatgaaaactggaaactacaaatntctagaagaaaatatagaaaaagtcctaatgactttgggttatcgaagatttcttagaaatgacaccaaaagcacctcatcaaaattaaaaaacgtatgctcttcaaaagacatattaagagaatgaaaagaaaagcaagagactagcagaaaatatttataaaacatatctgttaaaggtcttatatttagaatatataaagaactccaatactcaatagaaggaaaacaatcaacccaacttttaaaaatgggcaaaagacctgaacagttcttcacagatgtacaggtcttttgcccatttttaaaagttgggttgattgtt

SEQ ID NO: 540828 - DNA, 133 bp, Homo sapiens
ctccccacacctgtatagctggaacatctccatatactatatggacatgagctggcttgaaaatggcctcgtagtgactcgtcatcaatcccgtctcggagcaggtagttaacagcataatacttgcctttac

SEQ ID NO: 540829 - DNA, 827 bp, Homo sapiens
ccggagggggcccttcctctgccctctctgggggggccttcttttggtgcacctggattatgacggaactgtgagtaatattgcgatgagctcagggcgcttcttggtgggtcttgcgctgcgacacctctgtgggggtcaccactgggtgcgcctctaagcacgccgtctcacggggagcaccgaagagtcactgtgcgagtgacccttgcgtgctctctcggtaggtaacacacgtgtggtcaatcacacagggggttaacgttcgcctccgtgaaaccccggcaaggtgttgtcaccattcgattgtgcgccccccacgtcctatagggcggtatgattgtaaaccacgcactaggagttggctagcgaagactaataatgtgtctgttccgtagcttgtgcctcccacccgtggagccactagtcgcttggcgcttctccaccgtgttttcacggggaggcaggttcctacacgggtctacccacttggggggtattttttatgcccccccactggcggggacttattaacagacaacccatgcttggtgtatttctggccggcccgctagtttgtgcgggggactgatgtcgtgttgcacagcgtgtgcgtgtgtgctcgtgtgtgtgctgtgctgtgtgttctcgtgaccctcctcgtccgccactggtacagtcccaaccctgtccccacgatcccgctattccctccaccataccagaaacactcccacgggactttggggaataggctgaggaccaatacctgctgtcactccagaggacattttttttagccataaaattgagtgtcaactaattta

SEQ ID NO: 540830 - DNA, 206 bp, Homo sapiens
ctactcttagttatactcggggcaagcagactaggatataggtgttacttctataaagttacctatctgtttctaaatgctgtaaactaaactaacacaggtaacccggaaaacagtggcaaattccaaaatggcttaatacctgtaaacacactattgactgagccaggtactttatcgatgaaattcagacatacaatgtaaag

SEQ ID NO: 540831 - DNA, 378 bp, Homo sapiens
acaaccctggaccaacggtcttctgctgcttactgtctcaagggatcacctatatctcactgcctcgagtgatctcacctcttacttctcatgtgccagatgttaagatgaaggaggaatacaacacatactccagcctcagcctgtatagttgtcacaccctggggactcgacttttctgggaccggtctttattatcagactggccaagcctaactccataggttaaccggacacgtacgggctactataaactacaaacaattgtgtcctccccaactttcgctatgttcctatttgcttctaacactttgccgctgtttcactttttcctcattcgtctctaagttgaaggctttgctgggagggggccgcgcg

SEQ ID NO: 540832 - DNA, 168 bp, Homo sapiens
acagctaccgaagaaaatcactggaaccgggaagcagaggcttcagtgagccgagagagcgccaccgcaccgcagcctgggtgacagagcgagagagactcagtccaaaaaaagaacgaaaagaagaagaagaaaaaaagaacgggcccaaatactgctttgtcgctg

SEQ ID NO: 540833 - DNA, 81 bp, Homo sapiens
ggctaagcacggaggctgtttataggctgggccgcatattacaatgctcagggctccactgcacccttctgtcgtcttctc

SEQ ID NO: 540834 - DNA, 126 bp, Homo sapiens
agcggcccatccagccattcaagtttcctttccagaagcacggctacggcctttcattcatatgttcttctaaagatagtctacattgggaaacgtatgttaaaagcacgtatttttaaaattgtg

SEQ ID NO: 540835 - DNA, 875 bp, Homo sapiens
  misc_feature (51)..(51): n is a, c, g, or t
  misc_feature (85)..(85): n is a, c, g, or t
  misc_feature (95)..(95): n is a, c, g, or t
  misc_feature (107)..(107): n is a, c, g, or t
gcgcctgttctcacgtgctcacaggcagttaggcagaagtgatccccgtgnctctgccaaagacaagcctgttgggttgaaagangaagaagaangaagaagacaanaaaaaaactcaggcaaagtcacagcctcaaaatttgtttcactgaaaaaacgcgttgacgtggcacgaccgtgtgacaagatgaactggaccggtggattggcttgatgatgaccacttctctaagttgaaggagtcattcagtgtttcaccatcgcgactctgctgggaacagggacacccgggactaagcattttggtgaccagatcgagtgaatgcaggtgcttggaaatgaccattcttcaaaggcgacaggacacccaagtgcctaaaggatgtgccatgtgagcaattggaagatctcaaagacattgccagacggctgcttggcaggactctggcgaagacaagataactccccgaagaaataattctcacccacatcattagacagttctcatgtacttgagcaacaagaacaacttagatccatatcaaaatgattcagacaccagcgaaacaacttcacatccagacttcgcgaaacactcaactgtaatatttaccagacacatatcacacccttgactaaacaattccccatcagcatgacaaataatacacacaaaattagaataacaagctccaacacccaaccatccactcaaatttctccacaactccaagacacaaaaaatttaacaaagaccactatgacaagacagaaaatctattcagataaaccaccattaacacttaaaaagctttaatatataccactcaaaaaacccattaacacatgacctgaaacaaatatcactatcaaga

SEQ ID NO: 540836 - DNA, 308 bp, Homo sapiens
cgctcccccaatgatggtctcagctcccgagtagctaggattacaggcacccaaccactacggctggctaattgtggtattcccaggttggtctcaaactcctgaccccaagtgatctccccacctcatgcctgtaatcccaccactttgggaggccaaggcgggcagatcacgaggtcaggagatggagaccagggtgaaaccccgtctctactaaaaatacaaaaaattagccggtcgcggtggcgggcgtctgtagtcccagctactcaggaggctgaggcaggagaatggcctgaacccgggag

SEQ ID NO: 540837 - DNA, 957 bp, Homo sapiens
ggccgggtcgccaccggcccgctggtggatccctgctcccgcacctccattatgatctgactggtggtgaccatcttctttaacctcttccccgcggctgagccggcggtgctgagtccgagggctgtgtggccggtagcttgggctcggtgatgactcgggcgtgcccgctggaccggtagtctgctccggtcacaggagggcaccttcctggccgtgaccgccagtgacggcgtgcagtcgtgtgtgcctggtgggcgagatcgtgcgggtcgctgcgagaggagcggtctcttgatgtcggtgcgcgcgtgaagctggtgcaggcctccgaggatctgctcgcgtgtggcactagtgggcgtagctggttgaacgcccgttctatctgggcgtctgtgtcaagtatgtggcctccgtggtccgggggtggccattggttttggcaggggcttggacgtggtgcgcacctcgcgggcgctcatcggagccacgaacccgtgctcgactgccccgaccgggcagcaatccgcggggattgtctgcatcgaggttggctaagaaccgtgattcacggtagcgactcggtggccgagtgcccagcgtgagatcgctctctggtccgcgcagacagagctctctgtctgggaggagagcgcgtgggcactggcgtgtttgagtagaaccggatgattgcgcgtactagaggcttgcacactccaagactccgtccagggcccaagatggccgggattctggcgcacccagaacgcgcctgggagaaccctttggacgggtgtgacattcactgtctgacattgatgtgggtgggcaggcttccaaaaccgggaacagaggcacgaccgaggagtgtcagagcgggagacgtggaaattctgcaattctgttgcgacacgggccagcgtaaaagctcgttttaaaaaacaagagaagagg

SEQ ID NO: 540838 - DNA, 108 bp, Homo sapiens
  misc_feature (60)..(60): n is a, c, g, or t
ctagctccaaactattctgtgaccatgactcacacggagggccacctggccaggctctcnaggctcatgctgtgaccatgactcacgtggagggcacctgcaaggctc

SEQ ID NO: 540839 - DNA, 766 bp, Homo sapiens
  misc_feature (326)..(326): n is a, c, g, or t
cacgagggggccattgagataagaaccccgggatttccgggcattaaggtcggggggcctacccactccttccactaagaggccgtgccccatacaagccccccggaccccacattgtctggacaagtatgcacccgccccagaagccggactagccccaccattcaataagatagctagtgggccagcaatcagttgtggaaggacaacgacaggacgacacgcgggggcggggggggacggacccacaccactgaaaaaggggaaaacagacatgcaaaaccccaagacacgatagatgaagcaccccctctgcgaaccccctngcacccgcggagcgacaaacacttccacttctgtattctgtcattagacataaaaaaagattaagaggagagtgaagaaacccacatatattatccaaacgagaagggagacaataagccggccccgctgtttaccggatcacaagggggggagtgtgctctctcttgaattaccactatgagtggtgagagagagggagcgcgtaagtagggggagggccggcgcgagcgcgcgcggagtgacggatccccgcacgcggagtgaagatatttatctcatctggtgtgagcagagacacccgactacggacagacatggctaaagaaatcgaaaggaggaggagaacgtgaggacagtaagcgcatcctcgcgaccaaaccgaccagtatcgcccccgccgccccgccgccccccgcggcgatgatgctcgttctcttct

SEQ ID NO: 540840 - DNA, 191 bp, Homo sapiens
cttttgcttggggcctgttctttgccacctgggcaaaggtcaatcgcagaaggtcagacggtcagaacgggatgtcgtcgtccatgtcgtcaaagcccgtggccgacttcggcgcgggcgccggtgcagggcgcggtgccgctgccgggcgtgctgcaggacggctgaccggtgccggggcttcctggttg

SEQ ID NO: 540841 - DNA, 135 bp, Homo sapiens
tgactcctcctgactagcctgactgggcggggggcttggagactctcctaccgagctcccaggcgctcgggtttgcataccagagagctgagaggctgcctcacagtcgctgtcgggctagtgggggggtcccgg

SEQ ID NO: 540842 - DNA, 393 bp, Homo sapiens
gcacatcactagcagttctgtcatcgatccagtactctccctccatgttcacggccatccctcctgtgatgttcagactgatatatatcctatgtagcagcttttaccagcagcaccgtgcttccagtcagcatacaattaaatgtggccagctacagccatggaaacccattgctctggatagtggccttcatgtatagcctgcatgtagcaaagttgacatggaggcagatgccgttgttgagcaggtgtcacactgctggcgcttaaggcgaggcagtcgatcagcagcaatgtcaggataccatagatcctcttgaatatgggtgtcagtgattgggtctatccgaagggtctggtatatcgtagctagtgcttgcagatacatgaaac

SEQ ID NO: 540843 - DNA, 365 bp, Homo sapiens
cgggcggatcactcaaggttaggaatttgagaccagcctggccaacatggtgaaaccccgtctctattaaaaatacaaaaattagccgggcgtggtggcagttgcctgtaatctcaaggctgaggcaggagaatcgcttgaacccaggaggcagaggttgcagtgagcccagatcgcgccactgcactctagcctgggggacagagcaagaccccgtctcaaaaaaaaaaaaacaaaaggcgggaaaggtttgcgccttgggttaaccttcccacaggtgggcataggaatgaggttaaaagggctctacattctaaatttcggagaagggaaatatggctagaaggggcaagcctaatagaatc

SEQ ID NO: 540844 - DNA, 549 bp, Homo sapiens
  misc_feature (480)..(480): n is a, c, g, or t
tacagaacttgagggagtgcaactttgagggtatgggcactcttttaccctgagtctggctcctgaagggcttgccggcctgtatgttctgccttccaccccaggccgctccctactgcttccagcagctcttggaactcttgtttccaacacctttttttgagtctcaacataaacattagattaagccattgtggtctcttcctctgtgccttgattgcccagagcctcctaagggccaggagtggctccttgagaggaagagtgatgggagctatgggaggaaggatggaggctggatcatcaggcgcgagctggttctttcaggactttgtgtatccctcatcctgattctacaggggtcctccccttcagactccttctttgcccctgaggggtgggattaggtagtgattagggcatggctggagtcagctgccaaggttcaagtctgggctgtgccacttagcagcttagtgnacctggcagattatgctgcctctctgtgtctctgttcccttctctgataaccacaggaccatcgttata

SEQ ID NO: 540845 - DNA, 111 bp, Homo sapiens
gtagtcatgtcggtccgccatcattgttcatagttgctggatttggtctgagagaccgcgtgggagatcaggaaaccctgcacctgggtgcagtcgattttgcgcaaaagg

SEQ ID NO: 540846 - DNA, 550 bp, Homo sapiens
  misc_feature (34)..(34): n is a, c, g, or t
  misc_feature (36)..(36): n is a, c, g, or t
  misc_feature (67)..(67): n is a, c, g, or t
  misc_feature (351)..(351): n is a, c, g, or t
aagttatgccagcacgaaacggtagccacatcgngngtgtctttcaatcgacagtcataccagcgtnggctcaagcacacacacagtcagcctgtcccgctaccctcacagacccccaccatctacacacaggctcacaaacacacccacactctttcacacctactttccaacagccacacgcagcgtcccacacacagctctcctagtacacactcattctcacagtcacctttacccctccgcactcttttcagctgaaacatatgtgcatgtacagatagacacgtaaaacagacacatacaacacatgtgcacacacagaaaggctcaaacacacacagatacacncacacacacacagaactgctctcacacacacaaatatgtgtacacacacacgcagaaatgcttaaacacatacagatacacgcacagagaattgctcaacacacaatatgtgtacacacacagacatgtgcagaatgctttacacatagatacacactaacacaggctcaacatacactttacatgtacactcgacaca

SEQ ID NO: 540847 - DNA, 288 bp, Homo sapiens
cataccatcggaccaattctatcagcgcatatagaataagtactgtaagtataaatcacgtgaagagattctcctaccgcaatacgcatgcgtcagacttaacagactgaactgacaattaacaggccaagctctacaatcaatcaactaagtcattcttaccctctctgtcaacccatcacaggcaatgcgcatcaggaaaggttcctataagtaaacggaatgtcggtatatcttaccccgacctgtttctcactcagcatcacctctgaggcatcaccaccagga

SEQ ID NO: 540848 - DNA, 156 bp, Homo sapiens
gagctatttataattagagttggatcacccattcatgctctataaacctgaacattgtgtcatataatctaagagtctcagaattgaacaaaagaaaaaaggaaggagggaaggaaggaaagaagggaagaagagaatgagagtggacaaagcaaa

SEQ ID NO: 540849 - DNA, 481 bp, Homo sapiens
  misc_feature (386)..(386): n is a, c, g, or t
  misc_feature (402)..(402): n is a, c, g, or t
  misc_feature (452)..(452): n is a, c, g, or t
  misc_feature (466)..(466): n is a, c, g, or t
attcggcacaggtggaattaaaagttcctgaccttggccgggcgtggtggcttatgcggtaatcccagcactttgggaggctgaggcgggcggatcacctgaggtcaggagtttgagaccagcctggccaacatggtgaaaccttgtctctactaaaaatacagaaattagccaggcatggtggtggacacctgtagtcgtagctactcaggaggccgaggcatgagaatcacttgaagtcgagaggcggaggttgcagtgagctgagatcgcgccactgcactccagcctgggcgacagagcgagatgccatctcaaagaaaaaacaaaaagttcctgacctttccacacaggtccttcgtggtccgcggattccagagtggttnttagctttctatttantatcacacagtttttccttattttaagttattgcaaagggttcttttgcnggggattgttgagntttttaccaccttga

SEQ ID NO: 540850 - DNA, 312 bp, Homo sapiens
ctagtcttagaagtctcaatagcacattccacctgggcacaagagagactccatctcacaaaataaaaaagacaaaaaagaaaaatttcgggggtctcctgaggctcctagaggggattttttctttccccggctctcggagggggcaaaaccattgggggactcttttagagtgccctgctgggtttgaaaggtggggagaggggcggtggtttaaaacgcggtcggggatgggggaaacaggaaaagactgaaatctgagagctatacagggtctcaaactactttcggcctgtcctttttcctgaaagc

SEQ ID NO: 540851 - DNA, 171 bp, Homo sapiens
ctccacctgggtgggacgcgcccatgtgcactcttgaaacagaggggaagagaatatcatgtgtgtggagggagggggcacaattcaccatcttctgactgtcagaaattagaaaggaaataatgatcaataacggttaatgcctactaagcactagaaggtccaggtatg

SEQ ID NO: 540852 - DNA, 229 bp, Homo sapiens
tgctgactgagaccaggtctcggcctcctcggactcctgctcagtcctatacgggcgcacgtggcagggctgaggtggtcgctcgccgtgcgcgtgcgctgaactgcagcaatcaccagtcgctgttgtctcccttgggcacagagcttcagtttgacgaggacgacgggtgaggggaggattgaggaagaggtgctgctgaggaagacgtggattaagattgccatga

SEQ ID NO: 540853 - DNA, 957 bp, Homo sapiens
tgggtaccgcgtcccggcagcctgatcgccgggagcccacgccacctgcgcggcacagcccggaatggaccagcagctcccgggagaaccgagcaccccaagtctcatcgggggcgaccggcgagtccctcaaacgcagacaagttaatacggggacaaagccggcagcagccgcagcaagtctgaagatctcgcggctcgcggcgcgcttgaaggacaagaggaaagtgcgtcgcacatcgctggcgtgcccggaaggtcgggacaggtcctcggatggagggcaggcgtttcacgtgtgtggacacctccagcgatggaacaaatgcgagatatgcccaccagaataggcccctgcggtcagtctcctcaggggacatcgctctaccacctagctagctgacgcctcgaaagccccacaagcttcgcgagagacttccggaggacgtctacatggccctagccgcctctggacgcggttcgtctgcattcgcgagccaagacttcgagaatgatttacacaatggcatgtgcatgattttatcttttcctgggaaagtgaagtgtcaattgggttgctcaatatttcatgactgccaaggatgcattgaagatattgtatttagtaggtaatgagaagagtaccgtgtccagcggaaggagggtcggcaataaatctatattgtttctcaagaaagcatatctctgggggccgctggccccctcggctcctgtacacagctcagcttgaactcgtgtagcctctcaaatgaagaaggtggcctgtttatttaggactttgtggaatagcaaatcacagtgctgttgttaatgcctgagagaacgcactttaggggtagacttataccttgaagtgaaggagctgggggaggaacgaagcattcttaagtagaagcattttaaaataaggcagaacgcctttgatcgtaaactaca

SEQ ID NO: 540854 - DNA, 190 bp, Homo sapiens
gggtgtagttggcagagaggttatcatagctcagtaatctgaagtcctctccatctctccacagagtagtagtaaaggattcacccagatgcatgtaaaacctgggtagttgagaaatgcaagtgaaaaactagcctttttagccacaagtccctgtgtgtgttcgcatcgtgtttggtttggtttaagg

SEQ ID NO: 540855 - DNA, 915 bp, Homo sapiens
ggagctgtcgggaacgtatcagatcgccagtcgtggatgaccagcgctaacttatctccaacaatgagtccactgtgccatgtctgggccggcgccgctgtgtggccccggtagagctatggtgcagacgcgtcgtgccgacccgtgctacgatcgaggcttgtgtcgcatcctgggtgagctcgtgctcctcgagtggtgaggcgcgtcccatcggcatacttcctggtcacacagctcagtgaaggtccaggcgttgggactaagactttacgagtcggacctcgcgcgaagcaagcctgcgagtctgagaggaaccgtggcgtcgatgataggcgttgcccattagccttcccgatagtcatggtgagctaagatgcgcattgggcagcccgctggtgatgccaggcgctgcccatgggagccctgtcccaggagcccatggagaatgccaactgagtatggtagacatgacgagaggaccatgtgatcgcacctcgttccagaatgctggatcgccctgaaggttgtacccgacactgaatggggatgcttcccggaggaacctcgagaggaccttaagaacacccatggcatgaccgatagactgtacaggtctttgaggagctggatgcagccattgggtcctgtttggaacagtgagcatggcaactcctttgtgagcagaaggccgctgaggctccagccgaaagagtcagatggaactggaggacccggcttctgggctgggtgttgaccaagtcaggatctggggcccagtccccatgtgagacgcagcagagggcggtcttcagcatcctgtcagacccagcacgagtacagctttgttgtccctttaggccccaaaccttccccatttgcaaactgtactctccgtgaaacctggtgctgggc

SEQ ID NO: 540856 - DNA, 1152 bp, Homo sapiens
tctggtacggggactaagatggaagcgtgttttggggggtcgcgggtccgggacttgggggcgggggggtccgggccccagggacagtttataccggcattccatccactcccagattccttcatgggatccgggcgtctggcactttacagaggtgtccaactcacggcggacccagaaaccccaggggtgaccgggaccctcagtccctgcggggtaaagttccgagggcggagggggtgatggccgaaaacagtgcggggactcctagcggcctcctggggcctcgtttccgacaaaatctcttcgcatttagtgcgagttcaacaacgagataccagtgcgggggtgcctctgggggaattacgcgtgatttcccagattttgtgaagcaagtctctcggccaaatgggtggattggatggaggagacgctttctggggacgatgggacacaggttatataggtcctaaaagcttatccattccatgggtgtggcccaggggccattggtacagccgggggctcgaaatatgaacctcttggtgggaaccccatgggtcatcggagaggctatcgctggatggagaagagcttcctccggtttatcggtgggccatggctgggtggtagcctatggaaagccccttcgtggggccactggggttcacgggggcatcactggggctcaagccctcggcttgcagaaaaagtcctggggcgacaagcaggccagtggctaaagacaagaccggagggcccgcgacctctagcagaaccgcgtgcatcgcagtgccggaccaaccggatatgtccccggtttctttaacaacgggcgttgtacaaattggccagtgtgtcccgcaaaaacgggtggctcgcacacacgggggcccctgtgttctccacgcggaggaacaccacgtgtgtgttttttggcctcccatttgatatcgaggggggtctgggatgtggaacaaccggagtggctttttccccaacaagtggattgggccccatatagtacatttggggacactggtgcagagtacaaaatgaagcactcctttgggacggcaaacaattttccgaaccggctgcaaaacatatacaaccgacaaacaacacaacacgcctcgtcttcgtcggcgg

SEQ ID NO: 540857 - DNA, 1514 bp, Homo sapiens
  misc_feature (196)..(196): n is a, c, g, or t
ggtacggatccctattggagcaggctctgataacgaattccaaggagcgaccgctcagatgcgatgatactgacgtccacatgtgagattacgagtgccaatcggtgtcttcgcaccgtggtcacaatcaattcctgtcgagatagcgtacgacctagcgagagagtatccgggttacttaccgtctgctagcgcncctggagactatacgatagtggcgtcagcgaagtgcacgccttgtatcacgcagaaagcagaaggcccatcaagcgcagttcggggacttgcacatcgtttgagccggggacatgtgtctgacccgtaggtgcactgggtcgacgtgctgttggaaccattagtagatggctcgctgtcactaggtcggtgacgaactcgaatggggattgtatcttgggagacgcgcaaaggtatctgtctgcacaatggtttacctatgagaggggctcatgttaggtgagaattgcatggggtcaccgtagtggaaaacgatgtacccttgtattgcgtgccttgaagtcgatttacggtatgtagtgcagacgtcgggagttgcagtatagcaagaaatggggggacggtggacgatagttgattcacaaggcttcgtttggaagggttccaatacacgacagggagaggaagtgttgcgagggggtaacagacatataggggtaaccaatacttagaaaacgaatctcgaggatcccatgagaggaggtgtcccattccaattttttagataagagaggcaaaagcgtggcaattcttcgggtaattaggcaacgggtttcgagggcatccaagcgacggacaccagcacagggagaacattttgtcgtcgaccaacggacaaataggacaacgtcggggtggacaacttctcggaaacgaggggctgtcatcaggaccagttctacagataagttgaagacgcagaaatttgtgggcgagctagtagttgtaggacaaggccaattttgggcaaagtgagaatagaatttccccgtagaggattttcagttaaacgaagcccacaatgtggccggttatatatgacgggggtaccttcggggcaattgggtctgtatggccaagacagttggcgaaattaaaaaggaattataagttcctggattcccttatatagggggttgtgtggagatagaggcgtccacacaagttggcgaaatataggggaacggagagacaaaaccggccgaccaatggggacctttggtgggagaagggactgattggcgtatctggaggaagaggagactagtggaaaggcgggaaaaaaccaacatgcggaaagtgccatagttccaagtgagccggttgaaacaagtatacggtcgttagacgaagtgggcacacccgagtgtttagggctccactgttgagagcaccgagggggtacaaaaagatatcaatttgcggctccaggaagaacaaggttcgatataacttctaggatcggagaggaggtcaaa

SEQ ID NO: 540858 - DNA, 1017 bp, Homo sapiens
cagcaagagcactagaggaagagagagaccctcactgctggcggagtccctgccacactcagtcccccagcacactgaatctcccctcctcacagtttcctagtgttgaccccttgaacaggggaggggcctaaggatgccggaccttgtcatgtagccactcaataaagtaccctgtgctcaagaacgaacatacccaacgaatgcacgcagcggcctcaacagagcctccttgagtgccagcggagagctctctgcccgggagcttgcagcgcgtctaccgccagcgcagccgtagtccacagaggaggcctgaacacgaagccgccctgcgagcacccaggacaggggccccaggccaaatgcctcgacgagacgccagccaaacagcggggaaacccagcaggcccggaccgagcgtcagtcgcgaggacaaagccctcccgaccatcaaggacggcgtggggacgagcacatgcatggcaaaggggcaaaatacggctcgcggccgccacggcaggagccacaagcaggggccaccatgggatagcgcgatcgaatatagatagaccccaagactagaaggcaggaggccacactggatgaggtggaaggtccaaaaccaccacacggggaacgtaaactaaaaacgagaccgtggtgtggccacaaagcaaaccactgggacaggccacacacgtgggcgcaagagcggtaccctcctgcgtgcaatccgcaatcacccgcattcaccaaaatctacgagaggaagcaagcgtcatcacagtataaaacacaacaccacggagacatgcacggggaccaatgcatcagtgcaccgaaacggcacagaaagcaccaccaccagaaatacgcaaaggccaggaacatcgcgatgagccacagcacagccgacagtaacactgggatgacacccaaggaacagcaacacagcaggccggagtgaacaagggggagatggacagagagtgcacgtaacccaccagaccagagact

SEQ ID NO: 540859 - DNA, 911 bp, Homo sapiens
ggtactcgacttggtctgagacgatgatagagctgccttctggttgaagatgtggcgagtgaccaaactgagcctcagcctgtcgccttcgccccagagggaaaaccatctatgagaactcctctccgatgaacttacactggcagaccggtgccctcaccaactctggaaaaagatccccacgcttgctcctcgctgaccccatcactgtgcaagctggggctgccggaaggcagcaaacaactacatctccagatggatctcgtaaataacacgaggacagacttatcttcagaacatcttcagtcattcctcaaagtggctagaacacttgtcacgcatgaatcagatgagcagcctctagatccagatgccccaaattagctctactcctaaaaacgtctgaggcagcagtagacccactgggcaatctatatggttaaaaaacatcgtcctctgtaccatactccacaggggacagcaaacaacgacatgatatcagacggcccgttacagatacaacatggcagagcacacacagacatatcattcaacctggccctttgagacacagacgatctggtgagagaggaggggaacacctgcatggcagaacaggcttcgacacgaagctcggtcgctgttatctgcaggaaagctaatcttaacaaggcacatctccggacacatctcattagagcgaggcataccacaacataccgcatgatgaacacaactaccatggactccagacggacaagcctgtaagcagatccactagcacgtcgtggcatgaaaggcactcacaaacaacagaagagaaaagcacacacataggcaaccacaccacggaccagtggcatagcccaacaacaggaccgacaacagacataccgcgcaacacacggacc

SEQ ID NO: 540860 - DNA, 417 bp, Homo sapiens
agcagctctctactcagagcataatagcctcaggatattgagataacttactcatttgcatcgatctccagcgctcgtgtcaaggagaaaccatatcactgatattgattctgtattcgcagtgccaatattgaatagtgatctatacattgtgtactgtgttggcgacctgaaatccagagcattgagtaaaattctaatggcgaataatacttgacctagtatggatatacacagcactcagaaccccatttgtattcgtcagggggtcggagaccacctgttctggggttggagcagttcaaatgcgtagtcctcggtcgtactagtctgtctgcctgaaaacaaaggcaccctactgcgcttgttgctgtgcttctggagaatcctgctgtgcttggacaattaaagaacaaa

SEQ ID NO: 540861 - DNA, 355 bp, Homo sapiens
ggaagatttggaattggggttttaaaaattcccggaaagcaagttgatgcccagaaatcagggcaaacccattttttgttaaaccccttgggaaacccagaaaattcctgggcccccccttaatggccatctataattttacccctttatccaagattttcctaaggggaaaattatttaaaaaggtctattaaattgaaatttaaatcttgccccctatatcatggcaaaatgtgaaataaaaaaaaaaaacgtgaattttttagctaagcttgccagattgaaaaacaagggtcctttttttttgtaaagggggataaaacccctgtaaatgaaaaaagacctttttaattta

SEQ ID NO: 540862 - DNA, 249 bp, Homo sapiens
gtgaaaataaactccatctctactaaaaatacaaagaattagccaggcgtggtagtgggtgcctgtagtcccagctactagggaggctgaggctggcctggaggttgcagtgagccaaggtcacgccacttcactccagcctgggcaacaagagtgaaactccgtctaaaacaaacaaaaaaaaaagacttcacccaactaactgtgcttgtggagaaagaggttgcatccctgttccagtcatggcca

SEQ ID NO: 540863 - DNA, 411 bp, Homo sapiens
  misc_feature (17)..(17): n is a, c, g, or t
  misc_feature (258)..(258): n is a, c, g, or t
  misc_feature (321)..(321): n is a, c, g, or t
  misc_feature (354)..(354): n is a, c, g, or t
  misc_feature (371)..(371): n is a, c, g, or t
  misc_feature (388)..(388): n is a, c, g, or t
tctggcatatttaatgnagcataatggcctctgggatcatccattttgtggcaaatggtgggatttatttatatattagggctgaataatattccattgtaagaatatacactattttcgttatttactcatccataaatgatggacattaatgttgtctccatgtcttggctatagtgaataataccataatgaacataggagtatagatatctttccaagatcctgatttaaattcctttggatatatactgagangtgggattgctagatcatgtagtagatctatttttaattttttgactgatctccatgcttttncctagtgactacaccgatttacattcccatccnatagtgtacaaatgttntccctgtttctcccatnatccttggccaaccactccatta

SEQ ID NO: 540864 - DNA, 176 bp, Homo sapiens
cttttgggtaaataatgacattaaggcagaaatcaagaagttctttgaaactaatgagaacaaagatacaacataccagaatctctgggatgcagctaaggcagtgttaagagggaaatttcatagcattaaacaccacaccagaagttagaagactcaattacacctacatcaca

SEQ ID NO: 540865 - DNA, 223 bp, Homo sapiens
tacaatcgagctctgtacccccgctggccaatggcagtatctgccagcggaatggcattgtgcccatctgtggatgctgagatcctccctgatggggaccatgacttgaagcgctgccatgtatgtgaccgagaaggtgctggctgtgtctacgaggctctgagtgaccagcagatctacctggaaggcaccttgcttgaagcccatgatggtcaccccaggc

SEQ ID NO: 540866 - DNA, 522 bp, Homo sapiens
  misc_feature (65)..(65): n is a, c, g, or t
  misc_feature (432)..(432): n is a, c, g, or t
caagatctgctcaatgttaagtggcactgtacattgagaacgccacctacatgatgctgctgaantacgaggagagccggatttctctgcctctgcctaccttttcttccctgaaactgagagaaactaacctggagtcacttcctctggttgacacccactcaaaatgaacactcctgattaagacggttgagaccagagattgacaggtgatcaattgagacttctcagcatcacgatgaccttgaataaaaattgcacacacttggtgctacagtgcagtaccagcaagatggaaaaaaaaatcgtatcttgggaaaacagctttcaagtgcctttactgcagttttcagtgagcgcaagatagatttggaatagaaagaagctcagcacttaacaactgacaccccaaaagacgtagaaaaggtttanaaaataatctagtttacgaagaaatcttgtgctagaatactttttaaagtatttttgaataccattaaaactgcttttttccagtaaata

SEQ ID NO: 540867 - DNA, 588 bp, Homo sapiens
gcttatctagaggatccctcgaagctggcggtttggagtgtgaggacccggagcgagagctgaagaagcagaagcgggcagcccgcttccagcacggacactcccgccgcctgcgcctcgagcccctggtgctgcagatgagcagcctggagagcagtggggctgaccctgactggcaggagctgcagatcgtgggcacctgccctgacatcaccaagcactacctgcgcctcacctgtgcccccgacccgtccaccgtgcgccctgtggcagttttgaaaaagtcgctgtgcatggtcagaaaaaaaaaaaaaaaaacacaaaaaaaagcaaacaaaaaaaaagtgccactggaaagagaagcaggactacgcgtttgcctgcgagcagatgaagtcgatccggcaggatctgacggtgcagggcatccgcaccgagttcacggtggaggtgtacgagacccatgcccggatcgccttggagaagggtgaccatgaagagtttaaccagtgccagacgcagctcaagtcgctgtacgccgagaacttgcctggcaatgtgggcgagttactgactaccgaatcctct

SEQ ID NO: 540868 - DNA, 162 bp, Homo sapiens
tgagctcggtacccatcatatgccacgcatgcagccctcctgtaacctctactgtctacctacgcctaatctactccacctcaatcacactactccccatatctgacaacgtagaaagtatattgacagtttgaacattcaagaacccagccccattcctcc

SEQ ID NO: 540869 - DNA, 122 bp, Homo sapiens
tgtacatgcgtattgatgtctgccttctgcggttgtggacatacttctggtgggcactgtgccggaaacttgagcgatgaaatcacgtgagctgcatgcaacttagaaaggcatggcctgtc

SEQ ID NO: 540870 - DNA, 572 bp, Homo sapiens
  misc_feature (326)..(326): n is a, c, g, or t
cgggccctatacccgggattgggccaaaatttggtccaccttggtttccacgtgaccagggtttcttagatcctcatgaagttccctcgcggttggtggaagggccggctttacggccaggagggccttttcccaggaaaccacgtggagaaaatttgagctgggccctgggaaaagcctttttttttgcccgcctatttgcctgccggcctggtggggagccaggccctgccaattaaagccttgtttacctggggtgcaatagcctaaaagtccagtcctttggcctccagtcctgcccaggccctgggtcaccaggttattgntgcagcccccgcccctgggccctggttttcctccaacatcacacccggtgcccattttccatttttgtgtgtgtcaaagggggctaacagcagaatttccctccccactgccatgtgattaaaaaatgggttttgagtcctgtgctgttggcaaagtgccaggcccagttggggaggggggggtccttaacaagggggactttgctcattttgttttccctaaggcaataaacctttgcccggtga

SEQ ID NO: 540871 - DNA, 798 bp, Homo sapiens
  misc_feature (240)..(240): n is a, c, g, or t
gtctctcttgcaccctgccgtcatgtctaagttcagaagtctccgtaaagagcccggtaacagctgaggaagctcttcattgggagggtatgaagctttgaaacaactgatgaggagcctggaggtacgccgatttggagacaagtgggcgcaacgctgcatcgcgtacctgtgatggttaatgaagaagcatcgcaaaacaaccaatagcagcatcctagggtgcgttgggagatttgntacacatcagtgcgcactgctggcaggcaggctggcagtgcagaacctatggaagtgccaacggccgactacaaggttgcgcatggcaaggagttgtgtgggaacccaaaagagcatgcgttgtcgtccgagagacaagatacgtctagaagaccgaggggttgcctcacatttgaatccgtggtgggaacaagaggatgatctgggttcgggttgggcaatctaaacatgagacgacgacttgaaaggaagcaattcagcgctaaacggacgagtatactcttgtggaagctaggttcattcgcgcaatagacagtctcgacagggtggactttgacaacttcgatgaacgtggagcgcggatggcaaagatggggccaacaggaacgaatgggggcgtaggtgcgcgttattgtaaccgttatcttgtgactggagcgcatgggacttccctgttggtggattaaggattggggccatttccccggcaaagagttaaccaattaacttggtggcaatggggccggataaaatgttgtaaataattctgggaaaaag

SEQ ID NO: 540872 - DNA, 1540 bp, Homo sapiens
  misc_feature (804)..(804): n is a, c, g, or t
tcctgtggtttgtcgatgcccgtctgtcggcttgtggtggcctaatgcctgtgtgtgcttctgtgtgtcgttgcgtgtagcgcgcgccgcttgatttgccgcgcgtacggcgttgtgtgtgtgcgcccgccttttgtgggctggttaatatccgctgtgtggttttgtcgtcgcgagctttgttttctacacagtgttgctccccggggcgccccacagttgtgtgtagtcctgtttacttcccgtagtaggctgccgctctgtgtggcggtggctttccggtggatacccacactgtttgtgtctctgtgggccgaccgcttgagacttgtcttgtcccggcgcgttttggatcccccttgtcgcccggaccctcctgttgggttggagcccctgtgagcccgctcgttcgctcgaacgcgcccttctcattccttgggggtcgcctttttcgtggacacgtccttttctcttgtgatcgcccccggggcccgtggtgtgcccaaagccgcgacagaggcgtttctccccggggatggggcaccttgttgtcccgcggagctattctttggggaggtcgtcctacctcggcctgcccaggaagcacgcctgttgtgtgcgaggtcgaccccctttttcggaagggggcgccactataagggcggcctgggacctccccctgctggccacctcacgggcgcggtttcccaccccctttgtttggctgccccaagcaacccggccgcacaccctttggtgggacccatctggctgggctttcttgggaaggcccccgggtttccncgtggagctcccctttttcccttcccccgatattttttgtgggagaaaagaaagtggcgaaactttggccgctttttcccacgcggagaaaaggtttccggtaaacacggccccgcgctggaaagggaggagcccccccacgatacgcacactcgcacggagcgacacacagggagcccccacatcgctgagagtttctacggagaggccgcagggttcccctcgagggggcccggggcccctggagactccacagaaggttggaaccccgcgagcccctcgagagggcgacacctctgggttgttccgcggggcctcctgtttcttggaggaaaaccacttcacgcttcccacccgcaacacaccacactgtgggggttcttcgccttcggaagaagaagccgcgaagcacgcgaaagtggagacgcttttcggagttctcgggctcccacaaaactatccacgtgcccgccacaacgaacttttaactgccctggctgtcccaaggagtgaataatgtatggctcccacccccacgaggtgcacggatcaataagggacacgcgggggccacgggcacagcggcgtcgctcctctgctcaacacacaggagccaccacaacccctgccacgcacagccctgggagaccctgccacagcacagccctgggaaaaaggctgtggcctcaagggcgcctccccagtgcccagaaaataaagtccttttggattttga

SEQ ID NO: 540873 - DNA, 1030 bp, Homo sapiens
ggttcccgggaagcgggactccaaagtgggtcgcagtcgaagccgctactccacggagggcaacgtagcgcgttcccggtccacatcccgtggcagcgagaacgcaggcgccgaagacaagggtccaagggtcctccggcgagaagcagatcgggaggaaagcgagcccggctcggagaatacctcggacaccggaaaggactgcttccccggatcctcccagagaatgacacttagcattcgcacaattcttctctttcccccttatctcggcactcgggacatggacaacgaaaggcacgcattggacgggcacacacaggaaacggacacagccacaacctgcaaacacccacactgacgcgcacacatgcgaaaccgggggccgagacacttttaccctgtggcacgcaccacacgacactttttctccaccacgcgcgccccaacacaccaccagaggcagtgccaccgcgtacactgctcgtccgcccccctccggaccatgaaacaacgctcatcaccaagcggcgggcgcaactaacaaggcgcccatacccccactatgtggcaacctccaccgcaccgaacaaaagcacgcgcggcaaacacatcacacagggggccgagcacaacagggcgcctactcccttgtggtcaacacaaacttggtgccctctataaattgtgcgcccgcacatctaaccacatcttgtggtttccctattcaccctttaccgaagacgaaaacacgtcggtcaagagctggcgaactaaccagctctcttaaccccaacaacgtgggtcccgcacaagtggtatacacccacataagtatgtggccaacacaatctctccgcgagtcaacacccacacaccatggggggtcatgcgggagcactttatctctaccaccacaaccactcgagaaacacgaccccattgattagttgcgcagcatcatcttactccaccaatctatgggggcaccaagctttggcaacggacacacctttggtcgccacccgtt

SEQ ID NO: 540874 - DNA, 93 bp, Homo sapiens
caggcttattagaaggaatgaactaagggtcgaccatgattatttctctaagacggttggttagtaaacagtacctgctctcgaaatgagaac

SEQ ID NO: 540875 - DNA, 287 bp, Homo sapiens
  misc_feature (31)..(31): n is a, c, g, or t
  misc_feature (48)..(48): n is a, c, g, or t
  misc_feature (59)..(59): n is a, c, g, or t
  misc_feature (70)..(70): n is a, c, g, or t
  misc_feature (81)..(82): n is a, c, g, or t
  misc_feature (84)..(84): n is a, c, g, or t
  misc_feature (91)..(91): n is a, c, g, or t
  misc_feature (129)..(129): n is a, c, g, or t
  misc_feature (131)..(133): n is a, c, g, or t
  misc_feature (150)..(151): n is a, c, g, or t
  misc_feature (190)..(190): n is a, c, g, or t
  misc_feature (196)..(197): n is a, c, g, or t
  misc_feature (209)..(209): n is a, c, g, or t
  misc_feature (211)..(211): n is a, c, g, or t
  misc_feature (217)..(217): n is a, c, g, or t
  misc_feature (232)..(232): n is a, c, g, or t
  misc_feature (240)..(240): n is a, c, g, or t
  misc_feature (255)..(256): n is a, c, g, or t
  misc_feature (277)..(277): n is a, c, g, or t
  misc_feature (284)..(284): n is a, c, g, or t
aatcgagtagtactcccgattgaagccccgngcgtataataattacancacaagacggntgtcactcatnaactgtccccnngnttaggcntaaaaacagatgcaattcccggacgtctaaaccaaacnannncacaccgctacacaacnnggggtatactacggtcaatgctctgaaatctgtggagcnaaaccnnagtttcatgccnancgtccnagaattaattccccnaaaaaccnttgaaataggacccnnatttaccctatagcacccccnctacccncta

SEQ ID NO: 540876 - DNA, 296 bp, Homo sapiens
gctcgacattaaaacaaggatttaaaaaatggatcgaattatcccagcactttggaaggctgaggtgggcggatcatgaggtcaggagatccagaccatcctggctaacatggtaaaaccccatctctactacaaatacaaaaaacattagccaggcgtggtggcgggtgcctgtagtcccagctactcgggaggctgaggcaggagaatggcatcaacctgggaggcggaggttgcagtgagctgagattgcgccactgcactccagcccgggcaacagagcgagactccatctc

SEQ ID NO: 540877 - DNA, 1025 bp, Homo sapiens
agtgccattatggccgggggggggaaaaaaaaaaaaaaaaaaaaaaaaaaaaattgtgggccgcctgggccccaaaaattttaaaacaatggtggggggcggcggggccccaatagggtaacgtggacatgtgggcataggactggtacccaaaggagaaccccgggcgcatggataacgtcgtgggcgttctcacaccaattaaaaaaagcgccgggggcggaacacgggtcgtgtcttgagaacacactcccaaacagggaggcgtccgaagcggacataaggggactctacacaaggggagagcccacggagagccgcagaatacaaaattaaacgcccacggacgatgtgaggtcatcgagaaacaatggtacggagcacaacagaaagacgaaatctggcggagacgacaggcagacgaaccacacaaaaacaggaactaggagcaacccaagaacaagccgaacggcgcacacgcgaccagtgggacccagaagagcataacaaatatgagcgccaccggctagaacaacgagcagcgccaacaataggctcaaacaatagtgcgcaccgctagcaaacagaacaccaggagaaaaacccacacacaaaagatctgcacaaaagcaacacaaaacatctagccaacaccaccgccagcagacgcgataggacaaggagcacacgcagaccagaggaccatcgtgaggacaagcacatggcagaccaagacgcagaaacagacagcgggaacacacaacagcacgagcagaacacgccgaagtgggtcgagaaacggcaggcacacgggcacaagcagaccaaagaacagaaccaagagaaagtgaccagaacacccggcgaaaacacacccaggagcaaaacagctacataagcgagacaaacgtgacaaagaccgaggagaacaagcacaaaacaggaagaacgaaagacaacaagaagataaacaaaggccaccacaagcatacagcaagcagccaaacgagaaaacaacaacaact

SEQ ID NO: 540878 - DNA, 215 bp, Homo sapiens
atcactagtcaagacacagtactagggataggtttaaaaaccaaacagattctgggagtataatctcggttcagtgcgttgtgtaaagtagcactatatctgtaacgccaaacaatccaatgccattcctaggaacctaccctacagaaacaccagcttaaggtgactaaatgatacatctctagcacatttaagacagcattgtctgtaagagc

SEQ ID NO: 540879 - DNA, 864 bp, Homo sapiens
ggggagcgagagcgccaggagagagaagctcggtgggagcatgagaatccatcttcatcctagccggctccgcccgtgtttgcgtggaactgagcctgttgcgatgtgtcattgcataggagaataagcagtgcttatggtcgaggactcttttcaggcaccgctcgactcgtgtaaacgatctagcctcatcaatgaaccagactaagtggcgcgaagcatgcgctgttcgtttggacattctggcaacatgggttcgcaagcgcgatgccacgaatccatgcttgcaatactcagagctcattgcgagctggggactcagtccagtcgctgtgccaggatctatgaggagtggcaggccagcttcccaggacgacgcatatgcgctggacatatcttcgtgttccagaggccagctatggctgagtcagccttgcggggcacggaggccgtggcaggacaggcggcctagtccttacttagccacatcgttccgactagcgcccttacgtgggggtcacgtgaacgcgaataaccagtcgctctatacacttaccaataagataggcgatccccacaacagaagcttacaggcactggctatcctatgacattgccccaatgcaccccgttgtccccttgtgtttggcagcagatcgccgtatggggaagaagccccacaccaaacgaagcccacgaaatcccgggcaagcgtctcccggggacacccccctggcaccgagcgacccagccacgtaacctacggtacgccctcccgctgggcacactacccacgaggcacccgcgcaactccacccggagcaacgacacccctgggggcacagggctccaacaaacacagga

SEQ ID NO: 540880 - DNA, 172 bp, Homo sapiens
ctacagctcctgatgaattataaggtgaactacattcaggtgtctaataggacccctgctaaaaagcaacctgcaccctgctcttgagttcagcggttcgctggggatgaaggcagacactggggccctagtgcaatgggcgtcagcacattgcaggtgtcagggacggaag

SEQ ID NO: 540881 - DNA, 1395 bp, Homo sapiens
ggaaggctgcatagtgactgacaaaattctacgagagtgaatcctgcacagatagtgacagaggagcttaacactgaagacatcctcagtacacagaccccctgaccatgactgtgaaaaaagaacccagagaggacacgaaagggccccaagaaagggactgctgactctgggcaaataccaaacagacaggtgtccattagctggcttcttccaggagggacataaaccctgccatctcctggatagaatccagagaccttggcacgtggtcaaagggacgaccagaccaagcaaatggtacctcctccacgttaactagtggtaacgtttcaattctaagatactccaaccatcacactggtaatcaacaaagacctggataccaatacatacctggtgaggggacctaatacgtacttatcctaggaaacttataaaccaaaaaagcggcccagttcactcgtgggggcagaccacgggagtggcacaaaacaacggcgtggataaaacccgtttcctaaacttgagccgtaataacacaaacgccaccatagcatcatcatggacccctaggtcacctagggaagaaacggggaaatattaacgtcaccacgacacattctaataccattgggagaacgccaaggtatcacatcacaggaaacactattcataccaaatctgtcaacgggaccccatgatcaatgatgaggccactaaacacacccaacctggttgcccgatccccaacttccagagcactaaatggccccctggaatacccggacaatccatgcgggcaccagagaaaactctatcttcaccctaatacatttggattacaccactccttggcttatttggtataacgaacagtacccatggttagaggagacagtccacatccaatgcacttacacaaattcccatggtggcactaacacgttacacgccaaccgttagcttcctaacacataaagataaccgaaacaactacatgggaccccaccataacactaacctggcaacgccagaccctccacgcacagcccaacaaaagctacgggaggaccacacacgccgcacgccgaacaaacccccgagaaaacacaacaccccagataacagcaacacgggacccccaccaacccaccgacatagaagacgcccggcacactcacagaaagctcgaggaccacacaggaccagaggcacccgcaaacgcctgcaaacaccacaaagaccccggaaagaccagaccacgaacagacaaacgaaaaaaaacgaaccacgcccatagcgaggagaccgcaccgcggagaccgacccacaacacgaacagagagaagaaaaacaacggcccacaccaaaaactcacacgacagacgcacg

SEQ ID NO: 540882 - DNA, 5298 bp, Homo sapiens
gccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagctctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggctcgcctggtgctgggagcagtgtccctgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagatggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacacaggtggactggggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgccccaaaaaaaaaaaaaaaaaaaaaaaaaaatttggtggggccgcctggccggcaagaaaaggttttctaaagaacatttcgtgtggggcgcccctggccccatttatgggtaaggtcacacttgggcccaacactggtccccaagagaaacctcgtgggccaagactcgtgggtgggttcttcccccataaaaaaacgcccgcggcggaaaccgacgtgccggaccaatccaggggggtccgacgcataccggtccacacaggggccagaactattaccgccgccggagggggggc

SEQ ID NO: 540883 - DNA, 101 bp, Homo sapiens
ctatgagcatgagggactcctgcactactatcacttagatcacagtgcatgatgttgcctgggttcccaccacagcctccccacaagatcaccacagtacg

SEQ ID NO: 540884 - DNA, 869 bp, Homo sapiens
catggtggctcacacctgtaatcccagcactgtgggaggccaaggcaggtggatcccttgaggtcaggagtttgagaccagactggccaacatggtgaaaccccgtctctactaacaatacaaaaattagctgggtgtggttgcgcctgcatgtaaatcccagctactggggacgcagaggtgagagaatcacttgaactcgggagatgaaggttgcagtcagcagcgatcgcgtcactgcactccagccttggggaaagagtgagaccccgtctctgaatgaatgaatgaatgaatgaatgaatgaatgactgaatgaatgaaagaaacttgcctttagtcaaataagggacacaacaaaattctaaactaaatccaatgtctttgagctctacaccatcacgccacaagcactctagcccactgcttcttaattgacttgtgatggattcctatcctgtctaccaacttgccaatgtgaatattccttataagtactatcactgagtcacagagggcaagacgagaagacacgcccaacgaggcccaacagcgggacggagcaagccaacgacaaggcagaccacaaggcacaagcgcacgctcatacaaaccagggcagcaggcagaacagtacacagcgagcacagaaagcgagaacagggaaggaagagaggcgaacagccaagagaacgggccggacacaagagaacagaagggcacatagaaaggtcaggaggagagcaagcgaagcggaaggagaaagcgaaagggacgcggcgaagacgggcgaacacgacgcagagaagcggacgacagagaaaagcagaggaggcgcgggaagaagagaagcgaagccagaggacacc

SEQ ID NO: 540885 - DNA, 251 bp, Homo sapiens
acttgatgctgctggtcgctctagagatcccctgcattcccgggactgtttgggtcagtgaaggtcccatctggcagcctgatcctgtatgcgacatctggtcatactcccgcttggtgggaggctcctggcttgcggagtacgagggaacaggacctggctctggagcccacctgggggtggctgagagcccagcactgccaccatacttcttggcctctctctgctttgtccctcccgatttgcagggt

SEQ ID NO: 540886 - DNA, 443 bp, Homo sapiens
aatagttaggagtgtcgtgatcatgatactctataatctttaaaatgcgcaactataataactacagagattcactggaagtataaagaaaatcttgccgggcgtggtggatcacacctataatacccacactttgggagggcgaggcgggtggatcacgaggtcgcgagatcaagagcatcctggtcaacatggtgaaaccctgtctctactaaaaatacaaaaattagctgggcgtggtggcgcgcacctgcggttccagctactcaggaggctgaggcaggagaactgcttgaacctgggaggcagaggctacagtgagccaagatcgtgccactgcattccagcctgggcgatagagtgagacttcatctcacaaagaataataataataataactattttttaaaagataaaaaaaggcaggtgtggtagctcacgcc

SEQ ID NO: 540887 - DNA, 246 bp, Homo sapiens
cggagatgataatgatgtatcatgtaggtgtatgcatcgggtagtctgagtaagtagagggcattccggataggccgagaatagtgttgtgggaagaaagttagatttacgccgattaatatatagtgaaatggattttggcgtacgtttggtctagggtgggtatgaacaatagtgcaggtctgaacaacagtgcaatggatatcggcgtaggtttggtctacggtgggtatgaacaacagtgca

SEQ ID NO: 540888 - DNA, 154 bp, Homo sapiens
gcttcttcagagcaatacgccgccgtttgtgctgcaggacacgtggagtacaagacgctgaatcttgggtgctttgggcctaggtttcttaccttcattatttaagggcttgcttgcaacatactggcggacatcatcttctttagagagattg

SEQ ID NO: 540889 - DNA, 131 bp, Homo sapiens
tggtgataacctggccgtcaggcagatcgatagctcgtctaccagtggaggagctggaagcagacgtggccatctcttgctcgaagtccaggacgatgtaacacagcttctccttggatcttggcctcgtg

SEQ ID NO: 540890 - DNA, 206 bp, Homo sapiens
atccatgcccttgagctcggccagttgccgggccaccagcgagacataggcgggcgagttgagtttgccgcggtgcggtgcaggggccagataggggctgtcagtttcgatcaggcagcgctcgatgggcaccatgcgggccacgtcgcgcaggtcgcccgcgttcttgaaggtgaggatgcccgagaaggaaatgtgaaagcccc

SEQ ID NO: 540891 - DNA, 327 bp, Homo sapiens
ttgggcaaacctttttttttttccaatttgggaacctcccgggaaaccggtttccctaaggatcccccagtccccataaatgtgggttggaggcctgggaaagacccctaaaggaccccccaaggtttatgggacggggttaaaaccgttttgggcctttttggaagtcccaccttccccaacccgggggggggttctaaaatatgaattgagggttaaaaaattttccccttggattccctttgggaaaaggtttttttttatggggcccccgaggggggtttcctttttttttttttcctggggccccacccaaaaaaaagttta

SEQ ID NO: 540892 - DNA, 282 bp, Homo sapiens
cctatgaccaactacagaagattatagtggctatagctgaagttgtataaacagatccgcaagattataaactgcgtgactcctatgtacctgtagttttttctacctagtgtagcaacactacatattgagtctcctcaaacacaattctgccttataacaactcttcattcattttctttaacctcaaggctttaatattcccacacaaaacatcaggtgcaacactggccgggcactgtggctcatgcctcatacatcccagctgatcgggcagcatga

SEQ ID NO: 540893 - DNA, 402 bp, Homo sapiens
gacgtctctgcctactcatttacttcacttccgactcttggcaacttcagcactaaaggcactcctgccgtcagcatgattttcaatccctcctcaccagctacactctacttctctcccaagaaaggtcatgctcacgccctgaacttagcatgatggtggggagtggggagattctggtgacaggaggaaaggggcaggaaacagcaagaccaaggcagcaagaagagaaaaattagcctgatggaggcatacacaaacagatgaacacctgtgggacaaggggttatgaaagcaactaaataaagcaccgtctagttcttagattaaaattagtcaagaacaaaacttctaatcatataagctccagaatcctgacagtagcttgcatttttagagtca

SEQ ID NO: 540894 - DNA, 900 bp, Homo sapiens
agcggactataacgggagcagccacggcgaggcagacatgcgcactttgaactcgcggtgcgatgaaggagtaggtggtgggatctcaccgtgggtccgattaccctaattctctggccttgctgtgtttgtacgctatcatcgagacattactgagaatgggctagttacgtgataagggcgttggaagacagagactccaggaaaaaaggctcaagagcaaacggcaggtatatcactggctcggcaagaatacgaccgggctatgacgagtttgcccaaggtgggaccggtattcgatcgaacaactaagaattcgtatgagatcagaccgctaggtcataggcactgtagtggcgctgccgtagatgccgtgtggtgatacatgtggcaagactcattcctggaagatacctacacctggcataagtgtaactggaacatggagtaaggaaaatgcgtccaagaaagacattgataaggtaagaagcgtagttacgccctcgttcatcgttgcatacttagtcttaattcgtgggagactgaaggaatttggatttcatctcagtcaatggctatcccaatatggccgggtgtgtaggtgtcaggtccagagattcatcaaaatctctgatctcgggaaagaacatgtgaccaatgagaagtgactagtctagaagcgatagccttggatacccttgttatctcgagtgacgtctagagattactctaacagttgtaccagtgttgggtgattccaggtgaatcgtgggatctcttgtgaaataaccatagattgtatgccttttctcgtaattctacttggagccaacgttggaagttgaattagggttttcaagcatccaaaattattctgcagttccgatttcttaagccaat

SEQ ID NO: 540895 - DNA, 137 bp, Homo sapiens
  misc_feature (42)..(42): n is a, c, g, or t
gctctacgaggatttcagtactgccaggtaccacactcatancaccaagaaccaccaacacactcatacacagacatacagacacacacaccagatatgcacactcacacatacactcagtatgtgggtgtgtgtga

SEQ ID NO: 540896 - DNA, 272 bp, Homo sapiens
aggccccccccccccatgggggggttttgggattgataaactgtggaacctcccccctgggctccccaaagcttattaaccccttaactgtatcggggcggggggggtgtgggcatggaaaaagcctgggctgtttttgctatatgtaaataaagcccttgggtctttatttttgattaatttgttctgattttttggtttgttttttaaggacctgtaatgaacaaatgtcgggatatcccatccccaataaaaatgttgtttttttttta

SEQ ID NO: 540897 - DNA, 190 bp, Homo sapiens
agccccataaaaccagcagtcactgtaaaattggaaagggaagaactggcagaagcgtcttgcgggggctgccggcagcccccgcaagacgaggaggaggatttcggtaaggaggccgaagaggaggcctaaggcagagcccccgatcacctcaggcttctcagttccctttagccgtcttgcgggggct

SEQ ID NO: 540898 - DNA, 123 bp, Homo sapiens
ttgtcggatgtggtcatgtggacatccaggacacacgaggactacattgaatttgccagcctggatggctccaactcgccacgttgtgctgagccaggacatcccgcacatccgtactggccg

SEQ ID NO: 540899 - DNA, 239 bp, Homo sapiens
ataatcagctcggtaccgggcagtacggatgtgggctttaagtaggaagactgtcctggctcatgcctgtaatcatagcactttgagaggctggggccagaggattgcttgagaccaggatttcgagaccagcttgggcatcacagcgagaccccttctctacaaaaattttttttaaaatggagtcaggcccacgtggcacattcttgtagtcccagctactcgggaggctgaggtgg

SEQ ID NO: 540900 - DNA, 375 bp, Homo sapiens
tcccccttgagcccctcgcttcccgacgtccgttcccccctgccgccttctcccgcacgcgcgcgctccgaggcgaccacgaggaaaaggagtcgtatcgatgtccgtatccagaactcatctcgaccttggctgatgcaagtacgggtgatgacgtgcttcctgctggcactgagcataatatccatataagaattcaccagagaaacggcaggaagacccttactacttgtccacagggatcgctgatgatcacgataaaaagaacatagtgaaggcgtctacgcaaaaagttgcctgcacatggtactgtaatggaagcatccggaatatggagaagtaattcacgctacagggtgacaacgcaagaacatt

SEQ ID NO: 540901 - DNA, 398 bp, Homo sapiens
ttctgtctcagcaacttccgtagtttacagactttggagagcccaagctaactaggggcagaagtggtacacccacacagcacagctgctttataaaagtgtggctagactgcttctttaagcagatccctgatcccactcttcctgactgggtgacacctcccaaccagtgtctccagccaccacctaccacctggttgtttgggccagcaaccaggtctgtacccctctgggacagagctcccagaggaaggggcaggctgccatctttgcagttttgcagccttcactggtgataccctcaggtactggaaaacctaaggcgactagggactagagcagatgcccagcaaaccccagcagccctgtgaaaagtggccagactgtaaaaaggaaaa

SEQ ID NO: 540902 - DNA, 289 bp, Homo sapiens
agcagctgcacgcatgctgcaggtactctaaggatcccccatgattagatgtgaatcaacggggttccgatttgccgatatttctttaacgtcgttgcatgctaccttatgaggatagccatgtgtagggttgaccgtgcgtgtaatcatgacttgttgagtcgcttgtacatatagggctgttaattgtcagctcactgtcctggtctgacgcaggcgtatgcggcggagaatgtttccatgtatacctaatactaacattagttcttctatcgggtgatagattggt

SEQ ID NO: 540903 - DNA, 158 bp, Homo sapiens
tgccaaagccattgggggtttgcaggaacccccccgcccccctgctccccaatgttggaggccagcgataataaggccctgttggtttgttgaccgctgggctcgttggtgacccccccagccccgctttgtaaccagggaatacccagtctttttta

SEQ ID NO: 540904 - DNA, 241 bp, Homo sapiens
gccctttgggccctttgggccccagggggtgtgggcccttggggcccccccccccccagggggcccggggggggggggggcccctcctttttggggggttttttcccaaatttttccccccccccaagggttttccccccccccccctttcctttttgccccccttgggggggggggggctttggggccccccccttttttttttcccctataaaaatccccttgtcccccccccgaaaga

SEQ ID NO: 540905 - DNA, 108 bp, Homo sapiens
cattctccactggctgcttctgcatttatttgccttttttctttttctcttgctctaaggggtggtggccaccactgtttagaatgacccttgtggaacatgtgaact

SEQ ID NO: 540906 - DNA, 125 bp, Homo sapiens
  misc_feature (50)..(50): n is a, c, g, or t
gggagtcaatatctctctggaggtatgatctgtatctaacaacctaagancactaaagatctagactgataatgacttcagcaagtctcaggattacaatccagtacaaaatcagcagtactttt

SEQ ID NO: 540907 - DNA, 258 bp, Homo sapiens
cgaagtcacccgcgatacggtcacagactgggtgtgtatacgtaggaagcagtatatcaaaataagcaaagggtgagtcctcctttgtttttttattagaaacgctgtgacttataccaatataatgagaacactggagtgactttacacttgtcaaaaaaggaggcttgtcatgaatcaacaagcgatttcgcggcggaagttgctaggcattgccgggcttggctggatgtttgatgcgatggacgcgggtgaact

SEQ ID NO: 540908 - DNA, 184 bp, Homo sapiens
cgagagctgtccatcttctccttacacctagacaggtgtctcctctatcttagagtggccatcaatttcagtcacaatcatttagtcaatattgaacccctctgccagtaagccaataggcaaacgctcctcttcgtctgatccgtcctaatgcacggcattcctacttctcctatctctccca

SEQ ID NO: 540909 - DNA, 84 bp, Homo sapiens
caagaaggtttgcagttaagccaagattcattgcattgccacttgcacttccagccttgggcgacaaaagcgagattccacctt

SEQ ID NO: 540910 - DNA, 176 bp, Homo sapiens
ctttcggcgccgagccctgaagcagctgcccaagccaccgggtgctgatcactaacgggggcggggcacccctgcttacctggacaaaccagaggatgtggcatacacggactgctggacttcctgcagggcgctccacgctgaagcccagcactgcatgcatgggggtgggctgc

SEQ ID NO: 540911 - DNA, 788 bp, Homo sapiens
accagcccggcaagatgttgaaaccctgtctactaaaaatacgaaaattagccagtggtgcgcacatgtagatcccagactactggggaggctgcaggcaagagaattgcctgaagctaggaggtggaggttgccggtgagccgagatggggccactgaagcacagacctgggtaaaagagcaagactctgtctcaaaaaaacgaaataaaataatatattagacacatgtaaattaaattagtgatgtatcacaaaagatcaagaagatgacggaaaggtctgccaaaagggatgtctcctattcattttgctagcctaaatctttgtagtatgccctatgattttgaacacattggtaaaaatagataacagctactagagacagaatgaagcttatttctctttggctttttaaaacatttgaattcttttctgtaaaaattactgatactcagcaggtaaaggcagaatttataaaatttgtgaacagcagcatgggtatgatagagttctaaacatcttggattttaattcactcaatgatgaataataggctttagttaatctaaaagtgaattccttccaattgcatatggtaccaaacactttaaaactattttacatgaatactcattagaatctatattttttagagaacaaagattcgcctttactccaaagtttcattattttaacctttgtttgtctcaaggaaggtttggaataatttagaacatttaaacagtttcttttattctgtgtaatttcattggcttcctaaaaatc

SEQ ID NO: 540912 - DNA, 218 bp, Homo sapiens
ggagctcattgaggcgtattgtacagattcgcttaacttggtcaggggtagaggcccgtggtctcactcagcccaaaataggccaaagattcctccgtggttttagcatgagcggctccatatgtgctccctatcctgggggccggggccggtgtgttccttccagggggttcccactcgtggggggtcttcctcagtgtgtccatctgacccatctt

SEQ ID NO: 540913 - DNA, 174 bp, Homo sapiens
atagagaatgtgctaggaacttttctccctccccaaacaaaaagaaataaaaataaacaaatacaaaaatcagaatcgagtatactaactacagctcaacaattgaatcaaatgtcactgttttgtaaatactttatccataacgaaagatataaacatggcacatcttccaat

SEQ ID NO: 540914 - DNA, 447 bp, Homo sapiens
  misc_feature (151)..(151): n is a, c, g, or t
  misc_feature (160)..(161): n is a, c, g, or t
  misc_feature (171)..(171): n is a, c, g, or t
  misc_feature (179)..(179): n is a, c, g, or t
  misc_feature (193)..(193): n is a, c, g, or t
  misc_feature (206)..(206): n is a, c, g, or t
  misc_feature (209)..(209): n is a, c, g, or t
  misc_feature (212)..(212): n is a, c, g, or t
  misc_feature (242)..(242): n is a, c, g, or t
  misc_feature (245)..(245): n is a, c, g, or t
  misc_feature (388)..(388): n is a, c, g, or t
  misc_feature (425)..(425): n is a, c, g, or t
tctctagcttatccctgcacaattattagagtgaatgaaaaaccactttcctgctttccattgttataaattctaagcttaagataaaagtggttctttacatgactgaatcaattacaatttatgggctagagcaaataggttgaagacnatcatcctnncagctgattnggtggaantaggaattttcatngggaaatgtaaanacnacntttccccaacaaatggtccattgacctttnctnctgttttttgagaagagttttcatatggctgggaccacatttttaagcttttaattgttttttttttcccattgtccaaaaagttaagcaacaagtggccacactttttacgtgactacaacccggagttctgcaaagaaggnaatatttacctgggtccttgaccaagttatccccccnttccatgggtacctttaatttg

SEQ ID NO: 540915 - DNA, 138 bp, Homo sapiens
ccaaaaaaaaaaaaaaaagggggggcgcccccggtttaaaaccgggggggggggggggggaaaaaaaaaaacctccaaaatgggggaaaaccaaattcggggggttaaaaagggaccaaacaaagccctttttttcca

SEQ ID NO: 540916 - DNA, 812 bp, Homo sapiens
gtgaacttggcgtagtcttgttgggtgctgtcctagatgcgcccccagggtgacggagacacaccctctgtggggatgggattggggtggcttctgaggagcaggtggactggcctgagctggtcctttctgggtaccctggtgcccttgcctctagccgggtgggctcgtcttgcttgtgtggtcctagccatgtgtcatagtagggcgtggcctcttacagatcttcatgtgaaatggggctgtggttgagagctgggggcctggagggtagtcacagcacgagggacataggcccgactgctgaaagctggcaaggtttagcagtaggcgcccctgaagagtagtttaggagtaagaaggaatggagttcaggaataccctcacaggctctgcatgtgacatcagggctgccccgcaagttttggcaccctgagcctggaaatccaaggaaggcctggtgcaaggggcctcagggccgagggcaaagcaaggcccgggaagagccgagagtgccatccctgtccgggagcacgctgcgtcgttactagagagaagcccctcagtggggtgcgtggtctcacgtgcggcttaagttgggcaggcaatgggcttgtgaccaagttatcactcaggagcttgaatggagccgatcggggaagtcccacggcggggagggcatagtggcgctttagagccctgggcctgttgtcaggtgacagaaggcttgatccctttcggcacactgtcttggacccctgggggcgaggttaggctgcacaggggcagaggcgcacagcctgacgagctga

SEQ ID NO: 540917 - DNA, 249 bp, Homo sapiens
  misc_feature (21)..(21): n is a, c, g, or t
gtcatcaccttcactaaaagnaagtacagaaagaaaggaaaggaggaagagaagacaccaaaacacccagaaaacatcatacaaatgtcagtggcatggcatatgtaatatcagtatatcaaagagatgtctgcactctcatgtttatcacagcactattcacaatagccaagatttggaagcaacctgtgtccataacataaaagtgcaaactgaggatcaagctagaataattgactcaggtggtgt

SEQ ID NO: 540918 - DNA, 138 bp, Homo sapiens
ctgtaaggtgctcgggacatttgtatagcttctttggagaaagggccattcgagtcctttgcccgagtttaatttggactattcgatttgttttttgagattgagttgtgtggagcccgtttcactccatcattaatt

SEQ ID NO: 540919 - DNA, 140 bp, Homo sapiens
  misc_feature (2)..(2): n is a, c, g, or t
anctcctttaatcacagctactgatgaggctgaggcagaaaaattttttgaaactgagaggcagagtttgcagagagtcaagataatgccattgcaggacagcctggtcatcatgagcaaaactccaaaacaacaaggtg

SEQ ID NO: 540920 - DNA, 997 bp, Homo sapiens
  misc_feature (997)..(997): n is a, c, g, or t
gtgctcgcgtggaggcccagccagcctcatggtggcatggcagactgtggcagtcacgacgacattcacaggtcaagactaaacgagtctgaaatgcagatgtgagtggtctgaaatgcgcgagtactattctttatagaattgattcgtggaaatgctacctacaccatgcatatctcaaaccaagaaagaactttgtgaaaaatgatgcctgaggcatgataatttcacgaatgaagaccgatcttattctgcgatatggactcgggagagatcagtatgctaaaaagacctgtgcttttgcattgtgcaccaagacagcccatgctgactgaattgtgactgccctatcagtatcttcagctacagcacaggaatctcgtttccatcagtggccacttggctattagcatagctgctattatagcgatttctgacttttctttacaatgcttctgagggaagtaatttgaccactttagcaatcttccctatctatccatcattcttactataattccatatccgtggtcgatcggacaagagtctagccaactggttgccaatctactcctcttggccattgcgtgtaccatgcacacggtgtgatagcgagcgacttagtccgaacgtgtcataatgtgatacccatgttataagaaggttctccacatttggtttggagtaaggtggatgtctaacaagaaaagcagtcagaggcttctccaggttctttttcagattgtactggcattgccatgtcataagtctgtcttaaccccaaatgagggcgactccttaccggattcaagtttgcttaaactggggcaataatccaacagcgtccgaccaaagattaggcaaagatgcctggattgagcatgatgttcgcgccgaattggccattcatgtgtccctggcacatcgtgggaattggcaaaacgggtctggtggctgtgactctatccctctgtgatgactcttgactgcggagaan

SEQ ID NO: 540921 - DNA, 658 bp, Homo sapiens
ccctcaatcctgtcggtttaaaaagagaaatgtttatccggctgctctctttttttcttccccgggccccccacaccgcctcggtggagaataatattttttttctgtgaacacccccccccgcggggggtttgtgtgtggggggccccccgtggagacaccaacgcggggtgattcccgcccgctccttatattgtgagagaatttgtttatatacaatatatgtaatccccgtctgtttccccacctctctttatatatactcttttctcccccccgcgctgggcccggatataaagagatgtaaatatatgtagaggagtattttttctaccacgggaaaccacccccgaaccacccctccttctttttttttttcttttcttttgttttttttatattttaacacactctcttttatagagagagagatattatagaagggagaaattttgtttttccccccggaagtttggtggtccccgcccctctctctcctggtttcttgttttcttgtttgtcaccactctcccactcttgccccctttttctcagagaggggggggggggggggaaacacccgtgtttcccgccgttcctctcccgaggaacaaattgttgtgtggaaacaaaaaaaaaagctcccctctttttttta

SEQ ID NO: 540922 - DNA, 891 bp, Homo sapiens
  misc_feature (461)..(462): n is a, c, g, or t
  misc_feature (465)..(465): n is a, c, g, or t
  misc_feature (525)..(525): n is a, c, g, or t
cttacttgcagtaccatgttgatacttgaataaccatctgaaagtggtacttgatcatgttacaccatcattaaaggatgtgtattgcactttatttatggcccaccagtctcccccaagattagtacagaaatatccatgatcatacattacttacgtatgtgtgtacttggtttatacagctcctttgaaaactctgtgttaggaatatctctaatatacatagaaaacactacagtggtttagaagattactaatttatacttctaacgtcagttcataagacgcttgtcgtatgaaatgaccttcttaaatattgagttggatacgacgtgctacaggtaatagggactttaggaagcccttttatatgctaaaggagcatctatcagattacgttagaacatttgctgtcaggcacatattgtagatgacactaggtgcaatagcagggatagatnngtnggtgagtagtctcatgccttgagatctgtggtggtcttcaaaatggtggccagccagatnaaggatgtagtatctcatagttcccaggtgatattggttcgtaggtagaagagagtattataactcatgtgttgtttgacagcgttatagagttgagaatgttcgctaagggttgattcgtatatgtgtaagtggttcgttggttccagtgctatatgtagattgtttttggatggtgttacatattatatgttgctagagacatgtaatcctggatttacccttcttgaatataatccctggatgagatttatctatcataaatgcagaataatcaaatacacttataagcaagttaagtgtcctccaggcaattctgtattccagacttgggaagatgtacagttgcatgttgtgtgatcaaac

SEQ ID NO: 540923 - DNA, 1288 bp, Homo sapiens
  misc_feature (269)..(269): n is a, c, g, or t
agcgggggggggccgtgccgggcgccatcatggacgaggactactacgggagcgcggccgagtggggcgacgaggctgacggcggccagcaggaggatcgattctggagaaggagacggatgatgctggaggttcagcgaagaactgcctgcataaattttctcacctcgggatctatatcgatggaaccacatccgatcttcaacgacatctgaagcaggctattttcatgcgcaggatgggatctcgcagatgaattgttagtccangcctcttatcttcgataaacttgacacctgcgtgtggccctagggacgtgtgaacactgcgtggctccgagctggcgtcagtactagacgaggtgtctgagccatgtgcacgcgtatcacgggataactaggtgggagacatagccacgttgtcacagacagttttggctggcactcacaaagctgatgtgtccgcacgccctctgcggaaaaagctatgataatcgtcatgttgtctcactggggacagggaaaggaaggagaacccgcaaagctggttggccatggagggacactagggcatggactttggccagcgacatacgcaaccgtgttgggtccgagcgaaccctttttctctttggaaatagacagaccatggggacctggacaaacggcgcccaagtgccaggaaacgtggatttgtagaagtagccctggagaaacctttatcgacacggtttataaggaccggccgtttaggtttctccttgcaacggcgacggcggggtaacccaaggggcggggaaagggaggtccaccaccgagggggtgggtgggttccccaactaaggcaatgttgggcgcgaggcgcaagggcggtaatgagacaacggattggtgtcgctccgggaaagaaaggtgggcggtcccgagaaatcccctttcattccgttaacgggcgtttagccacatctcttgttaacgaacgtggtggatagcggaaagaaaacacgtaaaaacaacggccttttgagcaacaacaagacaccatttgctgtccccacctggggaggatttttcggcagcaagagagcgaaagtcgtgtttggtgtagtccccgaccggcgaggagcgaaggcgcagaccgaaacacgggtaaacccgcatgggttgtgtccgggccccgcaaggaggcccccgaggtggcacatttgcgtctccctgtgaggcctgggggggacccccagcgcgcgaatggggacccgccccacggtggggtggtggcggctgcccca

SEQ ID NO: 540924 - DNA, 740 bp, Homo sapiens
  misc_feature (666)..(666): n is a, c, g, or t
  misc_feature (681)..(681): n is a, c, g, or t
ggcgctggcgcggctccaagaagatgcgcatttgctactagcggcggacgcggacggacccaggccggtcctcacgcgcccagcacgcgccgctcccggctaacccggagcgcgcacctgataggccgagcggccagagctcgcgcatcccagcgcatcactcttccacctgctccttagagaagggaaagatgacgtgagtcgagctcgagagtccagtcctagctcctatggcactccaatgcgatgcgaaaaggacaggcactgagtaagctggggccgcgtggcgaggcctgtccgcgaatgcaagccatccaggtagatgttcccgggcactatgcgcgttggtcatgtgagaagtacagagaggagaccacagacgcacatgctgccaaatcaccgtaatggagtaacttcgcgtggaccgaaccagaaggagtaacgcagaagaatcatacgcggtgtctcgccgaagaatcctcgcgtagaaaccatcgcgaacagactcccagtgcaacggtaaaactcacaggtgggcatgactcactagatatacaactaggcaagacaggacgcgaaagcagggaaggaggcatcatcagcatgggaggtccatcgtgcaggcaatggacgcaagatgaaccacagtgtccgtagcctgaccgngactaccgttcactngcgtacgtgaggcaacagcttcccttgccctgcggacgtggaccagcatttagcttccg

SEQ ID NO: 540925 - DNA, 690 bp, Homo sapiens
  misc_feature (573)..(573): n is a, c, g, or t
  misc_feature (618)..(618): n is a, c, g, or t
  misc_feature (650)..(650): n is a, c, g, or t
  misc_feature (677)..(677): n is a, c, g, or t
taaaaccatagtgagataccatctcacatcagtcaagaatggccattattaaaaaactgaaaaacagcaaatgtttgtgaggatgaagagaaaagggaacacttatacactgtttgtgggaatgtaaattagtacaacctctgtggaagacaggatgggtatttctcaaagaactgaaagtaggatctaccatttgacccagcaatcccactgttgagtatctacccaaaggaaaataaatcattttatcaaaaagacacctgcacttgtatgtttattgtgacactattcacaatagcaaagtcgtgaaatcagcctaagtgtccatcaatgaatgattggataaagaaaacgtggtatatatactccgtgaaatgctactcactcataagaaagaataaaatcatgtctttgcagcagcatggatggatttggaggccattattctaagtgaaaaactgcaatggaaaatcaaatactgaaggggtgcgttgcccctccacacctgtgggtgtttctcattaggtggaatgagagacttggaaaagaaaaagcacagagacaaagtatggngaaagaaataagggggcccaagggaccagcgttcagcatacgggnggatcccgctgggcctcttgagttcccttagnatttattggtcattcctggggggttcncggaaagggggat

SEQ ID NO: 540926 - DNA, 219 bp, Homo sapiens
ttcagacgctggagtccaacgaggcaggatcattgagacaggagttcaagaccatcctgggcaacatagcgaaacctcatctataaataaattataaaacaaaaatgagccgtgtatagtggcacatgcctgtggtcccagcaactcaggaggctgaggtaaatggattgcttgagcttgggaagttgaggctacagcgagctgtgaccacaccaccgc

SEQ ID NO: 540927 - DNA, 388 bp, Homo sapiens
gcagcggaatgcccgggaaacaggaaacggcggtgggcgcggtgacaacgcacagtggcgatgaggactatcccaggggacaggaatgaccgggccaagggctcggcggggagctgcagttgccgagggggcagtgagagtcgagcacagagtccttcacggagcatgaacacacgctgggcgcgtcagcacaattccgcgtctccgtcttccaaaggaaacagtacatgatctgtcacatccagctgccagaggagaaaagcctatcaaagacagttacaccccacatatctctcacacacacacacacacgcacacacacacacagagatctaacgtattcaaactccagcccttgcgcgtgatggctccttggggtctgcctgcc

SEQ ID NO: 540928 - DNA, 155 bp, Homo sapiens
ttccgcgccttccgctgctcctttccctgagcaccttcatcaccagaggcttgaaggaaccccgtccatgtggtagggccatggcactgttcctggttgcaccttggaccgacatgcatgtccgtgctctcgggattgtcgtactctgtatggca

SEQ ID NO: 540929 - DNA, 666 bp, Homo sapiens
agcgggtgcagcgcgcgcagaagatcgcgcagcgtctatcggcgcctctactccgagagctcacgccgcgttctcctcggccgcctctggcgccggatgcacggacgtcctggccatgcctctgccttgaatggcaggcggtaagcctggacgtctaacgttaggggacgcacggagcaggatccaggcaggcaggagttgcagagatctattactgagatgaagcggttggaagaaatgtcaaatatgtctcagagctctggagtccagcgaccaccctccagaaccaaaagcccaaacagaagggacacgaagatgacagccagggcaaagagcaacgtacgggaacacggtgctgcgactacagaaacagcttgtcaagctgtggcgagacgcccaaggacaggcacccagctattaccagataccgagtacacaggaacctgaacaacagatgtgaaacctcggcagtgcttcaaaggtcagcatggacacagagtatagaacaaaaatgggatgccctggtcaatcaagcaggaggtgatgagaggcactgtggcaagaggcaccgaggtacattcacatgggttaacccatcacccttatcccaatgatactcacgggataatgtaaatgttcggcggacatagtgtggactcaggaaaa

SEQ ID NO: 540930 - DNA, 132 bp, Homo sapiens
gttgtgggaccgtttgttaacacggtgacactgtgggtctgacttttttcttcgacacgtccctttcctgaagtgtcgagtccagtcctttgttgctgttgctgttgctgttgctgttgctgttggcatctt

SEQ ID NO: 540931 - DNA, 226 bp, Homo sapiens
  misc_feature (116)..(116): n is a, c, g, or t
  misc_feature (198)..(198): n is a, c, g, or t
cagtgagggtaggaagaggaggtggcgcagtggcagaataagcaggctgttgtacagggactacaccatctctcaagccatagtaaggccttgcctgaggcagagctatcaggganctgcagaagtggtctcctgtgggagggctctgactgtgcgactgaccaaagagcttccattccctgagcatggtgaacccanggtcctcagttctcaaccctccaggggt

SEQ ID NO: 540932 - DNA, 186 bp, Homo sapiens
ggtggcaccagattgtgacaggttggagtgagcatggctcatggatcagtgcagctctgaactcctgggcataagcgatcctcttgcctcagcctcccaaggtgttgggatcataggcataagccaccatccccagcccattttttttttcttttaacttgcttcggtgagcaaggactccttact

SEQ ID NO: 540933 - DNA, 326 bp, Homo sapiens
gtcttcaggatgcgttataactaaactctctccggagacagagttcctaacgcttcagtgaagtacagagactagctgacttcacacaagaaccagaaggacctggtgtcctctaccgcatgatgaacaaactggacaccaatcagtgatggtcagcttagattctcacaatctcttaatcagatcggtggcctagctactgcctgccatgactccttcctcaaggctgtccctacccagaagcggacctgaggaccccttggtccaggccttcaaacccaccccctttccttccagcctttctgtcatcatctccacagcccacc

SEQ ID NO: 540934 - DNA, 555 bp, Homo sapiens
tcatgagtcgttgatatgatattataggaagatgcgatagtgtcgatgagtaatagaatcacgaggcatgtcgtagcaccttcgtgaacaggctataacccactctacagcatatccctctggtagtccatcattgagaacactggcagcaattttgaaatgaaaaaaaaaggaaggaggaaaaaaaggagctattagccccttttatttattctctgtttaaaatcaaacagaaaacaaacatcaatggttatacactaacatcttcaaagcacatcgttggtacaagagatagactaagaccaaaaatgtgtttacggagatccaaacataagtgagtgagagtgcctctcacacagctctccgatggtactcaggaggagccacttcataatcgcgggcacggagcaaagttgcagaattcttggccaggtactttaggaaatcgtgaagataatcgagtaataaagcaaggctcttctcatccagaggtgtataagccaacattgctccaattcgtacaactaatctcaggagatgtggcgctccatacac

SEQ ID NO: 540935 - DNA, 381 bp, Homo sapiens
cgaggaattagaagtagatagaaaccgacctggattactccggtctgaactcagtatcacgtaggactttaatcgttgatcaaacgaacctttaatagcggctgcaccatcgggatgtgctgatccaacatcgaggtcgtaagccctattgttgatatggattctagaataggattgcgctgttatgcctatgttaacttgttccgttgttccgctgttagcctcagttgactattgtcgttcgtcttgtactggtgtcgtctgagtcatgtactgctcctaggttggttacttgctccgatgtactgtgtcggaggttgagttgtgctcccaggttacctgatgctcgaagtcctgatcatggtcatatactgtattcct

SEQ ID NO: 540936 - DNA, 149 bp, Homo sapiens
tagacgtggaacacaaagcgtcctttttctttgcaggacggttgaacgaaaactctcttttttactaccagttgacgctcctccatctacggggtgtgcggagtcttgctcggaacggtcatgggcatatttcagaactggaacaaatc

SEQ ID NO: 540937 - DNA, 502 bp, Homo sapiens
  misc_feature (58)..(58): n is a, c, g, or t
ttatggggcaattctggacttcactgacagaataggaccacttccaccagtctctganccctgatcttagagcaagcatcctggaccttctccggaatcgatgcagcatggagaaagagggcaggatactgttcgactgcagcttgagttgtctcctggtttactcctgaaccatgtgtggtgtttaatgagagtgcccagagtcatactgtacacagtatatggctctgagtttgtctataaaacattcattatcacaagtggctagagtgcactatgtagcaaaggctatacctatatatcttctacaatacaacatgttagctttctatcttcaaaccaaattgtttatcagtgttttcaataaaagtgccctgtcattctttcaaatatcatgctctattttgttacaaatatcagatacacgccaaggccagtagatggagccaataattccagacagcaggtcagtagatagcacatcagtagatggagcccatta

SEQ ID NO: 540938 - DNA, 456 bp, Homo sapiens
tgacgtgacaccgtgctaacaactgcgctccgcatatgctccactcttgatgcgcatgggccaagtagcacgcacagccattccgtacatcgtccacctccacgttctgtggcgtactctttcacgctctgccaacacctgggcgatgttggcctgaaaggcctggcccatcatgatgtccatcttctccaggttcaggttcatcgggtcgttgtccttcacgaagaacaccttcatctcatgcttcaagatctccggcctttcctgctccgcattgagcattgctcgtttctggctggtccccctgttctgcaactctgggctcggcttgactgcagtgtgtcctcggggtgggggcggcttcttgaggccgtgtgccgtaatactccaagtccttctagtccctctgctttaacttcatcaccagcttcacagtgtaggagctccccaccgtcg

SEQ ID NO: 540939 - DNA, 596 bp, Homo sapiens
  misc_feature (37)..(37): n is a, c, g, or t
  misc_feature (68)..(68): n is a, c, g, or t
  misc_feature (285)..(285): n is a, c, g, or t
  misc_feature (291)..(291): n is a, c, g, or t
  misc_feature (375)..(375): n is a, c, g, or t
  misc_feature (384)..(385): n is a, c, g, or t
  misc_feature (407)..(407): n is a, c, g, or t
  misc_feature (427)..(427): n is a, c, g, or t
  misc_feature (467)..(467): n is a, c, g, or t
  misc_feature (469)..(469): n is a, c, g, or t
  misc_feature (474)..(474): n is a, c, g, or t
  misc_feature (479)..(479): n is a, c, g, or t
  misc_feature (483)..(483): n is a, c, g, or t
  misc_feature (501)..(501): n is a, c, g, or t
  misc_feature (511)..(511): n is a, c, g, or t
  misc_feature (526)..(526): n is a, c, g, or t
  misc_feature (531)..(531): n is a, c, g, or t
  misc_feature (558)..(558): n is a, c, g, or t
taggcattctttttttaatttgagaaggaggttcgcnattgtcgcccaagccggagtccaatggtgtnattccggctcactacaacctccgcctctgggttcaggcgattctcctgcctcagcctctggagtggctgggattacaggcgcacgccaatccgcccggctaattttttatttttagtagagatggggtttctccatgtgggtcaggctggtctcgaactccctacctcaggttatccacccgccttggtatcgcaaagtgctgggattacaggcgtnacacantccccggcctttttttttttttttaaaaaaaagagaaaaaaaaaaattttacaagggaaaaagaatcgaatccagggcacctanaggataccnncacagggaggacaggaacagantcctaggatctgtgccttcnagccgatgcccttagaatgggagttgtgttcttgggtgtntngtctnctgtnaacnctcccgaaagaactcccncactggactnaacaattgaaaaganaactntgggtttctttttggaagcccgccgcngggtgtttggatgccgaagggtagtacggcggggctct

SEQ ID NO: 540940 - DNA, 122 bp, Homo sapiens
cgaactaaagatgtatatggatgctaagtgcccatcacttctctctgtctatacctgccccatctgagacacccattgctcaccatcagatcaacctttgattattccatcataatgtatta

SEQ ID NO: 540941 - DNA, 208 bp, Homo sapiens
ttctcctccttggttttcttcctcttcggtgacttctttcttctcctcttggtctttctctttttcatcctctgttttgactctcttggctttcttgaagttggaagagttcttgcggccccctctccctcctcttcagaatcggaaaactcttcctcacaggcaattcgtttggcagaggagcagatccagatgcgcttgtcagggt

SEQ ID NO: 540942 - DNA, 137 bp, Homo sapiens
cctgggggacctgttcggactccagtatctgtcgtcgcagggtcctgccctagtgcctatgtccttgctcggggccatggagacactgcggcagtacggcggcgcctctgtctgaagaagggggtccgtctgtctga

SEQ ID NO: 540943 - DNA, 385 bp, Homo sapiens
  misc_feature (33)..(33): n is a, c, g, or t
  misc_feature (148)..(148): n is a, c, g, or t
  misc_feature (176)..(176): n is a, c, g, or t
  misc_feature (180)..(181): n is a, c, g, or t
  misc_feature (191)..(191): n is a, c, g, or t
ttttaaaacacgctgctgtcctaaacaaatccngtttaaaggaattttaaagagatgcattttactatatcaaagaacatacgtgtatttgcctaaacactctgtacctttgtaatgataaaacttcccccttctttacggtgaagcntattctgattaagcctagactgtgttcntttnntttttttttntttttggtctgatgatgaatttgtgaactctatctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatg

SEQ ID NO: 540944 - DNA, 243 bp, Homo sapiens
ctgttgaccacgtgcacacgctttctctagatggctatctctacaactattctcatctgtagtttacaatgtgtagccaattttctttcatctcaaaacgctctggctgcaggctgctcccattgagtctgtgcttttaggacaagcaatgataggctctggggagggttaacctgaacagagagaacggaatgataagatcgtgcctgcgtggtacctctcaagtttcctgaaactaaaaac

SEQ ID NO: 540945 - DNA, 365 bp, Homo sapiens
taagagtctgaagtcattgcagcattaactcaaaagtccacagccgtaaagtctcatctgagacaaggctagtcccttctgcctatgagcctgtaaaatcaaatgtagttagttacttcttagatgcaatgggggtatagttattgggtaaatacacctgttccaaatgggagaaattggccaaaatgaaggatctacaggccctgtgcattgtcacaatctggcaggaggattgtttgagtccaggagtttgacaccaaccggggcagcatagtgagacctcatctctacaaaaactaaacaaaaattagctgggcatggtagtgtgtgcctgtagtcccagccacctgtcgggctagtcgggg

SEQ ID NO: 540946 - DNA, 288 bp, Homo sapiens
  misc_feature (29)..(29): n is a, c, g, or t
  misc_feature (99)..(100): n is a, c, g, or t
  misc_feature (102)..(103): n is a, c, g, or t
  misc_feature (107)..(107): n is a, c, g, or t
  misc_feature (249)..(249): n is a, c, g, or t
  misc_feature (268)..(268): n is a, c, g, or t
  misc_feature (280)..(280): n is a, c, g, or t
cctctcctggctcccaaaaatgctggctncgggcggggcgggggccgaagacgaaacgcccctcccaaaaacgccagcggctgggagatacgctctaanngnncccnttcagggaagagcgatacgcgctgatggattgagggagattagggatgaagctcttcttggatttggatattgctgatcggaattctaattagatctgggttctgagtggaattatgatttgcgctatttggggatggcttngataggagaggaaaaatcngataggagctgnggcagagg

SEQ ID NO: 540947 - DNA, 1548 bp, Homo sapiens
  misc_feature (235)..(235): n is a, c, g, or t
ttatacattgttcccatttctagttgacgattatttcttgggtttgaggttatcatcagccgcactctagcgcggtacggcgatcctatccacttatggcacgtcacgagcgcgcacgccagtctgtgtagggaccgcaacagagaatcgtcagcctggctgttgactggcgaggttgtcctgtgtatgaggagacttcagagagacgtagttgaacactcacataaaactcaantcagacagttagacagaccagtggtcgaagtcagacgattggtccaggaatcgtggagtttgagcggcagactctgggaggcagacgcggggggcagtcccaagcgtaaagcattgaaatagcgggacacgtatgcacgctgcctgtcttcgttgaggaacacacaaacatagacagagaaagagaagagccatcagaggggacgagcccagcgcatgccaaaccggatatctttgctccccctgacggagcggggcctgcccgggaccctcatattgcgcgcgtgtttctcccccttggggtcctctgtgtgtctctggtcttgtccccatttgcgttttgtgtactctctcgtgtagtctcagtgtacagtctgtccgtgtctctgtataatacacgttgtctaggggtactcacagtgtagcacccggtctcgtgttgtccttgacaacacggggtgtttacacccggagttgctgccgccgaacacaaagtactgagttgctgaagacccttccgtgggggccactgtctcctttgggcgtacaaagacccataccacttcttttaactcttgtgctgagcagaaaactgtgaagacacttgtgtgatctgtgatgcgaatccattaacatatctgtacccatcgggcgcgcatgaggtgctccctatagctttgtggtggtctttttcgcgttgggggttgtctttagggattgtctctaaattagggaagcgatttgtcccccctgtgtggtgtggttaccaccgccttaagggcgggccacaccgtggcattgcgggctttgggccttggggcgaaggggccatcaccgaattttggccggtttggggaccctttgcggctttttgttctagcccccacacattgtcatagtgtcttcccccgggtgctctacaatcattccacgacacccccactccttttctacatttgggtttggcccaaacccaaaaatgggcgggggggccacaagccgcccttggttggtaaccgggccccccggtgggcttcccctttccgtcgcccccgtttgcgaccaatttcggtgttttgacggggggattcctttggcctcttttttggttctaaaaccaaacccccctttttggcgggggggcccccttgtgtcccaactttcaatttccacacatttggtgacacccctttggtggccttttgatatcgggccccttgtggcgttgtgcggcccctctggggtttgcccctcttgtgtatgggctggggctatccacactgtgtcgctgtttctacacggaggttattttgg

SEQ ID NO: 540948 - DNA, 315 bp, Homo sapiens
aagtcctattctaggatcttcatcagactttgactgtcggcgatgtggagctttcctcgctagttgctgagttacgaacagtgcatacatagagcccgctatgcttagtcgtagtatgggggatagacagatcttgtcctgattgctgacactatcccatttcttgtccccgaatactgcgccggttggtttgagttcgcgaagcacgatcgcgtcgaggttatctcctgatcggtcattggtgtctgctgggtgaattctggggaggtctgggccatggagtagattcagggtgtctgggtcactgcggctggc

SEQ ID NO: 540949 - DNA, 524 bp, Homo sapiens
tacagactgaccgcggggaagttgcggagatgtgaccccggcccggaggaggctacatgcgggattacaagcggttacaagaggacccacctgtggttgtcagtgggcaccatctgaaaacaacatcatgcagtggaatgcagttatattgggcccagaggggacacctttggaagagttggtactttaacactagtaatagaatcttctgaagaatatccaaataaaccaccaacggtaggtttttatccaaaaggtttcatccaaatgtgtatgctgatggtagcatatgttagatatccttcagaaatcgagggagtccaacatatgattgtatcttctatcttaacatcaattcagtctcggcgtggatgaccgcgaatcctaacagtccagccaatagccaggcagcacagctttatcaggaaaacaacgggagaatttgagaaaagatgttccggccatgtgttgaacaacgctggaatgattcataatagacaagtggtcgtgtaactctttttcaa

SEQ ID NO: 540950 - DNA, 642 bp, Homo sapiens
agcgttcgtagacgagcggaacttctgctccttcttcatatcccagcagtactcagctcacttaaaagaatctttggtccttaagctgtggttcaaacacacatgattaccatcatccatgatctgaaaatttctcttccaaaccttcccgctttagtggaggaatgagaccaagtaaggaaacacatgtctggcaaagcatgaggatggcccaccgtctgctcaggaacatggcagttttgtgttaggaaacagacaagggtaatggatgggcagcgtactctgtggtacgagataatgctctccgtgtgatatgaaagttaaacaagggaggccttgaagtgctcgtcatagctttcgtggcattaagtctacaccaagcacctcgaggtaaaatcctcactgtcctcgggctgctggtggcctctgagctgtaacttgaggcatggcatttatcggcttccaaagggaagtgcttcatagcagtttacataaacggtatggattgtggagctttaaaaaagttctaatttgtaacatgtatgtaccacggcatgcacatatcattctttttctccttttacaagaagaggtgcttgagacgaagtgatgaatgttatatattacgctggaatggacttg

SEQ ID NO: 540951 - DNA, 396 bp, Homo sapiens
tgaattttcctcccagaatatttagaaatgtagaagcgataacagttcacagccaggtaaaatttaactggtggcttaatgactctgcacctttttctcttgagttctgcctaatttgtctgccttttctaccacctaaaaagattttttatttttggggtgtttttttttatatggtggtaggggggggtatttctatgtcaagagcacagccttgatgatctcagggaaaaattttaatcactgtgtataatgatactgaaccttgattaataacagaaattcaggatgtaaagccacagaatgggatttattaatgtgggatacctcagactgtttgttttctttctgggaagaaaagtgtgttctataatgaataaatatagagtggtttta

SEQ ID NO: 540952 - DNA, 187 bp, Homo sapiens
tgatgggtggagagcattcgtggaatacgagagacaatgaaagtctagaagacaagccatgctgtgctcataacaggatggactggtctgctcgccatctagtacatccctgtctggagggaggtggttggaggtcttcagtttcatggatcagtcgccttcctgctaagttatttgttagggtcct

SEQ ID NO: 540953 - DNA, 121 bp, Homo sapiens
  misc_feature (1)..(1): n is a, c, g, or t
  misc_feature (88)..(88): n is a, c, g, or t
  misc_feature (111)..(111): n is a, c, g, or t
nggacggccgagagctgtttgtgctgggagctggtggcacggtgcagggctcttaagaacgcggcttgggcgcggactggtatccggnggactgtgacttggcagggtccnccatggggcc

SEQ ID NO: 540954 - DNA, 195 bp, Homo sapiens
aaaatatatatgtatcctgtgggtatatacccagtaattagattctagagtagaatggtataactagtctgtaaggtcttaagagagaaatgccacactgtctttcacaatggctagaactaatttacactcccaccaacagtgtacaaacattcctttatctccacaacctcaccagcatgttatttttagact

SEQ ID NO: 540955 - DNA, 652 bp, Homo sapiens
aaaaatagacaagagaatgctgtcaatattggtgtactgtaatgtgaatctatgctggtgaaaacaaaaaaaaaaaaaaaaaaaaaaaaaaaaaaaaaaaaggggggggccgcctttttatttttttgggcggggtggggagacgtatacacctacgacgcagactttgaccgtgagaaagtgccgcgcccgggataataagatttctccggtgtgacagagcacaccccccattatgggccaaccccttctggtggcgaacacgtccccggggaggggggccgcctaagggggcgtcacaccccaaaggggcgcggcgtgggcgccccccacctaaaaccttaaaaaagccgcgcgaggggcttacggcaaattgaaacacaaccgtgtgaacaaacagggggggggaaactaggtatacgaaggggaggttagcaagaggggtggggctcacaccaattaagttggaagaagacctaacagggggttggtgaaggagaagacttaccccttttgtgtgccaaatgatttacaccagaaaacgtgggtggccacaatttggggggaccgcctgaaatgggagaactctcgggggcgcgaaccaaatttttgttgttcccccttatattaaacaccctgttgctctttttac

SEQ ID NO: 540956 - DNA, 344 bp, Homo sapiens
  misc_feature (178)..(178): n is a, c, g, or t
  misc_feature (196)..(197): n is a, c, g, or t
  misc_feature (245)..(245): n is a, c, g, or t
  misc_feature (247)..(247): n is a, c, g, or t
  misc_feature (254)..(254): n is a, c, g, or t
  misc_feature (269)..(269): n is a, c, g, or t
  misc_feature (276)..(276): n is a, c, g, or t
  misc_feature (282)..(282): n is a, c, g, or t
  misc_feature (286)..(286): n is a, c, g, or t
  misc_feature (299)..(301): n is a, c, g, or t
ctcacagcctttttggccttttcccttggggaggggccccctgtagtatttgccttgatttggtggggtccagtggatgtgaatcctgtaaatagcttgggctcagactcctttgggtggaaagggtgggtgcaggaggcaaaccctccccccaaagccccctggggagattttcctntttttatttaactgtaanngagggggatcccaggtttggggatgggggaccccttgggccccagganantggttgnttcagggggacccangcccccngccctngccnggaatcagggttnnngcatttgattaaatgtttccagaaataaagaataattttgcca

SEQ ID NO: 540957 - DNA, 1149 bp, Homo sapiens
ggaaagcaatggaaccatgcgattcatgaaacttgccccaggacatacagctatggttgtcccaggtcctgctgcgaggaggctggcaggtcctgctcgtgctggacactccattacttacccgtatattcctgatgggcctgggtcctctacttccaccactacttcccagccatgctacttctcaagcatgtagacatggcattctgtgtgtgacaccctccatgctggatctgtgcctggggcttggcctcatggccccatggtgaggggcatacatgtggcgggaatcctgagcactgctcctgggaaacttgctacaagattctacctcattccaccctcttggctatacgggatggttggtccccatggcccaggaaccccaaagtccaaatggcaggactaagtgtggctggacatcatgggacattatgagggccacatgcgcaagattccagcctgggatccaggaactaacccaggagagccagatgggaagacagcacctggagcatctggccatgagggaagcagcataaggcagcccgaagacacttcctgctggttcaccatggaccccagactcctgggattgccgctgtacatcggacccacgcccttggcgagcgccggggcgagagccagagctccgatcaccagagaccaccggaacggacagcagccaacaggggacagaaacccaacagtgccacagcgactgggaaagatgcgcgccaaccgggacggaccgcggtcgaccagtacgccaatgaaaagacacacgagaccacaatccatgagaccataaaaaccgaaaaaaaggaacagacttacctggtacgtaaaagtccctaaacaacatgccaaaggttacatggacaattaaactgaggaatacagtagcagggttggacacgtctagagcaccaggctattgaactacccatcaaagaacctttcagcacctcggtataagccttagagtaaacgacaaatcgactccacacagttatgaccccactaacagataagtgaaatgcaattgtggagcacagaacagaaaaactggataaataaaccagcacaaggaagaacacaccgacacgaagccagcgcatgctcacggaacagaagcatcactcacca

SEQ ID NO: 540958 - DNA, 292 bp, Homo sapiens
tcgttactggcattttgcacatcatgttataagactctggatctaatttaatgttttgggatagggtctcaccttgtcactcaggctggagtgcagtggggtcatgactcactgcagcctcaaccttctggcctcaagcaatcctcccatctcagcctcccaagtagctaggaccacaggcaggcaccagcatgcccagctaatttttttgttttttgtttttttgtagcagcaaggtctccgtatgttgcctaagctggtctcgaactcctgggctcaagcaatcctccca

SEQ ID NO: 540959 - DNA, 844 bp, Homo sapiens
gtcatccacatcaccggcgctattttaaaacgccaacgtgcacaaaaggccacaacgttcccgaggaaccctgcggaagccttgtgtgaccaagactctgccggagaagggtccccccggggaatgtggtcaagccgggaccatggccccgcgcccggcgagcatgtgtttccagggcctacgccatttccaattccgcgaagcaaaatccacgtccggccgcgcccacagaatcgggcaaccaataaacgacttgggaccaaaagagaggctgtctagcccgctgccagcccatgccgatggcagtacacccccacctgctattggcaagacgggccacgcccagccggtagggaggcgaacttcaaccacccagatggcacgagcatttcttgtcacagaagagttgatacgtgccatttgttcaatagtcaaatacgcagaggaaaggtggctgaacactgtggcgcgcgccttctctggcttcgcccggttcctccgggaacctgacatctttgttaataaataggggggctctctccagttttcacacgtacgcgcacagcgggccaaacgaattccccctcatcatgacaaggaccccacaaaatcggtcttctggaaaaaaacatcgggcggtggaaaaccgccccgcaatacggttaatcgtctcatcgtatcttggttgctccccgcatatacattgcacgtgcggggttccagtaagcggcccttcgtcacaggtcgctccatcggacatggcccctcccgatgtcaatcggcggggcccccggggtggcgcccaaaatacttcgctaaaaaaaaagaacccacaaacatgaca

SEQ ID NO: 540960 - DNA, 351 bp, Homo sapiens
tcggagtgtactggagagtcgtcatgactagcatcttgagtgtcagatggatcacagtgtcatatggctgccggtcttatgatgtcttgcgtgctttagatgtcggctctaggtgagagttaggagtgtattgcccccatccctcccacgtccataagtatggcgccatatgcgaactctgtgcccaatttaatgagaatgtggcaaaggacagcgcggtgccaccttagtagcaggaatgtcctgtctccttcccaggctacagatggagtcagtagtattgatctcatctcatcttacatgcaaacagacactgttcccttaatttccccagtgccagaggcatacgag

SEQ ID NO: 540961 - DNA, 476 bp, Homo sapiens
actgatcccaggacaggatatggtcttgagcaaaatgtgcggactcctgcgaagggggggcccactctgtatacgtggactcctgactgttacgccctcttgtgtttcccaaacatgaggacgtcaggtgggcctccaggcccttgtgtgcaatgagaccggcactttcaggcgcctaagtgccaggaaatttgcgtacgggacctattctaaaaacgtccatgagagtaactaagacactatggcgcgtgctcacttgccaatgatcgagtgtggtgactggcgctcacaccatatactttgactattgcctctatcgagccgttttgaactgaagacttgctgacatgttctgcacacatgctgctatcgaggcccgagatccatagctgctttgaccctctggccaagcacatgctcagtgctgatctgtccggacatagatacctatgcagctactaggctaagctgtcaca

SEQ ID NO: 540962 - DNA, 308 bp, Homo sapiens
ctgcaccaattccgcgtgtgtatggtctctccccacacaagacaattctccaacactacctaggtatcccaaggttcaacccaatgcttacactatctacctcggggtagcatcagagcccacaggttaagggctcattcccctgcacccaattccggtgtgtaggttctctccccacacaagacaattctccaacactacctaggtatcccaaggttcaacccaatgcttacactatctacctcggggtagcatcagagcccacaggttaagggctcattcccccaggctgtccctaccatcacttc

SEQ ID NO: 540963 - DNA, 503 bp, Homo sapiens
  misc_feature (188)..(188): n is a, c, g, or t
aagggacggaagccgaagtggccctgaggggctctcctgtcctttgcgtggggtgtggaatcctgctgcacctgtcccttttgctggctcagggaagtgtctttttgcccacatttctgtggggaaaggtttttaatcctttgagggttccatcttcctgtttaggccatgcgcccagaaacttggantgatctttctttaatagtgaccccctgggcccctgaagagtaacatggctcccctggcccccaaagagggatggaatcaccaggccggggggcttttataacccttaggaaaaagcaaatcaaccctttttcatcttgggctcttccaaaactattggagggattttttttctttctaaacagggaaaataatgttccaaaagcatcttttttgttatttgtttgcatccctccccccccccctggggttttaaaatgaagaaaaaaacccatccctttttggccaaaaacttttaatgattaaaaacccaccca

SEQ ID NO: 540964 - DNA, 235 bp, Homo sapiens
cctcaggccgctgagcctgaggcagatggaggagctggatctggatctggactgattcagagagcggggatcagcggcgccatgccatggtgaagggactccgtgatcgagcgggagatgcccagcagtcgatcctccacgatggagcgacggacctcgggcttcatgatgacgatcagctccaccggaccgtcgaaccgccaggtgacgtcctttcggtccaggatggtgccca

SEQ ID NO: 540965 - DNA, 128 bp, Homo sapiens
ggccggcacaactgcggaggcacgggggtgatgtggcgatctacacagaagattcacctgggctcaaatgtaggccctgttccagtagtggttatgagtcttcggttcatcgcttctgtatttatgtc

SEQ ID NO: 540966 - DNA, 587 bp, Homo sapiens
atgaatggctccacgagaggcttcacgctgtcatcttacgtgtcttaaccagtgcacatttgacctgcccgtgaagacggtcgggcatgacacagcaagacgtagaagaccctatggagactttaatattcattcaatgcagacagtacctaacaaactccatcaggtcacgtaaagctgacacaaaccgtgctattataaaatttacggttgtggtgcgactctgcggagcaagaacccaacgctccgagcagtacatgcgtaagacttcaccagtcaaagcgaactactatactcgaattgatccaataacttgaccaacggaacaagttacctctagggataacagcgcaatcctattctagagtccatatctaacaatagggtttacgaccttcgatgtctggatcaggacatcccaatggtgcagccgctattaaaggtttgtttgttcaacgattaaagtcgtacgtgatatgagttcagacacggagtaatccaggtcggtttctatctacttcgattcctcgatgtacgaaaggacagagaaataaggctactacaagagcctccccgtaagtgatata

SEQ ID NO: 540967 - DNA, 678 bp, Homo sapiens
ctgccagtgatatgatgcctaaatacctcaagttgtcaggggtgtggtggactcagatgatctccccttgaatgctggcccgcggagacctcgttctagccaaccataaatctgccttaaggctgattaggaacgaagccttgtctcgtacacacactgctggactactgatcaagaagcatggcggatggagtaacatacgaatgagtacgtgttgaggaagagaatttgggtaccaacatcaagctgggtgtgacttgaagacctacgtcgaagtcgagacacgtcttggctaatacgtttcattaggctatccagtcctatcgtcgagtcatccagactggacacttacgtaggcctagcagccagtaatggtggcacacaggaactgaaaggcaagagaacgaatgtacaaaatcttacgttcattggggctgggctccagacagaagagagagggcgtgaagtcgttctccaattgtgatgagcgagtatctgagaaaggggctatgaaggttatttacactcacagaacctgtggagtgaagtacgtgtaattgcaggccctgtcccgaatttgagtgggacagaggttccaggaagtgtgtgccaaggaaggagtgaagtatcgatgaaagtgagaaagcctaaggagagtccgtgaaggaggttgagaaa

SEQ ID NO: 540968 - DNA, 138 bp, Homo sapiens
tgctgggattacaggcacgagccaccgtgcccagcctatttgaatcttttgaaatgatcaaattatctttgcccctcatgctgttaatgtggcgagtaactttactctgtttttctaatatggtacccccccacatta

SEQ ID NO: 540969 - DNA, 1605 bp, Homo sapiens
tcttgctttcctatgggatctatgtggggggctcatcgtgaacataacaacactgcctcagctggcttctaatgtctttttgctctcgagaggtgcctactcaattcactcctctttgcgactccttttgttgtgcctcccctcgttttgtcacgacgtgcgaagttggtttgtgaactagtctcacagtagcatgtgttctcatctccttcccacgtggctggtcctgtgtggagtgtcccccccccacagcgaaagttgtggttgggctccccacgtttttgttatctttctggttgcacaagagatgggcgcatctcatcagtgcgtcgccgttttaatatctccagagagccccgttggcaccatagtgcctcctttggccccgaatagatttctcggcgcaatattcttctcgctctgaaaattgtctacttgggtgatcaaagagtttttcaaaaagggcgcccatgcactactggggtataatagtcccggaaggaatttctttttggggagtaatttggccccaaactagatcctccggcccttgtgatttcccctgcctcattcttgaacattttttgtgcctccgtttgtgggccagaaaccttttgggttcctccaagaaacctctgtggcggcttttttcaaccgccacaaaaacttggccgccccacatttggggaaaaattgttgccaccgatcttgggggacacatatcttcgcgcccacagtgttggtgcccacctttcagagtgttttttgtatgtggaaagcaacaccaaatccacaattgtttggtgcgctttttcactattcttcttcgtcttgttttctgtgccacagccttgtccccgcaagatttgtgaataccaccccgagagttattatatatttcggggggggggcttaaacacactttttccccctccggtgcgcaaatcctcggcgggagacacgcggggcgccctccctagggggggaaagagagagtctcgggagatttacaagagaccgtctctttccctctgccacagtttgtcacaccgcggggggccaccttgagaggacctcttcttgagaggcgctctgtgtcttgagtttggccccctcttgggccctcggcgtgtcacaacacacccctctgtgtcaccacagccacacttcgccacaagcgccacacacaccccacacacaggggcctccacactgacgcccacacacacccgcgttccacaggcacaggcacacccacagcttgggcactatttcacacctcgcttgtgcacactcgagactcttgtggcacggccacaaggaaccttggacagggccacagaaccgctgggaaccaatcacccacggcccagggaatgggggtgggggtccctgaagctcacatgttggtgcccccctttcccttgtctgagagtggccgagaggcctgaataacccctgagccctaatttgcacagtctccccagcaacacaccagggagacccgaagtagctacccggatgatgaaacctggtgttccaacgagttctttcttgttacctttttaaaatttcttttttataaaagtaatattttattgttgg

SEQ ID NO: 540970 - DNA, 162 bp, Homo sapiens
aaaagaaagcatcttttcgaatgtcataaacttaatgtcacaaactgaagctttagcaactctgaaacctttttcattatatatatatatatatattttttttttataaacagtgttagaggccagtttggggtcatttaactacaattcaaacttctcagg

SEQ ID NO: 540971 - DNA, 419 bp, Homo sapiens
gcccgttataagacggccggaggttcaagtgggtctggagagtccgacttgaggaggttctgggcccggagaggccgctggaagggaaaaactgggcctggaaaggccgttgtcagcacatgacgccccattggcctgaagagtgccacttgtcaggcgggagctgggcctgcctgaagcgtccgagaggcaaggagctttggactcgggaggccgcaagttgaagcaaacagctagcttgggcgtggagagtccgctgtgaggcaaaggcttgggccttgtgcaggctttcgggagggcaggaggctgggcctttgtcgaggcctgcagaggccacggaaagtcaaaagcggggctggggaaggccgccgggaggctttagcttgggctgggccgaaagagggcattgggaggcagga

SEQ ID NO: 540972 - DNA, 956 bp, Homo sapiens
aggagaatctcttgaacccagaaggcgaatggttgcagtgaaccgagatcatgccattgtactctagcctgggtgacaagagcaagactccgtctcaaaaaaaaaaaaaaaaaaaaaaaaaaaattaaaaccgggtaaagggggtctcattgtgtggcctaggccggtttggacctccggggctcagtttgattctctttaccttggaacctccataaattgtgtggggaatttaccgggttgttggagacagtgtgcacctggggcccgaaaattagcctcaggttttcgtgaaagacaaaattcttgaactctatttggtaattcctttagcgttcacgtggctcgtggctttcacagaaatttaaccattacagggttttgccacaccatagtattcgtgcccagctttaagtgttcttttttattcccagttatttccccccaaaaggttgggttctacccttggcattccccaaggattcctcaaagcgtcttaaacagatacagcgaaattaggtccttttagaccagggttagtagagatattatttcccgatgtacaaaaccttagttaggaagagggagagtacaagggttatcttagggggggtcacattttttcccctttataagatccctttagggcagtcagaagttattgcggcaaacaattggtagggcaagttgaaacacacggttctaccctaaccaactcagggaaaaacacctttggacgtataacatcagggatacttcctagggataatagaggccccctttaaaatttccacggcaacttcgtggagaaattcctgactaacaacgacaatatacacattacttgtggggggaaaataattcattatattattaattatccaacccccagtgtattcggaaaacgaaataggattccatagaggtcactattggcaacactatatgagaacgct

SEQ ID NO: 540973 - DNA, 363 bp, Homo sapiens
  misc_feature (117)..(117): n is a, c, g, or t
  misc_feature (352)..(352): n is a, c, g, or t
cgcatagcaacatcataacccatactgccatgaccacagctctgattctctttttttaattattaaaatatgcacagcaaagtgacccagacatatattgacctggttatatatatntgtgtgtgtgtgtgtgtgtgtgtgtgtgtgtgtgtgtatacattcttctttcctccatttcttctatcatggtttatcccaagcgagtggatatagttccctctgctatacaaaaggacctaattgcctatccattctaaatgtaatagtttgcacctactaaccttaaacttagcaaccatgagtccattctctatatctatgagtctgtctctgttttgtagacaggttattntgtgccacatt

SEQ ID NO: 540974 - DNA, 139 bp, Homo sapiens
  misc_feature (62)..(62): n is a, c, g, or t
ctactgctcgaattcaagcttctaacgatgtacggggacatgccattgccaatttcctgggngacagagcgagagtccatcttaagaaagaaaaggggaaatgcaaagctattcagtagggatctcaaggtttttgaaa

SEQ ID NO: 540975 - DNA, 851 bp, Homo sapiens
gattccaaccccgcttcgctttccgcatgtcccgctttgcgctcccggcctgggcatcccgctgtttccctctgcgtccgggcctgcccttttcgggggcacagtgtggtctttccaccccgcgagacagcggggcgagggggcgcgggggccagtgatagaggctgatgcccccaagcacggacgccagcgtgggggtggaggttcttccagctgccctgagcctgtgcgaagggggaggtccttccccagttcccacagatgtggggaggcaagagaggggaagcgagcgggtcggggctcctggggtctctgaattaccctctgccctttgtcccaacactcaggtagcgggaaggatgaccagctcaaggaaaagacctcaatttgtgcccaaggtggtgcccgatgttgctctgcgagtcctgaaggtggctgtgcaatctcatcctctacgtgcgcgaggtctacccgtgggcatcttccagaaacgcaagaagttacacgtgcggggtccaagatgttccttgcaccgggagctgaattcagtatattccagggacaacgctgcacttggtgttcaagccacctcgttggacaaagactgctgtggacgcacacgcgggggggcgggatgcggataaagaagcaccgcaagtggaaaaattcccgctttgagatcacccaaggctccccattggtgtggcattcaacttcagactcgcgtgggggcccatggtgaccaagtggcccggggcttactctggaagatacagctggtgaatgccgcgtggacaacaaccccacggggttcttcaagtctggtgccacagagaaagcgcgctctcaag

SEQ ID NO: 540976 - DNA, 1398 bp, Homo sapiens
  misc_feature (220)..(220): n is a, c, g, or t
atggcacatgcagcgcaaggtagtgtctacaagacgctaacttcccctatcatagaagagctaatcagccagaagcatgatcgacgctctacaatcaacgatattgaccaaaacgaatcgaagctggctgacctggattgccctaagttccttgacactcagaatcagaagcaatgcaaataatgaacaacacagagtcacagaagaatagaggttcatnttaaaagaagaccgagtcggtccaaagaaccgaagtaccgacagacaccctgcccatatcctagacgtctgagccgattacaaaacgaaggggcttagatgcggatcgagtcgccagcccgagaagccaggcttggagcaaaagaacccaccgatgatttaatctggaaagccttaatctagttgattcgccctggagcaagcgagcctgggagcggagagtctaaacttggggctcggaagcatagctatattcgccccatattgatgttgccctaaggaagccaggggcgaaagccgtggcgaacttccctaggaaccgttatttgaatctaagtatcggagaatgggacagcgccagatatggattttctccccatggacttgttttatctacgagagattccgaagcggacattttaaccaactggggaacaaccgagcgaataagatgccagaaaaccccctaccaaaaaaaatagggccgaatgggagactttttgaaaaacttattggaactccccagaactcgggacgatataattcccagggatctcacactggagacagcgcagacaaacgaccagatggcctgaaaatttttagataaccgaaccataatgcaaagttatcaccgaagagatagaccaaggatgaaggcaatggccaagagggagaaccgtgaaccgggcatggctaagcgcaataaaaagaggaaaccccgctagaaaaactacgttgaggaaacggggaggtcccccaaaaatggacctccctagtaaaacatgacgccagaaaagggctgccgaacaatggaaagcctgaaagggggggacggagctttctggagacacagcaaacctgatctggaagaaagggggtttcgcttaagacccttgaagattaaactgacgcgaacttgcacagcgcgacgttataaagtcggccatcaggccgccaagagcggtctagccggacaaccagatgtgcaaacggcggtaacacgcggagggagaaccgcggggacctagattcaagacgtcggaagactacaacgcacccgctaaaggagaggagccccggttcgggacacactctgcaacgtagagcaagcggcctaaaaacgcgacgcagacgacctggcagacaaaacaaaaaaagcaacgacaaacgggacaa

SEQ ID NO: 540977 - DNA, 475 bp, Homo sapiens
  misc_feature (275)..(275): n is a, c, g, or t
  misc_feature (282)..(282): n is a, c, g, or t
  misc_feature (285)..(285): n is a, c, g, or t
  misc_feature (288)..(288): n is a, c, g, or t
  misc_feature (312)..(312): n is a, c, g, or t
ttcggcacggcgggtcattggtgggccagcttctttttcggtaagtccaccctcccgttcttggccacggtgttggagtccgcagacactcggaacctccccaggcctccagcagcatgaccgcctgtgcgctggctcgggacgcccggtacacgcagcccggcggtcagtccagcacagccagcgctggctctccgtcctgacctgagcggttaccaccagccccaggcctgcggagggcctagtccatccagtgttctgctttgtttcttttntcatttntcntcnccttttcgcattctcctgttccgnattgacgaccccaggtcttgaggacagcctgctgtgaggggactagtacttgtagactctgcatccccagggtgccccacttcggatggtggcccttctgctccaggcctccctagccacctctgccctaacccgaattcctcccttgggtccccatttctga

SEQ ID NO: 540978 - DNA, 985 bp, Homo sapiens
agcggcgtcagaagtcggatgcggtggctcacacctgtaatcccagcactttgggaggcccaggcaggcggatcacttgaggttaggagttcaagaccagcctggccaacatggtgaaaccccgtctctactaaaaatacaaaagttagccgggtatggtggtgcatgcctgtaatcccagcttcttgggaggccgaggcacaaagagtcggttggacccagggagacggaggttgcagtgaagtgaagatcgcgccattgtattccagcctcgggtagacacgagtgagactgctgatctcacttaggagactccataaaattattctagtagagtttcgaactgaatgtgtcggactcgattggggacgtgcctcttactgaggcggggcgccttgtatccctggcattttggctcccatctaaacgacgtggagtgctggatggtgacgcagagagggtatagattcggggagctagaagcggtcagcaaccgggcggtagtcaaagactcggttacctccgctacatcctctacttgccaatatttcttccgaaatacactttcttccccttttcttttccaaagtaagatttaacccaaacccatacctactttaccttccacctagtcaccttaaacattaactccacagtgatctttcctacaaaattctcctcttttgaatcacttgatccttttgataaacaacacgtccagtagcctaactaactggggttctaagcacagaacctcttgtgtgaagcagctccagaagatcatcccactgaactctcacaatggccccatttccctttgagctggaccatgtattgaactacttgagtcaacacaccgttcacccttgacataataccataaacatcgcatcctaactaagggtagatacacatacccatcttctttcacacccaatcatttcatggaacaattatcacactaaccaaggttcccccaccctac

SEQ ID NO: 540979 - DNA, 295 bp, Homo sapiens
ccgtctttcaactgcggtaggagtttgagatcagccaggcaacctggtgaaacccgtctctactaaaaatacaaaattagctgggcgtgatggtgggcgcctgtaatcccagctacttgggaggctgaggcaggagaatcacttgaacccgggaggcggaggttgcagtgagccgagatcgcaccattgcactccagtctgggcaacagagtgagattccgtctcaaaaaaaaaagaaagggaaaaaaaatagcattatacctcttccttgtcccaaccgcagttgaaagacgca

SEQ ID NO: 540980 - DNA, 473 bp, Homo sapiens
ttccttgagcgccacaacttacccggttcggtggcaggcatccgcaatcccagctacttgggagcgctgagcacggacgaatctgcttgaaacccgggggcaccgaggttcacagagcccatactgtgccccggcaactccacctgggcacacgagtggaactccatcgtccacaataattatatatataaatcaaatggaaagttaatataaaaaataccgtaggccaatcctggtggctcaagcccgttatctcagcattttgggagcactgaggtgggaggactgcttgagccccggagatatcaggcccgccttggccacatagtgagacccccctctctaccaaaatataaaataaaaaatttaaaagagctgcttaagccccggacattgaggttcatgagcgtcatcacacccctgtgactttagcctgggtgacagagaatgaccccgtttcgaaaaaacaaaaa

SEQ ID NO: 540981 - DNA, 402 bp, Homo sapiens
  misc_feature (78)..(78): n is a, c, g, or t
cataatccaaaccatgtcaaataactttttaagacatagacagtacaaaaagatgtaaatagaacaacaaaaagttanaaagttgggggatgaagttaaagtgttgagttttcattagtatgctcttgccttgttagttctttttgttgtttatgtaattagtgttgagttgtcattagtttaaaataatggattatgagatatttgcaagtatcattgcataccaccagagaaaattaccttcagtaaaaggaagacagggagaaaggaaagaaggaagagcaggccacaaaccagaaaacaaataacaagatgacagtaataaattcttatcaataataacattgaatgtaactggactaaactctccaatcagaagacatagagtggctgaactgattt

SEQ ID NO: 540982 - DNA, 980 bp, Homo sapiens
agcggagtcctccagccgcccggggaatacctctagttcttcccggccgccgccgccgccgccgccgccccgccttccttcctcctcctcctgtcgttctcctctctccccgcccccggccccagcacggccgtgcgcgcccgagccagaacaccaactactaggcgaggcagcccaacaacgcgaggcaacatgccaccaacgaaggaggaggaggaggacgagcacaagaggtcagcaggcagcagacagccagcagcagggacaggatcaacaatcatacatacttactcgcctgtctgtctggtctgggctgactgatgctggactgactaccatactcaacgaaccaacactagtatatcattgaaggaacggaacgacaacagccaccagcagcgtgcgaagctcagccagctaaccgtaccgtaccgaccgtctagcactcacagcatcgcgccgtgacatgcacgtgcacgcaagacaatggcaagtcccagcacatgccgatgtaggtttagaatgcatgcatcgacctcagaagagaacaacacgtcgaactcctcgagtcaagtctgttcttgacctctgcatgtaaaatacagcacacaccgatatcagtcctgatcatctatctgtagcgtggccgtcgtcgtgactggtcaaagcagaacattaaagaaagttactccttaacactgaccctaaacccaaatcacagcactcaacgagataccaacatacgagtaaactggacaacatagctcataaaacacaaccatagaacatggcaccttccatatatgagagcgcacaagcaaaacagaccgagcacgaagaggaacaagaaggatgggaaagcgaagaacacggtgcacggcaacatccttccacgtacaactcaaacatagacgcacacagcgagtataaagacaggcataatggaaactgtaaatacagaaaataccaacaagcacccg

SEQ ID NO: 540983 - DNA, 1166 bp, Homo sapiens
ccatgactccgtagcccttcagcagtcatggtgaggcaaggcgagttatgcagttgaacgcgactattcgtgaacaagagtctatattctcctatgataatcgtcccatacaattatcgtacgcttgaattataatcaattgcgacagacgcacagagtaatctaattcaatattataatggtcgtgtcattacgaatgatccacaggtaaattctccgcaggcgtagtgcgatcatctatccactgatgcagtgtgcatagccactaaggcactagaaatcggtcgcttgaaagcagtcgagggcaactaatatcgtgtacctaatatcaaacaactcactaggtaaggggtcgcctatccaccgtaagcgtacattcggctacttgaatttatgcatcatcaacgaacacgcgctagggacgttcatctaataacatgtgcttagctaccatccaactactaccactgggccactcgatagcataccttcatcccaaaactgcgctggaggttccaaaaccaaacttgtaatagttatggaacttagacgtgttaccatcggtaataggtctttttccaataatgtcaaaaggtataaaccggtcctttaaatcgggaaacttctcagctataaatgagattttccactaaaaagacccccatggttgcgggagagggccccgcccatttcgggcttgggggttccacattcaggtgagctgtggcccgacacaagtaaacttctgttaaaacacctaagtgtcggggcttaactgggtaatgagagtaaccggcctttctaacgagcgtccgatttgcttacaaaacacacccgctggagcgaaaataggggccaattagtcgccttaaacccccattatacctttgtggtgaccttaaggtggccctaattgggggggcccatacaagtgggataaaaccaaaggcgtccgcaaagtggtagcccttaaccgaaccacagagcagggaacgcttaaaaaaattccgggtccagtttggacataaaccttcttttcaaagttccaatgcccaacattatcgcccccctccggtaacgttaacccaaggccactttctcacattcggaaaaacgcgcctgggagaagctttacacccggggcgcacagtcaatttccttcaatg

SEQ ID NO: 540984 - DNA, 387 bp, Homo sapiens
cggggccccaagacccccattttcccggacgccaaggagtccagcccggtgtttgaaattaagggcatcgtcgagggcatcctcaaacggcctcctgacgagcaacggctgtacaaggatgaccaacttttggatgatggcaagaccctgggggagtgtggcttccccagtcaaacagcacggccacaggccccagccccagtgggggtggccttccgggcaaatgaccccttttaggccctgtgcatcgagccgttttccagcccgccaaagctgcccgatgtgatgaagccccaggactcgggaagcagggccaatgaacaaaccgggcagtgagggcccccaaaaggcccctttcccccaataaaaaagatttgggggtctgca

SEQ ID NO: 540985 - DNA, 792 bp, Homo sapiens
gcatgtgcatgcggcggccaaggctttgctagccatggccagcagtggactgaaaaccgctcggtaattccttttgcagcgaggtgccgtgcttggctgcgcagtatcatcggattaatcagtctggtcctgtaaactcgtctgtgttgacatctgttcagtctggtgatcgctactcgtctatcaggacttcggcgcacgttactgacagtaaacgttgcagacaggccaagccattgtgctgagctgacccgattaccacggtgtcacaatataaccttggctgtcagtcctgtctacttcgttctatcccatgcgtcaggacagaatggaacaccgaacacatctttcgctccttctgcgcccattcactattctaccaattgcggaattaaatgaaataacttcaattctgaacacgttatgcaacattacactatcttgctgctctcgtgtgtctacacgtacatcctcttgcgggttcccttttttccccctttcttctttataccccacattcccgcgctaactggccttccaagagtgcccccttagggctcctacaccgacctctctccaaacggtccttccccatgtgtctcgctatggccattcctgagggcgacaagcccaacttcgacccttcaccaccgccaacacaacacctcttccgcctacacaacatattcgcccacacatatcccaaacacttccccacccacactgtgaacttcccacaacccgcctcacaccacacttctctcccacattaccccaaatgcccctcttacc

SEQ ID NO: 540986 - DNA, 300 bp, Homo sapiens
  misc_feature (9)..(9): n is a, c, g, or t
  misc_feature (120)..(120): n is a, c, g, or t
  misc_feature (136)..(136): n is a, c, g, or t
  misc_feature (192)..(192): n is a, c, g, or t
  misc_feature (195)..(195): n is a, c, g, or t
  misc_feature (216)..(216): n is a, c, g, or t
  misc_feature (233)..(233): n is a, c, g, or t
  misc_feature (262)..(262): n is a, c, g, or t
  misc_feature (294)..(294): n is a, c, g, or t
caggccctncaaggagtactgataccttttgattgagtcctgtattccagttgacatgataaggacttacatctttatatgcctacttagactgtaacttcaatatctacatcacttggnggtgcttatttacgtnttctttcccaaccagactataaagttcttgaggacgggatagctttagcgcctagnaanatgtgtggcatcacatctgcntggtgctcagtagcgantcaaaggacttccagacatatccaacagnaattcaacaaaattggtagaagatatggtganggggct

SEQ ID NO: 540987 - DNA, 264 bp, Homo sapiens
ggggggggggggccccccccacctataaaggagtttgttttttcctcccaccccggaaggggtttttttttcccccccggggggggggcttcttctcaccgagggaggcctttttttttcccgggcacctcttgggcgggcttttttctccccccctcctcaccaaatttgttttttccccttttgggggggggggtttttttttttttttttaaaaaaaaaaattttttttttcccttaaaaaaaaaaaacacccggggggga

SEQ ID NO: 540988 - DNA, 339 bp, Homo sapiens
tttggtagttatagcccctcaatagtttaagaagactgttacaatttgcagcatttcaatgatctctaatatgtcaggtattagcaccatgacattctcattcccttaaaaaaacactcattcaaatctaggtagaacttccaactttcatcaacacattatcacacaaaatttatttagtctttttcacaattgcatcagaagacacataagtatattttaaacatattatcagtcagtccgacatagtgtggttttaccttatttctgtctgcccataattaagaaatcttgcatcgatttcatttgtcccccttgttatttgcacacggtctctca

SEQ ID NO: 540989 - DNA, 768 bp, Homo sapiens
tggctggcttatgacctgacaaatttattggaaaaaagctctgtaccttctacccttctaccgaaaaaaggcggtcttgcagggttggcacctgtccacacctgtcatctggggccttccccggggctaggctgatgtgggagcagatgccctcatcctaatgtcgcagggcctgtagcaggagccatcacaccaccttgtttgatgatgacacctagttcttcaatctcacacgggacttcatccccctttctggagaaagacaggaggttccctgaatacaccgacacctgtgggggggccccagttaggatgacatccccgtggttaaaaggtaacaaacggggagacccaggcatatcaggctcccacgtggtcttgaagtaccatcgggtgggttgtagccgctcgtggaccactttccccattcactcggacagacgaagatctctaaaggtgggtgtggcatctgctaacactgtcctgtggataaccaagggcaggccccagaagggccagaagtgtgctccgaaggcttttcccccagcaggccaatgggttgcccatatacggtctacatttgggcccgttcccgaagcctcacgttttgtgagcccactgttcacccgtccatgttgtgcccatagacatcgtgtggcccatgaagtgtggttgcccttcctttccaaggacccagcgcgggttcccacttccaacttaactcgtggcccttgtgggtggggagcccctcacttatggcccccatgt

SEQ ID NO: 540990 - DNA, 188 bp, Homo sapiens
ccatatatctcagacactcttctaacagcatttcgggcatgaaaaagatgtactctctgatgatgagttatggaaggaaatgatgtactctctgagatgaacattcgatatgctagatgcccaaaacggatctacggatgatgagttatggcatgatgaacaagggcatatggatctgggaatttcag

SEQ ID NO: 540991 - DNA, 972 bp, Homo sapiens
ttccggtgtgtctgttccgttttccggcctctgtgcctggtcgtccttgtgctctgtgctgcttcctgtgctgtccctgttgtgcccttctccagccattctggcctctgtccttgcggacctgctgtgacctgtgtgagcgtctagctctgcttttgctcccaggggctctgagggtgctcccagactccttccgtgcttgctcgatgctgcgcggcccttactgtgggctaccgctgcttggtgccgcagtgggcccgtcccgtgcctgtcacaagggtgcgaggctcatcaccatgcgagatcaaccccgacgtgtgcccgccatcaccgcagtcgcgatgatggattctcgtctggcatgaatggacaaggtcacccttgtgcttggacgctgttctccaggatcatcatcccccagcaggagcaagcaagttatgactcgtggacaccatcctggacatggtcttccctcgaccatctagaaggaccggtacctgccggacacgcttctcctggaggaatgtcggctctgctatcggaagggtgacagtcgcttctggctgacgaacgtgatctgcccaggtgctccagacttcctagcacaccgtgcgacgggagcagccatgctttatgagtgcacacactaccaatcgttcctggaatacagtggaggtggtggacggcacatggaggaggccatcctacaaggccctccagacagtcgaaacagggacctgagtgcacccctcggcccccatgtcgggctctactcacccagcctggtacagaaggtgcctgacgtgctcctgctgaccttctgcggtcgccgggactgtgtcctatatgcaaagcacacctcgcctgaggcttgcgcctgacatgctaacctctcgaactgcaacacctggattgttcttttgtaagactcaatcattgacttctgtactaatacctggcctagctatatta

SEQ ID NO: 540992 - DNA, 293 bp, Homo sapiens
  misc_feature (57)..(57): n is a, c, g, or t
  misc_feature (63)..(63): n is a, c, g, or t
  misc_feature (254)..(254): n is a, c, g, or t
  misc_feature (288)..(288): n is a, c, g, or t
gcaatagtcaggagaaggtagcattggagtcctggtttgattcgaaggatgaagacnaagaancaagggaggaacaaatgaagaaccatctttgttcatgaataggaatattcaagattataaaggtccaggtctcctaaaattgcctatggatttaatccattttcaatggattccacagatttattgaatgaacaagcaggtgttatatgagtacaaggcttttcccaatgcttttaatataaggaaggttnggcaccacctatgtgccagtttatgcagacagtnttgtg

SEQ ID NO: 540993 - DNA, 204 bp, Homo sapiens
aatgtgttcatgctaccactcgcaattcatctttccattttcgtctgcgtatagtatatgcgttaactaggctttaaatgactgcacttctccctgcgtcgatggatttcaaggtcttaaaatacacctatcgtgtataatcgtctttttagaaagatcgtccttcaaagttattttaaatcacccggacagaagaaaactgct

SEQ ID NO: 540994 - DNA, 136 bp, Homo sapiens
atgtctgagttatcttaacagcataaggaagacttgccctcttgcctatcaaagagacatagtttggaggggcagaagtgggaccacaacacagatgcagttttcatttgtattgggcaaaggtgacaaataacaa

SEQ ID NO: 540995 - DNA, 1119 bp, Homo sapiens
gaagaggaggaggaagaggcattctacgaagacctagatgatatattggagtccattactaatagaatgattaagcagtgagctggcaagatttgcaactggatcaaatccagccagcattttatcatcgagcagccaccagtcattggcaatcaacacaacatcaatatcgtgtgcttttcttgtgcatgggcagttctgtgcaggttttcaatcagcaatacaatttctccataagtagtttcagtaagcaataggtttgaggacattctgagcttatttatgtgttacaaaaaactctctgacattcttaatgcaaaaagcgggtaaagccaagaactaaaatggccaacaagacaagtgatagtctttagtccatgaaatttgtgtccagtcttctcactgctcttttcagggatagtatccaaagccaccaagaaagcctttctgttctcaggtccagcaatgagtttatgcgctatgcagtgaatgtagactctgcagcaaagtacagacagctaaaggaaacagggcatgtgagtggccctgatggccaaacccagaaaagatctttcagaaactctgagacataactcgagtcttgctattggagatacacttcaattcctacttcagtggaaagagtcgggaaagaaagagaaaggaaagagcatctacacagcatgtgcaaggaaggcgaaaaacaagaaaaatatacagatggctgtgaaacagaacaaacgagcccaaattcagaagaaaaacacaagcacaggaaggttccacaggacacaggaaggaaacagcagaaagacagagagccaaagcaaccacaaaacagaaacaggagcagggaaagacgacggtccagcagcaccaatagacaaaaaaggcacacgatagcgaaaagccgctgagaaaaaggaagaacaagaaaggccagaaacagggaccgcccatcaaaaagaaaaggaagagggaacaacgaacgagacaacaccaggagaacacacaagacaaaaaagccaaacaaagaaagcgaaaggaaaaaaaaacgagaatacgatggaacaagaagaagagaagaagaagaagaagaaagccagaaaaaaacacaga

SEQ ID NO: 540996 - DNA, 641 bp, Homo sapiens
ccacgcgtcgatgcagtaacaaaagcacacaacgattatagtaactataagatacaataaaacaaataaatgtgaaagtagattcatgaaaatagcagtaacaaaagcacacaacgattatagtaactataagatacaataaaacaaataaatgtgaaagtagattcatgaaaatgtattcctttaaaatatgttttcctacaggcctatttaacaagatgtttcattttactgtatatttgtagttcatcataaatgttgctctaatcagatggcttaaaagccatttttattatatatatgtagtgaactaatatatgaaataagtcaaatgtagctcccacaaggtacaacttcagtggtcaagatggcactgttctgattcatgtacgcatgcgtacatcattctctggaaatcaaaaagataaacagagcgatacacaaagctttcttttctaacttttccaagcaaaatctaaaatgtcgatgacatttttctggctgtgatcttaacaataattcatatctaacatagtattacgtctaggagatgctttctctctagctagttcagaccattccactctgtgctcagcattgcctatccaatgtctcacttgactttccgcacatcctcggtc

SEQ ID NO: 540997 - DNA, 93 bp, Homo sapiens
gaaaagtgatggggtggcaattttataaagtgttgctgtgcgggtgttttatcggagtgagaaaattaaaattgtgggtttggaagtagtaga

SEQ ID NO: 540998 - DNA, 200 bp, Homo sapiens
ggatggtatggctcagcttcccaaagtgtggggattacagtttgtgagccaccgcacccggctccaataaaactttatttacaaaaacaagccgtgggccagacgtgccctctgggctgtagtttgctgactcctgccctagagcagatatacataaagggcaatgagaagcgcgtgcaaaaatacattctccttcagtg

SEQ ID NO: 540999 - DNA, 1077 bp, Homo sapiens
agcggctcgcccccccggagccgacaaatggccgcggcggcctcaggtgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacaggtgaagggggcgcggcgtggccgggctgggcagccgcgaggtgggcgagctggcaggggtgcttgtggccttgggacgggccagggtcgcgatcagtggtgagttgggggtctggaggtgtgggaaggcctagttcagagagagcaattggaaaaccacttgtaccggtttggacatcgtttaacaaagccgaggatgactcggcggctggcgagggtggtgtatatgtggcagtgggagggtacaccagcttcgcatacgcagagcggatttcaggtcggaaagtctaggtcaaggagcccgacgctgacctcccggggactcggcgaacagcccactgggctaccgaccaggtgagatcgtgcaacaggatgaagagctcccgtgccgaggaatactcgaattacggcttagccatgacatgcgctgcagctaaacacctcgttaaaacatagtagcgccttaacgcggaacggctgatgcatacaggtgataccccagtggtatgcgtacccttgtgcaaatcaatcccgacgttatgtcccacgaagttacaaagagcccttgacatcccactgacccgaccgtgcacaatccgcgatgccccatagcttaccacaatcgtacaacattacagggtcatcatctgaaccgaagggcaaacaac

SEQ ID NO: 541000 - DNA, 924 bp, Homo sapiens
agcggctcgcccccccggagccgacaaatggccgcggcggcctcaggtgcggcgtcactcagacaagggggcgggtggaggaggaagcggccaagtccacagtcctgctccggtgccgccgagcaccgcccacctcagctgaccagccctgtccgctactaggcctcgcctagaggagggaaaggccgtggcgtccgctccctccgcggctcatggcgacgacgcttggcacatccgggaccctcaggccgctgcagtcgcgtcgccggctgctcgggccccagccccggccgctgtggtgactccgccgcgcctcgccgtcgcccccgtcccgcccgccgccccagccgccagggacatgtctaacctcggaggccgtaggaacgggcctgtcgaagtgcgcctgacagggacatgccacccccgttttaggagaacttgtatttggtttgagcaaggacattggaatcacggcgttatcctaccttcaccatttacccctgataaatggtccacgtttatatttggagtctcattctattgcccatgctggagtgcagtggcaacagcgtgcagtgagtgatcccggctctctgcagctttgacctcctggctcaagtgcttttcccaccttggcttcccaagtagctgggactacaggaatcatattgacccggtcatgcacaatgagaccaaaagatcctctggacgcgacttaccgatcaactttcctggagaagaagcctgactacaggaagggctgcccaggcttgatgacaactccgtgacggttgcacattatacatcctctcctcatccagccacccaggaccctaccttactggcacgagtaagggtgacttgacgactcttggaagcaagaatccttaacaatcgggactatccactgcaccacaccaacca

SEQ ID NO: 541001 - DNA, 240 bp, Homo sapiens
gaggatcccccaaactgacgcgatttaggatgatcggctggcagctatgttcagagaatttacccagcaaaataaagctaccctgtgttgaccctgggtatccggcgccttactttcctggttgcacaatacaggatttcagaaagcaggtcaactatcaggtggatcggaggatttcatagagaattccctaaattctttacattccgagcaagggataagtttgaggaggatcgtatc

SEQ ID NO: 541002 - DNA, 137 bp, Homo sapiens
gcggccgcctactactactactactgctcgaattcaagcttctaacgatgtacggggacatgtcagccttctgatgatcccactccaccccacctcaacttatttaacttcctaattaaatcagactgtttgaaaaa

SEQ ID NO: 541003 - DNA, 699 bp, Homo sapiens
gcctcgagaactctggctcttcctgggcgtgagggggaagtgaggtgttcttgccattgccagcctaatgcgcagtgctttctgcgctctggtaacagggagtgagtgagcccctcagacctgcactctggggtgtctccgtgcttatcaaaggttcttaatagtgtaatgcttgtagaaacttgaaacgtcatcacggagacactggaagttctatcccaggggtggagagaataagaggaagtgctcgcggtagattgggagcagcaaggggcctcccgagaaaggagcccgcacctcaggcatgacggccttaatcgtggcctccctggggtgggtggggttctcgtcctccctccctccctcctcctggggtgggagggcggctcctgttcccattctctgtgttccctggaggcagggtatcacaaaagcatttgtgaattggctttaggtgcagggagaccatgcgcatctcaggtactcttccccagtcatcgccttccataggcacaccctagatccagcctcaggagactaacgaagttttgagaaagagcaggtggtagagcagcagcttcgtgctctcagcggtggcgtggctggcatgttctctagcgttgtggtgccaccttcccttcttgtcccaggttataaggctggtcttctcttggggatcataacgtgggcccgaagtcc

SEQ ID NO: 541004 - DNA, 338 bp, Homo sapiens
ggtcgactcagaatttaagaatacctttatcctgattgttttgcctcaaaatgacatttgctaacaccatcaaaaagtgggcaagggatatgaatagacgtttcctacagaaaatgtacaaatggtcaacaaacatgaaaaaatgctcagcatcactaatcatcagggaaatgcaaattaaaattacaatgagatagcatcttattcctgcaagaatggccattattaaagtaaaaaaacaatagatattggcatggatgtggggaaaagggaacacttgcatactgctggtagaaatgtaaattagaacaacctccgtggaagattgcttaaagaac

SEQ ID NO: 541005 - DNA, 851 bp, Homo sapiens
cgcggtgcgcgacctcgtcccgaagcctgtggatacaccctctcgaagagcccgttgtggccctccgtaaaggtcgaatccctcacagttgcatgtgggcagtgtccagcccaaggattccctcgctctggttctctgcccctattgtggaaactcggtcccacgccttcccacgttgtctgggatgaggtgtccccctttctccccactagaatgtcaaataacttacggaggggtcttcctgaaacccgcagaggaaaaattcaggcaacgcctcgcgtgatcccataattgagaattgcgcatccaccatctagcatccagggtggcccaagggaaagaacatggaccaacgaaagattctccaggggacacgaccgtaaacttacagggcattaccattcttgaagacagtgattgcttgacaatttcaccacacgattctttggggcctttacctacaggggatttcggaaaagtgtgcccttacttcgggattccctggagccagtttgggaccttcctgggaggaagggtctcgatttcccttttacgccaggttttgctacacggaggtggtcccttaagcacaggaagcaccagagtttaattgggcggaccggaaggcgggagcaggaacaccccggcgaacattttgacgtagcaaaggagagggaaaaacctaatatagacaactgtgcgccccctcagagagcacacaccgagaggacggttttacgggccgcaataatggggcaccatagtcccgttccaactctaagcgtgtattacccacttcgctttttccccaatactttacagattcacgaaccgaccgtcagggcccggct

SEQ ID NO: 541006 - DNA, 325 bp, Homo sapiens
aagggaaacttcttttttttaaaagtggcccggcccccttttaaaaagtgaatccccatatgtgaggtaaaagttattcccccaaccaggataaacttttccttccccctttgctcatttggggtaaagggggaaaaacctatttgggccccttgccctcttaagattatgtaccccagcccctttgggagggtcttaaaaaatttttttgaaaacttgtccctttccccgccccccccctgccaccaaaatgaaagttgcccctttaccccgattttttttttctttttggtttatgtctattctaattaaaaatgtataaata

SEQ ID NO: 541007 - DNA, 519 bp, Homo sapiens
  misc_feature (11)..(11): n is a, c, g, or t
  misc_feature (22)..(22): n is a, c, g, or t
  misc_feature (57)..(57): n is a, c, g, or t
  misc_feature (507)..(508): n is a, c, g, or t
attcctcaaancctcagtagtnaaaagacccaccccattccgaatatgggcaaaagncccatgaagagacatttcacccaaaaaagataccacagatggcaaataagccacatgaaaagatgtcccaaaatccatttgcccatcagggaaatgtggctacacatcgatgacaatgacctaaaataaaatgaggcaacacccaaatgctggcaaggatgtggaaaaactcgatcattcacacattgctgttggaaatgtaaaatcatacagctactctggaaagcggtttagcagtttctttaaaaaaacaagcaaacatgcaactatcatatgacccatcaatttcactccccggcaatctcttgaaaattatgctcagtgaaaaaagccaatcctgaaagtttatatatttattattccattcatatagaattgctgaaatgacaaaataatggaaatagagaacagatcagtggttgctttgagttaagaaggggatggggtganncggaaagtagg

SEQ ID NO: 541008 - DNA, 140 bp, Homo sapiens
tttttccccctttcccccccccccaaatttttggggggggggggttttcccccccccccccctttccctttttttgggggggttaaccccgctgcccccggggccccccctttttttttttttttttttttttttttaca

SEQ ID NO: 541009 - DNA, 383 bp, Homo sapiens
  misc_feature (101)..(102): n is a, c, g, or t
  misc_feature (109)..(109): n is a, c, g, or t
gtccgccgcatcccctttattgcatttaatttttgtgtgtgtgttgttccttcgtccattagggaaaaaaaaaattgggcagcgggtctttttataacatnntcttttnccccctcccccttttactgacagggggtgaaaggtgttctttgacattatttccaaaagagacagttttcttttaccccatccttgtcaccccaactttagctccgtagtcattaccgggggggaggttttgtttacaaacttaatagttccattaacactgctgcaagtatgtcatacccagaatccaacagtgcaagggggtgtccatccagcgcagctaattcaaatggggcctggctgagtaagatcaaaccttctcttcttggacattg

SEQ ID NO: 541010 - DNA, 316 bp, Homo sapiens
tctcttgctccgcacctcgacaatatcccatcaacgaccgatctaagtcacccacccaaggaatgtatacatctaactaacctcaaaacaactgataaccatacacaacactaaaggacgaccctgctctcttatactattatccttcatcatttctattgccacacctaatctcctcggactcctgcctcactcatttacaccatccacccaactatctattaacctagccatggacatccccttatgagcgggctctgtgcttgtcggttttcgctctaagattaaaaatgccctagcccacttcttaccacac

SEQ ID NO: 541011 - DNA, 449 bp, Homo sapiens
tgaaaaaattctgggggcccggggggtgggttgtaaacccccttggggggggtctcaatccctccttttttggtcaaaattttttttttcggggtccctccagaagtggtggggagagggggggggggcatctccatatattgcttccccccgaggggtttaaaggagaggggtccttctcaaccatattagtagacttttcggcatctcagaaagcagaagggttcccctaaaattcgtgtggaaaaaatttatttataattatttagtgcgggtgtgtatgagagaacaagtgtgtagtggggaccccataacgaggagtgtaaagagggagtgtttcacgagtggtgggtgatatgtgaccatgggggagtatagaatcgcgaagataaggttggaggagttattatcgggaaatagggcccgagaaaggtgtgttggggaaaaag

SEQ ID NO: 541012 - DNA, 286 bp, Homo sapiens
ggaaagcagtacaggaaatagccagtagcagtgtcaaatgatgttatatagggcaagaaatgatgtgcgaccagtaagtagtaggaatcagcgcgtgataagctatacaagagcccacgcatcagtaggatcctgcgccgaatcaaccctgacccctctccttcataaattattcagctgcctacactattaaagtttaccacaaccaccaccccatcatactctttcacccaacagcaccaatcctacctccagtcgctaaccccactaaaacactcaccaagag

SEQ ID NO: 541013 - DNA, 288 bp, Homo sapiens
catgcgaagtgagaatatgcatgtcatgtgcacaagtctactaagggaaccatgtgatggaatcggataatttactgtgcactccatcactccacttaatcacccattcttagttttatcttggggccccaagcgtggggaattcctcaagatgtcctcttgcagcttttgagtctgtgactctggcgtgcttgaaaaacgtaactgttgtgaggagtgttatctcattgtggcgatgataagcatttccgggatgtacagtgatggtgagcatatactaatgtgtaa

SEQ ID NO: 541014 - DNA, 482 bp, Homo sapiens
  misc_feature (44)..(44): n is a, c, g, or t
actagacgatcccttagctcgatcaacccggaagccttttgtantgacgttcttttccctctattttggcacccagatcattttcttcttttttgaaatggagtctctctctgtcacccagcctggagcccagatatgtggtcccagctcactgcagcctttgcctcccaagttcaagtgattgtcctgcctcagcctcctgagtagctgggaccgcgggcacacgccaccacactcggctaatttttgtacttttagcagagatggggtttggccatgttggccaggctggtcttgaactcctgacttcaaatgattcacttcccttgtcttcccaaagtgctgggattacagtcgtgagccaccatggctggccaacccgacctcattttgatgatgatctggagaggtgaggggtcccaccaaggtgctgagtaaatttctagggcttctaagtctcagaagtcctggttggatgatct

SEQ ID NO: 541015 - DNA, 499 bp, Homo sapiens
  misc_feature (9)..(9): n is a, c, g, or t
  misc_feature (465)..(465): n is a, c, g, or t
  misc_feature (479)..(479): n is a, c, g, or t
  misc_feature (499)..(499): n is a, c, g, or t
tggcagctnggacatcagtgcaagtacagagactcagccatggttctgcagaggatcttcaggctctcctctgtccttcggtcagcagtctctgtgcatttgaagaggaacattggtgttacagctgtggcctttaataaggaacttgatcctgtacagaaactcttcgtggacaagataagagagtacaaatcaaagcgacaggcatctggaggacctgttgatattggcccagagtatcagcaagatctggacagagagctttataagcttaaacaaatgtatggtaaaggagagatggatacatttcctaccttcaaatttgatgatcccaaatttgaagtcatcgacaaaccccagtcctgaggaacatacaaaatccatgtggtaatttgtcatgaattagttgtacaactaatcaaaaaattcaaataaacattcattttccctttaataaggtgttcngagggacccaggtnaattacaagcagcgggtgan

SEQ ID NO: 541016 - DNA, 942 bp, Homo sapiens
  misc_feature (89)..(89): n is a, c, g, or t
gccaatccagcgagtggtgaggccgcgcctcctccttttacatttcggttgagttgtgtcctcgcgcccgtctcgtaagtggggtggtnttcctcgcgccgagactgatatactagaggagaggacagggggtgttgtcttcttgtctcggtcccgcgctgcgtctttgttctcttggttagaacatctctctcgtcgtggtcgctgtctcttgtcttctgtctgtgttgtgttcttgttttctttgtggtgcgagaatagagaggaagtggtttccccaccgcattttctctcccctccctctcgccacgagagagttattcacttcgctgacaccacatttccccccgcagagagctcgcgctcatcagacaaatgtgtgtctctctcgtcgccaccctctctcctgtagagataatgctatcatctccacagcatacagagtgtccccccctctcaatgcaacacacacacacacagtgtgtgtgtgtccccatttcccccactcactcaccatgtcacacagacagaaacacacactctctggcagtcttatctattaatactctctttcccacacgcgagaagaaaaaaaatttctttctgtgtgtgttgcccacctctctatattgcacgagagagcacacaatatttgcgtgggttgtgaagaatatagatgaagagcacaacccagctttttgtgaacaacatgttttttggtttctcttttaacagaccgcactgtttgttgttcggtaattcttgtttgtagggtcgtgaggaaagtttaagtatgtggtgtccccccctcggattaagaatttaggaggttttgaattacgactttttttttttttttctttttttttttttcccagagaacaattggggaagaaccccggaaaaaacccccaagggggaaaaaccacaattttttgccca

SEQ ID NO: 541017 - DNA, 436 bp, Homo sapiens
cacgaggctggcgcaacggttcaccggcttcgcatccgcgggagtcgctgcaccggcgtcgagtacaccaccgccgagggccggcaggtgacggcggcggcccgggagatcatcttgtgcgcgggcgcaatcgggtcgccgcatctgctgctggcttccggaatcgggccgccgaaccatctccggtccttcggggtcgacgtcgccctggagttgcctggggtcggtgcgaacctgcaggatcatccgatcgttccgctggtctatcgcgccgcgcgtcccgtgccggccggccggtacaaccacggggagctgctcgggctcatccggcgccacgcaaccggcggaccgccggagatccagatcttcggcgtcgactccgcggacgttccgggcctcggcggagccgatggatacgtgctgggagtctccgtca

SEQ ID NO: 541018 - DNA, 209 bp, Homo sapiens
  misc_feature (3)..(3): n is a, c, g, or t
  misc_feature (12)..(12): n is a, c, g, or t
  misc_feature (18)..(18): n is a, c, g, or t
  misc_feature (22)..(23): n is a, c, g, or t
  misc_feature (33)..(33): n is a, c, g, or t
  misc_feature (43)..(43): n is a, c, g, or t
  misc_feature (47)..(47): n is a, c, g, or t
  misc_feature (58)..(59): n is a, c, g, or t
  misc_feature (62)..(62): n is a, c, g, or t
  misc_feature (68)..(68): n is a, c, g, or t
  misc_feature (83)..(83): n is a, c, g, or t
  misc_feature (89)..(89): n is a, c, g, or t
  misc_feature (95)..(95): n is a, c, g, or t
  misc_feature (107)..(107): n is a, c, g, or t
  misc_feature (124)..(125): n is a, c, g, or t
  misc_feature (135)..(135): n is a, c, g, or t
  misc_feature (151)..(151): n is a, c, g, or t
  misc_feature (157)..(158): n is a, c, g, or t
  misc_feature (160)..(160): n is a, c, g, or t
  misc_feature (165)..(166): n is a, c, g, or t
  misc_feature (174)..(174): n is a, c, g, or t
  misc_feature (189)..(189): n is a, c, g, or t
ggngggtttggnggaggnttgnncttgagttcnttgcacaccncctnccaggtttggnncanggccgnttccagaaccatggnaggagnaagaanccattcatgggnaccacctgtaagaaagnntccaattgtnaaaggaagaaggaggnttaatnncnggaanngattttgnagttggtggggtatnaataaaagttattttccctg

SEQ ID NO: 541019 - DNA, 112 bp, Homo sapiens
ccattccaacccaaagccttcctgtgcagacatgtgggagctgcctcggggggaattgccataggaaggagagcctgtacctctgggaggctgagcccttctgggcttaggt

SEQ ID NO: 541020 - DNA, 390 bp, Homo sapiens
gttcctgtttactagaaatccagcttctatggtgaaaagaaaaagtaaattacatttttcacatttccaaacaccatccatttccgtgacacacacaggttctccttgccaagaaaagtcagtggttgtctgttctggaagggaagtaagaaagtggcattttttatttcctgaagaaaaaaaaattaaataggtcaaatacataaaacttccatgaaaagagccacacttcatttcagccattaaagaaaaatgtgtttaaattccccaaaggaaccctatgctctacactgggaaaggcttattcactgctgactttcaagaagcaggaactgggttcctgcttcttgaaaggctgaggcaggagaatcgcttgaacctgggaggcgg

SEQ ID NO: 541021 - DNA, 1768 bp, Homo sapiens
  misc_feature (429)..(429): n is a, c, g, or t
attggctattggtgtacgcagctagctgtgtgtggtgggctcgccttcgcgggggtggtggacatgtctctggttggttagttgtctgacgcctcctttgttctccgcgatctctagatgtgtttcttgctctctgcgtctctctcttcgtgtgtgagttggtactctctttctgtattatctcttggtggaaccatccgtcgcccccaggggaggttggtacgactccttctctctttgtgtgggaatgttgtgctctagccagcgcggtcgttttcgactacccgggcggtgggctactcactctccgcaaacccgttggttgtttttgatgttagaattggcggcgtgtattgtgtttgctccgcctacacatagggtttgcgcccacatgtgtttgtgcccaccagtgttatctgagatgccgtntcttctttggggcgtgtgggggaacacctccgtgcgcctccctcattcttttgggtgagattctttgctcacctcatcacgggcgggcgtcacacccgatctctctgctgagaggggcctgaaatgtttttgttgtgggggccccccatttgaccccactatcagggcgattttttgttccgtcgtgaagatgtttgttgtgggcgccagttgttcttgttcgcggtccgttgtggactatcaactcctggcgcctcagaaggtgtgtgcgtttctctgctctgtggggtatttctttttcgttgaggtgatttcttgtacactcccctttttccctcagcgctttttatacgtggtgatgaatatacccccccgtcggggggtggtgttggtgtgtccccggatatatataccgcaccttggtgttccgcccagcgcggattttgtggagagactccccccacttctctccgagaagattgggggttgttttccattttggttggttgccccgccctttttttttcggcgccctctcagacacggtctagtgtctctacccgctttatgtctatgcgctgtctttccctgtgtgggcctggggggacacacacatctcgtggggctcaacagagttttatggggaacaccctgggggctaaaaactgctcacacgacctggtgatagagaccctctacgcgcccacactgtggggcgcacacacacacagggcgatatctttgaaaaccacccgcggtgagacctgttcttcttctcacagaaatgtgagtctctccctcttgttgtctttcttgtggagaggctacacaggatatggccacaggccacatgtttaatcgtggagatctctctcccgagagagccaaaccaccctttttacacacacgctgtagataggtgggggacacatctcattcgcaacacgcccttgtgggttctcgagcgccttatacccgcgtgtacttggcgttgttgtggcttgcccacacaggcgccccagccattccaagaatattggggtatttagagagaggaaagaataccttgttagaatagaactgaagcccaagaaagtttataccagtacccagccagcaagagccagagacccacccccagtgcacactccctggcctggtttgctggtaggcccagaactctgtttgctggctaacaccggagccaccctggtggcgagtgtggcacggtgacccattggcaccaccgctaagaaatttattggcacgagctttaccaataaaaaaaaaactggcttttcctaaaaaaaagaaaaaaataaactcgaggattaatgtt

SEQ ID NO: 541022 - DNA, 1162 bp, Homo sapiens
gggtctgctggctcgtgccacagggtgcaggtgttgcaggggctccctgtgtccggctgcctgcggtccccctgctcctggaccctgggggctccccctagcggccgttgaggagccggcctctgctggctccaagagaagggccgcatggacgccggagacactggagagacggcctgagagggcctcgacggcgggagggactaccacagggcaccaatgtgcacagaactcacccatgcacaatctgggcgttgaaggagtaccctttacacatgggaggaactcttacttacaccaggctttggggaccaatttggccaacgaagaagccttggtgaaagcaccaagggggtgacccaaacccagtttgcgtgtcgtccccttgggaacctctgtggaaaacagtgtggccacaaaggacctaacacagcaggtccgtggagacaaagggtaaccattaccactaactcacgtggtggcacactggtccggtcatcacacccgtcattgtgccccgcacacggtgacaatacttgggagcgtggccacttgtggtcaatgtgcccacttcccaagcaacggcgaaacgctgagacccaacggaacaagtcaggacacacgggaaaattcccaaggcaattcccagcgcagacattgcacccagtgttttcgcaagcacaaaatgggcccaacttgactgttgccagttcttgatcccaacatcagtcttcggggcaaaagtcacaaacagcacacatcagttaacggcgaaagttttttgctcaaggaacggcgcacgcgaaagcaggcgaataaacaaaaagggtccgtcactggagacgcgcacattacaaacaaaggatacccccgaataattccttccccacccccagggcaattctaagaaagcagagaccaagagccacgtggccacaaaacaggagtggtgcggaacacagatcctaaccagtaacaaacaaccccgggataggcatgaaacccccagcactgcacaaaactccggccaacaaccgaacagcgacatgcacgcgacatcaacggcaagacaccttggcagcgaacgtcaggacttaccaaatggcaccgcgcgaacggaccacgcgacgaaacactgaggcagagtggaaacacagaggtc

SEQ ID NO: 541023 - DNA, 484 bp, Homo sapiens
  misc_feature (404)..(404): n is a, c, g, or t
  misc_feature (406)..(406): n is a, c, g, or t
ttatcgcccaacactcctatcaccaccatagagctgaccatattttcccacctcttttcaagcttcggatcctgctgatgttgagcaaccaacagcctctacctatctccgcttatatgtcccacaggctcctctaaccgtagatacccaaaacaaaccactcagggacgctgttcttcctgccacaaacactcagtcagtgaaaacggccctgctggccacaagttgttcaaggcagaaatctgccagtcatccctgtccacatcactccctacttctagttcatgccctttccacttcttgaatcacttgaaatcttctcaagcaagctgtttaatcctccaaatctctttttcttttttgagacggaatcttgctctgttgcccaggatggagtgcagtgntntgatctcggctcactgcaaactccgtctcccggcttcaagagactctcctcctcagctcctcttcagcatcgggatct

SEQ ID NO: 541024 - DNA, 573 bp, Homo sapiens
  misc_feature (381)..(382): n is a, c, g, or t
  misc_feature (403)..(403): n is a, c, g, or t
tgtaaataattagcaagcaaaagcgtttctgtgacttcaggtaccagcttaaagagcactagggatggggaacgaatgccaaatcagactccacctagagcaccaggaaacagcttgtaccctggtagggaaatggtgtcgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatccccccctttttggggggggggggggggnnaaaaaattttttaaaattttnaaaaaaattgggtttttttttccctttttttaaacaagtataatcatatcgtcggaggttaagattatgaaattttaaaatctctattcaagatgatgttcactccaaatacactacagaatttagtcaacattttatataatgtttcaataaatgtttctttcaataaa

SEQ ID NO: 541025 - DNA, 575 bp, Homo sapiens
  misc_feature (404)..(404): n is a, c, g, or t
  misc_feature (406)..(406): n is a, c, g, or t
ttatcgcccaacactcctatcaccaccatagagctgaccatattttcccacctcttttcaagcttcggatcctgctgatgttgagcaaccaacagcctctacctatctccgcttatatgtcccacaggctcctctaaccgtagatacccaaaacaaaccactcagggacgctgttcttcctgccacaaacactcagtcagtgaaaacggccctgctggccacaagttgttcaaggcagaaatctgccagtcatccctgtccacatcactccctacttctagttcatgccctttccacttcttgaatcacttgaaatcttctcaagcaagctgtttaatcctccaaatctctttttcttttttgagacggaatcttgctctgttgcccaggatggagtgcagtgntntgatcatagcttgctgcaagcttgatttctggctcaagtgatcctcccatgtcagcctctcgagtagctgaggcaggagaatggtgtgaaccccagaggctgagcttgcagtgagccaagactgtgccactgctctccagcctgggttgaaagcaaaactgtctcaaag

SEQ ID NO: 541026 - DNA, 575 bp, Homo sapiens
  misc_feature (357)..(358): n is a, c, g, or t
  misc_feature (377)..(379): n is a, c, g, or t
  misc_feature (410)..(411): n is a, c, g, or t
tgtaaataattagcaagcaaaagcgtttctgtgacttcaggtaccagcttaaagagcactagggatggggaacgaatgccaaatcagactccacctagagcaccaggaaacagcttgtaccctggtagggaaatggtgtcgctgaaaggggaggctgagccagtgcgagactgaacttgtgcagccttagccaagacaaagcagtgtttttcagcagacggctgatgggacaggaattgaagaagagaattgactcgtatgaacaggacagggtgaaaatgctgggaattataatgggaaacaaaactatctatgttcatattttgtaatatttcatttgttaagtttatatctggnngaaaaaaaaattttttttnnnaaaaaattttttaaaaaaaaaaaatttgggnntttttccccttttttttttttttttaaacaagtataatcatatcgtcggaggttaagattatgaaattttaaaatctctattcaagatgatgttcactccaaatacactacagaatttagtcaacattttatataatgtttcaataaatgtttctttcaataaa

SEQ ID NO: 541027 - DNA, 363 bp, Homo sapiens
tattggattcttctcaaaaagcggcttacagtcaactacagtccaaatttgctccttggaagactcctgaatgcaggtttctgatgatgtcagaaagactgtgctgttggattagacagaaaacttctaggactctaattaaaaggctgatgtggtcataaagattgctaacccagtatgaagcaaaacaagagttaattgcatggactgagctaatagaggactgaactgattcttttgtggcttttttggtttgaaacattgctgattctttttgttgttcagtgtcaaattttttttctcttgagctatttgtagcccttaacaattgagtatactcttgtaaataaaatttaaagcaaa

SEQ ID NO: 541028 - DNA, 1009 bp, Homo sapiens
  misc_feature (336)..(336): n is a, c, g, or t
cttagcggccggcgttgaattccgggaagtgggatgcttcaggctcgctccgtgcgggtatgtggcgctaatgtcacttgggatggttgcgcaaggacatcgcggcggacactgacaaggaagcggggaggaacgggggtggggagagactgctgatgggactcgggaagccgggaagggccgagctgaataagcctaaggggccgggtcgcaaggagtgtcgtggtagcacgaggcctcggctcagtcggagcgccaggcctcagcggtccagggcggggagctgctgcagtcatcaccatggcatgcctgaggaacgcgaactgttgggcaacncgtgtgtggccatctcgctcgatcatctttacgctgtgggccgatactgcgatgtgacgctatcctgtggagcgtgatgtcccgacacggtgcggggcgccggaaggatggagagaaagactagagacccggattgttgacagcgctgtgatgccgcttgattcatgtgtgggtggccatggtttagaaatgtacctagccttcctttctaggttcctccccggagggcggggtgacgggtgcggcgccgaaatcgcaacaaaaaacgctgctcgacgggatgtaagtaactgtctcagcttaagttgctgccttttagcttacaggtttgtatcgataacctgtaagttgtggactcgttaggttaaatcccttcagtgtgcttggaaaacactatttacaacgtggtatagcgaaacatacttaacaaggcacttcttgagcactgcttgttttggaaacgcgtttttagacttcgcaaatttctggttaacacttgttaactcttgttcaagttcctggcagaatgaacctgaactcactcacgggttcatgacatgtggggtctgaaagtcgacggtttggaacaaaggcggggattagggccagtgtagacaggtgtgggtcagaactccgtggacctcggagagatacaccggcacactggcttcca

SEQ ID NO: 541029 - DNA, 366 bp, Homo sapiens
cttctacctatgtggagtatacagtgtctggaactgactgagttgctaaagaggccacataggctgccaagtcgcacctgctggcagaggttgcagtgacctgcacggtgttcccacagcccgtgacctcacagtgctaaccagaaggtgccaatgaagcattgctcacaccagtgttggacccagatgcaccttcgtccactacacttggcgcacctggactctctatagctggctcacccccagactaccatgtgttactggcagcttctacaggataccagatgcaccggacgcactacgacctgtgccacactttcatgggtgaggtctaattggggacactgtcatgaggtgtcgtccccc

SEQ ID NO: 541030 - DNA, 255 bp, Homo sapiens
catataattacaataatttaaaactaagcatacaccggattaaaaatcataaaagtcataaagatggcgagatatgtctattaaagtgaagggaaaggggtcatatgtttctccaagattaaactttaaaagacttctgtttggcttttgaagggaagggtgtcattcctgggtgtactgattctgttgcccacaaactttaagagctaaactcccattaaactgatagattgagacatttcatatttttcatct

SEQ ID NO: 541031 - DNA, 343 bp, Homo sapiens
aaaaaaccccggggccggtcccccccccgggtttttccctaggcccgggggggggataccattttcccccgggaaccgctttgccccctgggccccttttggggcccccaaaaaaccaggttggcccaaaaagccggggggggccgggccgggattcccggggatttggccccccccggggccggcccatttggggcaaaaaggtaattgaaaggccctttttttccggggtacccccgggattttaaaagggattttccttttttttttaaaggctttgggtttttttcctggccccctttggtttttttttttttaaaaaggacccccccttttggctgga

SEQ ID NO: 541032 - DNA, 477 bp, Homo sapiens
  misc_feature (11)..(11): n is a, c, g, or t
  misc_feature (206)..(206): n is a, c, g, or t
  misc_feature (214)..(214): n is a, c, g, or t
  misc_feature (220)..(220): n is a, c, g, or t
  misc_feature (222)..(222): n is a, c, g, or t
  misc_feature (226)..(226): n is a, c, g, or t
  misc_feature (261)..(261): n is a, c, g, or t
  misc_feature (279)..(279): n is a, c, g, or t
  misc_feature (306)..(306): n is a, c, g, or t
  misc_feature (308)..(308): n is a, c, g, or t
  misc_feature (318)..(318): n is a, c, g, or t
  misc_feature (337)..(337): n is a, c, g, or t
  misc_feature (354)..(354): n is a, c, g, or t
  misc_feature (364)..(364): n is a, c, g, or t
  misc_feature (385)..(385): n is a, c, g, or t
  misc_feature (401)..(401): n is a, c, g, or t
  misc_feature (403)..(403): n is a, c, g, or t
  misc_feature (468)..(468): n is a, c, g, or t
tgaaaatcagnagcaaaagaaagagaacaagagcattacttgatctcatgaaaacccatatcataacacctggaccttgctgaatcgaatgctgccgcctaaaaaacgggaggagttgccctgcttagaggaacagtagctggaatgctgcgaagagacgcccctgatgtcccagcaggcaccgctgaaagctaatgagaaaatantggaattngaatananagcncctgagccgcctatgctaaataaagaatcaaatanagaggaagagctccctanatgcacacagatgcattccttatccananagctgcaacncgagaaatttccgtacatnaagcagtcgaaggctcngatccccaanattagtggataagcggccttnaagatatgctgcaaantntcgagatagcgaacgattgtaaatgagcatgccgcgcgcaccgattaagcttcggcgttcactcnctagaagat

SEQ ID NO: 541033 - DNA, 1089 bp, Homo sapiens
  misc_feature (209)..(209): n is a, c, g, or t
gagtgtgttcaggcggctcggactgagctcgaactttccttatcccatttgatatgttggcagaaatacattgcctgtgctgttgtcttctattcatccaatggacgttcgttcttgatatccagtgtgtaaatgaatctggaagaagcgtacgcttcaggaccaggactttgtgacgtctgtattctcaaggacctcgtctccataanagaattctagttgccatgatattgcgcctcgcttttccccactcccaaaacgaaaagcaatgtgcatacatgtatacccctgtgaatgagcaaataattacaatcataaggaaacatttaagcaaagggcctggcgaagatacggacaaacggaaccgcccaaaggtgcctcgggttgtatacgcttgacgagtcctctggatagggcaccgtctgagtcgtagcattaaaactccggacgagagcaaccggacgaacaaaagacaacgtcgcctttccaagaacaacggggcaaaaataacggaaacgcaaggagacgcaaggcaagaaatctttacaacggtcaaacaacatcttcgggccaaagcacacggaaggaaaaaaggctggagtacaccaaggcagaggagcattcggggaaaatggcttaagacgtaaaaacgggagagaacaatcccctggacggaatggggccaacgaatacatttggtgccgttgggcacgaaataacattgggggaacgccaggtttatatggcacggaaacgtaacggcaaaatcggggactttaatgtgcccatgcgagattttggaaaacacgcgaaaaagagttggtcccgctgtcacagaggatgagaacctaagaacaaggcgaatagtttctccgagtagaagtgtaagtccccccattggacctgttgtcaacgggaaagagacacgtttggaaaaatgtgccttgggacgcgttaaacaattttcttgggttgtgcgttggaagggcaaaaccttggagccgtttttgtcagttcccacacaacgaaattgcagcccccctgtgtttcgcctttaataaaattaaattctctaaaagaagacaacga

SEQ ID NO: 541034 - DNA, 813 bp, Homo sapiens
  misc_feature (25)..(25): n is a, c, g, or t
  misc_feature (63)..(63): n is a, c, g, or t
  misc_feature (73)..(73): n is a, c, g, or t
  misc_feature (80)..(80): n is a, c, g, or t
  misc_feature (90)..(90): n is a, c, g, or t
  misc_feature (99)..(99): n is a, c, g, or t
  misc_feature (106)..(106): n is a, c, g, or t
  misc_feature (157)..(157): n is a, c, g, or t
  misc_feature (164)..(164): n is a, c, g, or t
  misc_feature (175)..(175): n is a, c, g, or t
  misc_feature (239)..(239): n is a, c, g, or t
  misc_feature (686)..(686): n is a, c, g, or t
  misc_feature (750)..(750): n is a, c, g, or t
  misc_feature (786)..(786): n is a, c, g, or t
gttttattaaaaatattatctccanacatctttcttttgagctgaaagagcccccatctgcgntgcctgcgcncaccgcnttcacggcanacacaggtnctgaatnaattaaacgctcaggctctggccccaccccagctttcagagcccacaagcngactgtncaaagtcaatnatttaaaacccaaaccctgggcacagtgcctggcagtgtcagggtcacccactccccttaagtnagccactatacatgttcatcttctgacaggcggggccaggacagacgccaggcacaggaatcagggcctggggtccctggaccacagccaccccctcccctgcctccccactgtcccctggggcttgggagaggcagactgctcagaggaaataacctcaacaaataaattaaacaataaatagccccggtgggccgagggctcctccagggggtcacaccatagataacagagttggcggcgggtacggctcgcgtgggcgggcgggcgcggaggccaggacttgcattgtgtgtcccggacgtgccctgacgcacaccgcagactgagggcgggaggtgggcttgggaccctgcgccggcggaaagagctccgggtgggcaggcagatgggaaggctgcctccggacacagcagcccagaggggcgtctggggttcaagtatccncccagggcaggcgggacctcgaccggagcgtctttggacagacagagcttgagaaaaccaagtnccgcgggatcagcgttcaaaaggcactcaaagcgangtcaccaggggtcagaggtcactgctt

SEQ ID NO: 541035 - DNA, 417 bp, Homo sapiens
cctgctccccgaggagggaggcgtgggtcctgtgtctggctgcaagacgtggagtgactgttcgtcccgtgtgtccctgacattctctcgtgtaacccatgaaaagactgagaccctgtggtgcctcccgctttccatccgcattccatggcaggtgagtctgattattcgaaggaggctggagtgtgggcggaggggcagcgcctggtttccccatcagatttgctcagggtccctccagtattcgatgccgaagaggctgtccccttggaggcccacgcatactagccacggactcctcacgtccatgccgggatttgcgccctggaaggagccgaccggttgcctctcgccaacatgcagcacttcccttcctttccatggagcacggttcctgtcccgggggtcaatattggc

SEQ ID NO: 541036 - DNA, 1025 bp, Homo sapiens
atctgcaggaaaagttgcttagtgttttagcacaataagaatttttattactcaggagttggagaccagtctgggcaatacagtgaaaccctgtcgctactaaaatacaaaaaaaaaaaaaaaaaaaaatttcccggggttgggggggggcgccgtgttaatctcccgggttacttgggcacggcgttgaggcagcgaaaacgtgctttgacccttgggaaggtggggaggttgtgctagtggacccgagagttgtgtgccaatgttgacctctccagtcctggggtgacaagagcaaaaacctcatttcttcaaaaaaaaaaaaaaaggggattgtttataactatatttccctgagaaaaaggggttttgggacacctggtgttctgggttcttttttaaaagggcctcttctctataaggggttcccagtgacgaaatatattctctaagaaactgtggcatttcgattgggggggatcttcaaaaaaggctctattcagagaacgggcgtcttccttgtgggcacaaatattagaaaccctaaggtgtggggcgtgtgttgctccccccacagttgcttgggggtattgttttacaaacgccctgtggcgggtgcttgcccacaactttagaagagaaactactgtgataaagttcgggggggagagtccctcccacgctggggaggggaacacaccccctctgtcaagagaatatagggggacagggcggacaataaacacacggtcccgacaatttttccacagaacgacaaagggtaccacgggtaagacaaacaccgtatacccaatatggggacatcgccgggtgtgaggaccccaggaataaacgggggagtcccctacactgggaccacacacgagggcggggtaaacaaaagcagttacacgggccggagaaatatggggctgcgcgaacattaaatatccccggggaagacaccgagagggggaggcccttaacgagcaaacacacaggggcgaaacaccgggcgaccgacg

SEQ ID NO: 541037 - DNA, 101 bp, Homo sapiens
ctgtggaagacgggtgacttgggaaagaagaagtgaggcctccagcgggacatccatggagggccgagggacccaggtccccctcggatcccaactatctg

SEQ ID NO: 541038 - DNA, 312 bp, Homo sapiens
  misc_feature (143)..(143): n is a, c, g, or t
tccttggtgagcaaggtaaagtgtgaagcctccctccctgggaaagattaccagcccacatgtttgtggggcttccttgagggaggcaaggattcatgtcagggtgattctggtggccctgtggtctgcaaatggacagcttncaaggagttgtctcctggggtgatggctgtgcccaaaagaacaagcctggagtttacaccaagggtctacaacatatgtgaaatggattaagaacaccaaagctgccaacagctaaagcccccagtattttttcagtctctataccaataaagtgaccctgttttcaca

SEQ ID NO: 541039 - DNA, 376 bp, Homo sapiens
cccttttagggggaaacccctttcggtgggcaagggaaccccaaccccatttttttggacttaattttaaggtggggggaacccaccccctaacctttgggttccccaccaaaaagggtggccctcccctttttttatggttaatgttttaaccccgccggccagggaagggaaaaaaaaataagcttccccctggggtttttgggaatgaggtaaggctttgaatttggtttgatataaaaaaaccttttttgggctaaaaaacctttttaaaacccattttgttggtggggggaatttttttttgcccgggccccttccccccccaaacccttttgaagagggtctggggtttttttaaaaagttccctttgta

SEQ ID NO: 541040 - DNA, 207 bp, Homo sapiens
cctccttggttgcatggtagagatgacctgctgtgtgtcattaatgcatgtagccattcagattgcttctcctttggttggtgattaccactagtctcctgtattgacctcaagtgcctgtcctacatagtcgacagaagtggtaccgcagctcgatacttcgtaaatcattagctcagtagctgttttcctgctgttgaaaatgcc

SEQ ID NO: 541041 - DNA, 327 bp, Homo sapiens
tagatggagtttcattcttgttacccaggctggagtgcaatggtgcgatctgagctcactgcaacttccacctcctgggttcaaatgattctcctgcctcagcctcccaagtagctgggattacagacgcccgctcccacgcctagctaatttttgtacttttagtagagatggggtttctccatgttggccaggctggtcttgaactcctgaccttgagtgatccacccaccccagcctcccagagtgctgggattacaggcttgagtcaccgtgcctggcgcttggttttcttataatcttcattattctttgctgggcctacct

SEQ ID NO: 541042 - DNA, 1513 bp, Homo sapiens
ttccgttgtcctccttgttggcggtcgttttggcatttgtctggactgattacttggtagggagccccggagcgctgggtcagcatcatccgtgactgactgagaacggcgcgagaggagctcttccccggctgcacagaggcgtggcctgaggctcggcggcgcccagggtacccaggcccggcccggcaatacaggacatcctactactggaccccgctccgctcacagagatccgactggcgcgcgcgccgagcctgcacgcgccccggcccccagcgcccacttgctgcacgctcttgcagcgcacgctgcccctgctcttacgttcgtccctgcgcacccggcacctggcggcgctcctccctccgccctgcagcggcctcacgccccactgcccttggttccccaccgcactcgctcgacctcgcctcgccacccacacccttttgcaccccccctctaccacaaccccctcccccctgccccctcgccctaacctcgcaccccactccccccactcgcaccccctaaccgccccacccccatcaaccttcctccccccttcacccctaacccacctccctcccccaaccaactcaccaccctctccctctccacccacacccccatcaacccacaaactcctcccgccttatcgcgcgggcccccctgacgtcccccgtgtgttcctcccccccgcccccgcgcacccgggcatcccccacccacgccgccccgcttagcgccgctcgccgcgacgctccgctcggctccccacgcccccctcagcgcgcgtccccttccggccccccgtgaccccctctgtccgctttcccctcctctgctccgacccgtgctctggcccggcttctcgcgccttccaccccctccgcgcttctcgcggttgtttctctctttctcttcgctgcgcgttcgtggccgctcctctcggccacacccccccccttacgcctccttcccactcccatcctcccaccccccctcttccacccccccacatctccctcaccacccccatcctccccctccccaacacccacccccctccaatcactcctactctcccccccgctctacccccccctcttaccccccccttccccccccctttccccgtaccagctcttcccgcccgcccccccactccgcgccctccggtgcgctcgcttcgccctctgccgccgcccgcccctctcactccccaccccgctgcgcggccctccctcgtcgcaccgcggtcgtcctccaccctcactggagctgcgcctgcgtggcccccgcccacaaccacccccctccccccccttcaccactccctccatgtccgccacaccccccccccgcgtttcctctttgtctcccccctcacctcatctcctcctcccctcccgcttccttaatccctcttcctcctcctcatccctcacctcacctgtccctcctcccccctactttctccgcccccacctacaccaccctcccactacac

SEQ ID NO: 541043 - DNA, 173 bp, Homo sapiens
atactgctctcataacatgatctgatggccttggtccaggccctgtggatctaatcaaaagcatcattccctagtcccattgcagaagaaacgctacttcacctctcagcggatgaggagtgcgtgtggcggcagttgcaggtaccagagatgtactgaattttcagacgcgg

SEQ ID NO: 541044 - DNA, 134 bp, Homo sapiens
atcctaagcagcggtagcttgaggctggagctgggtggcgggcgggtacgggaccgtggagagctgagaggtcaggccaggcgtcgtcgagtgagcagcgtgctgcgtgtggacctggccgcttagcacatgac

SEQ ID NO: 541045 - DNA, 420 bp, Homo sapiens
tgagagggtagaccctagctgttttatgaactaacaaaagctgtcctttatcagtaaacagtatctccttcgaaaactaggtacctgaaagtcaatatagtaggatataaaaaattctaaaatttatctaatagcaaatattgtatctcatgaatccagtacacatcatcaattataagatgccccagtaattatatttacccccaaaaaagaaaaaaaaaaccactgccaaataaattgtgaagtacatcaattgcaaataattccaaatttgagacaggttaaaagtagaggaaagtacattttaagatcaataaaatacattaatttaaagccacagacatttactacatttcttctccaaaatcctcactttcacttttgcaatctttaaccactaaaaaattatcctttcaagag

SEQ ID NO: 541046 - DNA, 681 bp, Homo sapiens
  misc_feature (565)..(565): n is a, c, g, or t
  misc_feature (567)..(567): n is a, c, g, or t
tggcacgaggacttctcttctttactaataaatgttctttgtggcatattattatttttccataatagggcacttctgtctgccttaagaacctgttttggtagatatgctttctcctcaatgattttcttaatggcatctgggaactcatttgctgcctcttggtcatcaggagctgcctcttctgttatcttaacatttttaaagccaaacttctttctaatattatcaagccatcctttgctggcattaaattctctagatttagatccttcaccttccttttgctttaaattgtcatataatgaccgccttttctccaatcatattagagcctataggtacgtctttcttgtagcaatactgcacccacataaaagttgcatttttaatacgagataaaaaggtatatcacaaaaagtgtaaggtttgctggtatagatgcagtaatggcttcataaattttcttaatttttttttaacagtggtccttatgctggattcatttatcttgaaggatgggcaactacagctgcagaccagtacacatcaagcaatttaactntntcttggaatgtcatgactttgctccttgggagcactttcagcgtcactagcgggacttcatatgggtcccttgggtattattgcaagggtttatgttgtacctaaacatgatga

SEQ ID NO: 541047 - DNA, 268 bp, Homo sapiens
tgagacgaccttacagcactagccttactcagctatccattatagcttggcccttaagaggccatgatgaggtgatgaaaaaattattggaggacaggagcgtgataccttcctgggtttttttttggcagccttcaaatcttattttcttgccccacaaggtgagcggctacccctgaaactcttttttttaaaggattaacctatcaattggaaaaaaaactaatgggggaaggggataatccctgattccagggtggccttctga

SEQ ID NO: 541048 - DNA, 192 bp, Homo sapiens
ctgcttagaaactgagatatctgaacttatatttggttagtgtagttcaagtgaattggtctctaaatgcaccttgtgtagaccaacgcctttcgttttaactattatcatacaccatttgttggacagacttggtccctgccttttagtccctgccttgcacactgctcctttcaagaaggcaggaactgg

SEQ ID NO: 541049 - DNA, 211 bp, Homo sapiens
ttgagtattgattcagtgctcacattctacatgtgcaaaacgaatctatcggatcgtactacaaccacagcaggtaccaggacagttaagcttgagttccttctttcccgtcaatctgtagagctagccaggtctttcgtacagttatagttgggttattccgtgttaatccttgttggtgcccatgtgcgtccacttagtccaggcttcg

SEQ ID NO: 541050 - DNA, 277 bp, Homo sapiens
tagctcccaacaagaggagagtgaagaggaaggagttcggatggaaacgggtgtagaagttaaggacatagaatgggtcatgtcacaagcaaatgtgtcgagagcaaagccaggtccgagcccggaagaacaacagtaaggatatggtaaaggcgattagggaattaccaaggtaacaatagggaaccaccttttttgggtgtctcaaaggagtactgcagctggtttgaaattgtactgtttctatcataaataaagttatggcttcttgtggatg

SEQ ID NO: 541051 - DNA, 189 bp, Homo sapiens
gagatggctggagtgatgggtgggagctagatctgttctagagagagcagactccaagctctctatgctggctcccagctagtgggaatcctttagagcttgttcttcaactctacacgttcaaaaatgctactatggagtcgtttggagacgggggagatgggaaaactgagcctctcatcttgacca

SEQ ID NO: 541052 - DNA, 630 bp, Homo sapiens
cagtaagttatctttgaatatgtagtatctatatgactatgcgtggctggaaccaacatgaagaatgtagagtaatgaaatggaggatctctaaagagcatctgatcttgtgctgtataaaggataaagaaggatgatgtctttttattaaaatatttcaggttcttcagaaagtcacacattacgaagagttaaaatgttatcaaaatagtctaaggccatggcatccctttttcataaattattgattatttaagactaaaagttgcattttaacgcctattttaccgtagctaattatttaatgtccagttgtcttggatatataggctatttggctaaagactgtatagcatgacacataaaatatatctttataaaagtggaagtatgtatattacaaaaagagacatccaaattctttttttaaaagcagtctactagatggtgatcccttgagatatggacaggatggcctataagggcgactggcatttaaaaaaaatcccgcaaaacttcgcaaagatggctattgatacttggggagggtgcttggctttatgaatatatgatcgggcatcaaggaaagaacaatgcgtcaaaaaatgttggtgagactcaggaaaaaaa

SEQ ID NO: 541053 - DNA, 1289 bp, Homo sapiens
gacatcagctctgcccttcgaatttaccctgacactggcagagctcaacctgacgcagcaacgagactgggcgatgtcaggagatgcattgcgtgctccagggcctgcagaccaccactcctgcaagagtccagaagctgagccatccagaaacatgctgcctgacggggagccggaatgcgcgggtcctgaatccagcaacacatacgctattctcatgaccacaacaccatgacaggacgctgcaaccatcaagcagacaaaccatcaaagagagagagactagcgcagagacccatgcacaagacatgcctcatagcacagacacggcaccatcacagagagaaacacacaccacgatgacaaagaaccatggaaacacaacagcgatgcaagaccatggacagcatacatcagccagcgcacatcctcgcgccacatggcaccacgacaagtcgacagaaccgacaacacacccagatgagcacacaaaccccccgagtgaacaatccaacgaaggacaacccacaaaggacacgagcgcacgatgtaccacacggcgagagacaaccaaacggaggaaacaagaacaaagcaaggacacgcaccgcactacacaacaccgcaccgagcccaatgggaccaggattcacacgaaggaatagccatcacgatagacgacacagaccggagaacacacatcggaacacaagggcaaccaatcagcagccccgacattgagccacgacggagcaagtaggacgacaacgaggaccaagcagaatacaacaaacagcaccaatcgcacgacaagcaccgcccgctacaccatgcgcgactcgaatcgcacccacacgtacccagaagacccacacagacccagtggcacacacgaagacgacaacccacagtaacgaagcgccagcgagcaccaccgaccgaacatgccgccacacaaccgccaaacaacgaacacaaaacaaccactgcacaaagggcaaaacaatgacgacacaccaatgagcagcagcaagcacaacaccacacaagccacagcggagcgacgcacagcagcacagagacgaacacacgcgcagaagcaacacgacgagcaaaagcacgataggggaacagggaaagcacaagcgacaccagacaaacacacaccgagacacacaagaagaacccgcggcacgaaacaatccacgcgagagaacagcaactacaaacaacccacacacaccaagcagggaaccgaagcacgaagacgaacacaacagaagacccag

SEQ ID NO: 541054 - DNA, 524 bp, Homo sapiens
ttgagtagagaccccctgttccccacacagtcctttgaggtttggagggtttagacgaggctcccaaaagtttaacggccattcccgctccttgaggatcgccttggcctcattgaaatttttgaaggcccgtttggaaaccacctttagggaggtgggggcccgtttcccccttcaaatggagcggctaaaggggttttttttgccccttatgttaaagttggcccaaccccgggcagagggtcggggccgggccccgggttttaaggcccttttgaacatcaaggtcaagttgggggttgggtttcccccctccccccgcctgttgggagagggggggggtttttttttttggtgttgctttggccagcagcacttccatgcaacccttccaaaagcccccccccccccggatagtggatggcaaagtggtttttgagcccaatgcccccaaattttttgggctttaaccccccaaaagcggggtcccctttggggggcggggggccaataaaaagtttagg

SEQ ID NO: 541055 - DNA, 911 bp, Homo sapiens
gtcctctaagaacccagcacacgaacatcggaatcacctagagactacttaattctggcgcagtggacactggagtactacggacaggctctaagcctgccttattcgacaccgagttggtgccaggcaggccattccttctaggtgacacgagcacacttgtaagaacgtcatcgtcccagaccatgcattgagtaataatcttgttcactgaatgtaagtattcgctatcattaactcgggaaggctatgggcgaatcggtgacataggtttgcccgctaattagattcgggtggctcccctgataatgcgtgtatcctcgcgcattatagacgacacactaacactactgagctcttaacgcgtccctctctccgtactctcgtgctctgcatcgtgctatatgtggagcgtcggagcaaggaacagggttgaactggtctaccctgccttacggagtggaactacacccatcgcgggagcctccgtgaggaactagctcatacgtttctcctttagacctagcaggtgtctcctctactatggaggggcgcagtccaatttcatgcacaacgagattatcagagtgatataaagccccctggcgataaccggaagaccaaacgctccctctgtcgtctgatcggtgcctaatcgacagcagtcctagttctcctatctctcgcagtcctagtcggctggcgatcactatactactaagagagcgcaacgtcaagagcagcttcttcgacgcggccggagggaggagacccccattctatatcgaacacctatactgattgatcggtcaccctggaggtgtatatgcttatcctagcaggcttcggaataatctcccgataattgtacttaataatccgggacaaaaaaacctttgggtaataggatg

SEQ ID NO: 541056 - DNA, 864 bp, Homo sapiens
cgaggtaggtggatcacctgaggtcgggagttcgagaccaacctgaccaacatggagaaaccctgtctctattaaaaatacaaaaaaaaaaaaaaatagccgggcattggtggcgcatgccttgtaattcccgagctactcaggaggctgaggcagaagaattgaacccaggaggtggaggttgcagttgagctgaaatcgtgccgttacttctccaacctggacaacaagagcgaaactccgtcttaaaagtggaccaggacaggaccagatttgggagtcatggtccgggtgtccttttcactacaccatgtttgagctcaaacccccaactctcattccccaggtggctgacccagtccctgggggaaagcccgtggatttcagaaaagagcaagttcgtggatctgggaacccttttcctttcctttcccgtggctttgtaacttccaccaaacccatcagaaaggagaaaggacaggagaactcaccttcgtgcctcaagtgtgaatcagaacccttaccccaaccacgaatgttggcccttggccttgcgggggcttttccaaccttcaagcctgtgggataatgctgttggcctcaatcttataacatgcattggctcttggtacatgtcaccacctttcccaagttctccctcttggccctatgccattcattcgggggaactcctgggaaattttcagttactcaagccctggggccccaccaccttaaggccactcctcccaaaggacagtctaggaagcctgggcaggaaaagcacacgagcgggcaaaatgcagttaaaggggcgctgaacggggagacaggggtcatcatcgatcctactttcacttgcca

SEQ ID NO: 541057 - DNA, 853 bp, Homo sapiens
caaacttcttgttctcaataccatcccaccgtttacatatggacaacacctttgtgtgagaaaataaatgcgcctgcttaacacatttctcgctgtatactgaaaatttcccaacataaggggataaattctgcgcaaccaaatgtgtttcgcccgctttgcacaccccctcgggtaaattgaacacacacaaatttctatgcggaaagacgccctctcgattgcatcccctattccagcccacacccttctgcgccctattttagtgcgcccacaaaggatttgcctgccccacactcttaattcgtaatatatgccccaacaatgatctccttgatcatactctccccccctttccggcatttttttctccccccaaccagcaggtttgttcaacttcttctagaaaaacaaaaccgtaataatttatttcagagaaataccctagacaacattgggtgtaatatgctcgaacacccactttttgagataagaaacttcttcccaaccagatcgccccctcaaacaccccctgcaaatactgtttctattagagaaaccctttattcacatgacgacccaaaaaacaggttatcccctcaagacgtgtctcaaactatccgccggtttctcatcttttcttttcaccaacaaaaatgtgtttatacaccctcaaaatcatgttaggagaaagacattacttagttccccctccccaccctttataagatttgccccctattctgcccccctagacccccccctcgaaatcgcaaccctgacacccttttaaaaaaaaccaaaaccctcagtttttggacaacaagaggcgaaaaccccaaaaacaaaaaca

SEQ ID NO: 541058 - DNA, 961 bp, Homo sapiens
  misc_feature (215)..(215): n is a, c, g, or t
  misc_feature (224)..(224): n is a, c, g, or t
  misc_feature (266)..(266): n is a, c, g, or t
  misc_feature (287)..(287): n is a, c, g, or t
  misc_feature (289)..(289): n is a, c, g, or t
  misc_feature (331)..(331): n is a, c, g, or t
  misc_feature (346)..(346): n is a, c, g, or t
  misc_feature (392)..(392): n is a, c, g, or t
  misc_feature (416)..(416): n is a, c, g, or t
  misc_feature (460)..(460): n is a, c, g, or t
  misc_feature (464)..(464): n is a, c, g, or t
  misc_feature (715)..(715): n is a, c, g, or t
  misc_feature (717)..(717): n is a, c, g, or t
  misc_feature (733)..(733): n is a, c, g, or t
cgcctggaccgtaggcggggacatggggtctctggttgcgtgcagtgcgccatgagagcaggtcttcgggaccggccatcgtcccggtcttaacaccagcgacttccagaagctgaagcggaaatattgaagtccagggagggagcgccccgggccgcgtccgccccgtcccacactacgcccccgccccactcccggggcctgttaatctgagnccgatccgngaccggcctccttgcgtctcccattcccaagattgtcccgcntctgccaatccccgccgtccntncagcccacgacctgccgcgccgaggagcggcatctgtcccgnttcccgattgggtcngtcgtctctctccgcctagcgacagattccttctattaagggattngctcgctgagttctaagctctaanatgggtcaactcctttgttttccgcctagcgacaagggatttgntcgnacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccncntgaccccctcagggantggccccaaactgtccctgcctctggcaccccctttcattggttccatccatccccacaacagcctgccaatcgaagcccgtccctgcatccaggatggtaccagctcccgcccctctgccccccacctccacaggtgaccttaaagggccctcagtccacccaaagtgaggggcaggggccctcactctccggccctggtgtgggataaagactgaggggcttggga

SEQ ID NO: 541059 - DNA, 948 bp, Homo sapiens
  misc_feature (215)..(215): n is a, c, g, or t
  misc_feature (224)..(224): n is a, c, g, or t
  misc_feature (266)..(266): n is a, c, g, or t
  misc_feature (287)..(287): n is a, c, g, or t
  misc_feature (289)..(289): n is a, c, g, or t
  misc_feature (331)..(331): n is a, c, g, or t
  misc_feature (346)..(346): n is a, c, g, or t
  misc_feature (392)..(392): n is a, c, g, or t
  misc_feature (416)..(416): n is a, c, g, or t
  misc_feature (460)..(460): n is a, c, g, or t
  misc_feature (464)..(464): n is a, c, g, or t
  misc_feature (715)..(715): n is a, c, g, or t
  misc_feature (717)..(717): n is a, c, g, or t
  misc_feature (733)..(733): n is a, c, g, or t
cgcctggaccgtaggcggggacatggggtctctggttgcgtgcagtgcgccatgagagcaggtcttcgggaccggccatcgtcccggtcttaacaccagcgacttccagaagctgaagcggaaatattgaagtccagggagggagcgccccgggccgcgtccgccccgtcccacactacgcccccgccccactcccggggcctgttaatctgagnccgatccgngaccggcctccttgcgtctcccattcccaagattgtcccgcntctgccaatccccgccgtccntncagcccacgacctgccgcgccgaggagcggcatctgtcccgnttcccgattgggtcngtcgtctctctccgcctagcgacagattccttctattaagggattngctcgctgagttctaagctctaanatgggtcaactcctttgttttccgcctagcgacaagggatttgntcgnacggcattggctccatcccctagtcgctggacagctctttttttgattggctcaaatcctgtaaagggcttgaccagtctctacatagtcaccgtccgcttttcctgagttctccctcccaattggctccagcttcctgggggcgtggccaagccctcctcttcccagaattggcccggggccttcaatttacgttctttacactacggggactggggtcgtctttgcccacgtcccgacaacttgttccncntgaccccctcagggantggccccaaactgtccctgcctctggcaccccctttcattggttccatccatccccacaacagcctgccaatcgaagcccgtccctgcatccaggatggtaccagctcccgccctgccccacctcaaaggtcctaagggcctgtcacaaggtgggcaaggcctaattcggcctgttggaaaagtaggttggactgaagtgaggggcttagataag

SEQ ID NO: 541060 - DNA, 512 bp, Homo sapiens
  misc_feature (18)..(18): n is a, c, g, or t
cccgcataaattaggccntaggcacagaaccaactctgtttctatttctataaaattctagaaaatgcaaactaaaccataatgaccagagaatattagtggtttcctagggatgggatgtgggcaaagagagacgaaggaaggagggattaccaaggaggacagggaaacttcggggatgagggatatgctcattatcttgactggtgatggttttacaggtgggccaaaactaatcaaactttacacttcatctatatgaccagctatcatatgtcaattatacctcaataaagctgtttaattgacatatgatagctggtcatatgtcaattaaacagctttattgaggtatatctactggaaagtaaaactttttaattatagactctatcatcacgtgcatagaaaaatccaaaggattctacaaacaagctactagaaccactgactgcatcaagatgcaggtacaaagttaatattcaaaatcaactatatttctatacaagagc

SEQ ID NO: 541061 - DNA, 348 bp, Homo sapiens
gggctctgtgtggtgtttcaatgttctcagcgcagctggggagagtattttcggctggtgaatattctagccctccttccactcctcgtgtggtaggtcatgtctagcagccagtctgtatcttctgggaccttgtcagatgtgctgcatctcgctaccttctggatcagaatctacattgtagcaacgatttcctgtgatcatccttgtgtatacagaagtttaataagttgtgtcatgagcactcttttgagatcctaggcccaggatagcaaataccgagtctgcatccttccactgtcctgcggtagtatcagacattactagctgatctagccgatccatttt

SEQ ID NO: 541062 - DNA, 305 bp, Homo sapiens
gatgcacagcacacacttttgaaggatttcagatcatgaagaaaaattggtttggggctgctctgctcggcagtctggtgcttgctggatgcggacccttgagtcaggtggactcggaaggtcacacagaaaacccggtgtttcctgaagtggacaaagcgacttttcacacgggctcttacccgaatatcgacaatctgcgtcaggtccgggaaggcgtgacacgcgatcagttgtatgacctgctgggtcgcccgcactttgccgaaggtttcaaggtgcgggagtgggattaccgtcgacgc

SEQ ID NO: 541063 - DNA, 287 bp, Homo sapiens
agtcatgatggattaaagacttaaatggacacacctatatcctagcactttgggagcccaagcttggagtatcacttgagccaggaattcaatgaccagtctggacaatgcagtgagatcccatcgctacaaaaaaaaaaaaaaaaaaaggcttgggggcatgcagggttatccccagttccttggactgctgaggtaggaggattctttgagcccaagagttcaaggctgcaaggagcatataatggtccttacaacacccttagcttgagtaaaagagttgcacc

SEQ ID NO: 541064 - DNA, 271 bp, Homo sapiens
ctcctagtggaagcccaagggcctttgaaaacctcctgctgccccctgtttccctgggctgaaaggggaagtgcatatgtgtaacggggactggttcctgtgttttagggcccaaaccttaacaaatgattgattttccctgggcaaaacaggaaagcaaataaagcagggaaaaggaaaaacagcgtttttttttacaaaaaaaagggtgggagggtgtggttttggcccttataggaccctgtgccaataaacaaacatgcatccgtca

SEQ ID NO: 541065 - DNA, 270 bp, Homo sapiens
atagaaagcgagggctgtcctttacaaattcttggttctgcaacttcctagcgtgactttgggcttgggcaagtttcttagccgttctgagccttcatttcctcatctgtacaatgagattatagtacctatcatctaccttcagattgctgacagcagatttgaataaatatgcaggtagctatacaaaagtagatgatccaaaatggtagcactacctcacaactgagtcatgacacgagtcgagattatgtacactctatcatgtgt

SEQ ID NO: 541066 - DNA, 911 bp, Homo sapiens
  misc_feature (34)..(34): n is a, c, g, or t
  misc_feature (171)..(171): n is a, c, g, or t
  misc_feature (201)..(201): n is a, c, g, or t
  misc_feature (267)..(267): n is a, c, g, or t
  misc_feature (482)..(482): n is a, c, g, or t
  misc_feature (893)..(893): n is a, c, g, or t
  misc_feature (895)..(895): n is a, c, g, or t
  misc_feature (911)..(911): n is a, c, g, or t
actcttgtccttctgtccggcccccacagctgcngctcacttatcctgccatactgggaaaggggttcccccacgatggcttattctgggtccagactttccccaggtagggaaagcggaaggtagaaggctttttttgctggctctagggttcttctagttcgaggcctngggtccccatcctctggaaccagggggagncctggaaggagttcactgtagacccgtcccatggggaaagaggctgcggacttgctgctgctgctnctcccagtggcctcttctgggtgccaggagaggggaaggacctttgtctgggcgttaaccaagggctggaaactttacctggtacctaaaggtttcatttgggatcagaccggagacccttgggttctcccgtctcaccacccctttctacagaaagcacttggaagattgtttcagggtgtctccagggtccctctgtaaccatctgctgtggnaatgcaggaccctctgtgacattctttatcccttcttccccgggttggtggccatggagggtcttgtctgctgtgaatcgactctggatgctgtgagcttgatgctggccagggaagcagaggatgtgagaggcagaggcaggctcctggggctgagctccttcctctgcatcattctgggcttggcctggacagcacccgccagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaaantngtgttaaaataatgcn

SEQ ID NO: 541067 - DNA, 605 bp, Homo sapiens
  misc_feature (100)..(100): n is a, c, g, or t
  misc_feature (114)..(114): n is a, c, g, or t
  misc_feature (198)..(198): n is a, c, g, or t
  misc_feature (233)..(233): n is a, c, g, or t
  misc_feature (276)..(276): n is a, c, g, or t
  misc_feature (283)..(283): n is a, c, g, or t
  misc_feature (300)..(300): n is a, c, g, or t
  misc_feature (315)..(315): n is a, c, g, or t
  misc_feature (369)..(369): n is a, c, g, or t
  misc_feature (378)..(378): n is a, c, g, or t
  misc_feature (387)..(387): n is a, c, g, or t
  misc_feature (389)..(389): n is a, c, g, or t
  misc_feature (429)..(429): n is a, c, g, or t
  misc_feature (467)..(467): n is a, c, g, or t
  misc_feature (486)..(486): n is a, c, g, or t
  misc_feature (496)..(496): n is a, c, g, or t
  misc_feature (505)..(505): n is a, c, g, or t
  misc_feature (538)..(538): n is a, c, g, or t
  misc_feature (593)..(593): n is a, c, g, or t
gcgccctttttagagtgtttgccacaaatttatttcataagaaaaacttttttgcgttcaacaacacaagaataaaggtatgcacagggtttgaggcggngagcagtgtggtangcccagcaggaagaagccccctatacttctctaaagcctgggtgcctgcttgaggagggaaggcaggaacccaggggcaggggngggggtctcttcagcaattatgatgacgcactgtnacctcctggcccagggttcccaggatactgagggaggggcccngagactntgaacccagcggcggcngaatgcctgtgtgcngggcctcaacaaggcctcgcaggacctcagtgcaaggggagaaggaaaaaaganaaaaaaggngacagaaananaaagatagaactggtggttggggttctgggcagcccaggngtcagccccggcaagcagatggtaccgagcatgagacngtgagggacgggccgccancacagggtgntaacacaanctgcgaaggcctggggtgagtcccaggagtcgngaaccacatggcaggcagcccggagccgccggatgcgcgttccgcgtggctgttnactcgcaatcct

SEQ ID NO: 541068 - DNA, 102 bp, Homo sapiens
ggcgggcatttagtggctataaatttggcctctaaacatgggctttgagctggtgtcccagaagattctgggtacggtggtggtcttggttctcatggggtt

SEQ ID NO: 541069 - DNA, 868 bp, Homo sapiens
  misc_feature (5)..(5): n is a, c, g, or t
  misc_feature (152)..(152): n is a, c, g, or t
  misc_feature (163)..(163): n is a, c, g, or t
  misc_feature (178)..(178): n is a, c, g, or t
  misc_feature (220)..(221): n is a, c, g, or t
  misc_feature (223)..(223): n is a, c, g, or t
  misc_feature (226)..(226): n is a, c, g, or t
  misc_feature (229)..(229): n is a, c, g, or t
  misc_feature (232)..(233): n is a, c, g, or t
  misc_feature (239)..(240): n is a, c, g, or t
  misc_feature (242)..(242): n is a, c, g, or t
  misc_feature (245)..(245): n is a, c, g, or t
  misc_feature (252)..(253): n is a, c, g, or t
  misc_feature (269)..(270): n is a, c, g, or t
  misc_feature (276)..(276): n is a, c, g, or t
  misc_feature (281)..(281): n is a, c, g, or t
  misc_feature (286)..(287): n is a, c, g, or t
  misc_feature (293)..(293): n is a, c, g, or t
  misc_feature (300)..(300): n is a, c, g, or t
  misc_feature (305)..(306): n is a, c, g, or t
  misc_feature (312)..(313): n is a, c, g, or t
  misc_feature (323)..(323): n is a, c, g, or t
  misc_feature (333)..(333): n is a, c, g, or t
  misc_feature (337)..(338): n is a, c, g, or t
  misc_feature (344)..(346): n is a, c, g, or t
  misc_feature (354)..(354): n is a, c, g, or t
  misc_feature (356)..(358): n is a, c, g, or t
  misc_feature (361)..(361): n is a, c, g, or t
  misc_feature (363)..(363): n is a, c, g, or t
  misc_feature (365)..(366): n is a, c, g, or t
  misc_feature (368)..(371): n is a, c, g, or t
  misc_feature (375)..(375): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (394)..(394): n is a, c, g, or t
  misc_feature (402)..(402): n is a, c, g, or t
  misc_feature (404)..(404): n is a, c, g, or t
  misc_feature (410)..(410): n is a, c, g, or t
  misc_feature (412)..(412): n is a, c, g, or t
  misc_feature (418)..(420): n is a, c, g, or t
  misc_feature (422)..(422): n is a, c, g, or t
  misc_feature (427)..(428): n is a, c, g, or t
  misc_feature (431)..(431): n is a, c, g, or t
  misc_feature (434)..(434): n is a, c, g, or t
  misc_feature (438)..(438): n is a, c, g, or t
  misc_feature (444)..(444): n is a, c, g, or t
  misc_feature (446)..(446): n is a, c, g, or t
  misc_feature (614)..(614): n is a, c, g, or t
  misc_feature (617)..(617): n is a, c, g, or t
  misc_feature (850)..(850): n is a, c, g, or t
  misc_feature (852)..(852): n is a, c, g, or t
  misc_feature (868)..(868): n is a, c, g, or t
ttatngttcgatacttttaaaattttttgggggagtatttgttattgtttttggatagtttggggatttatttaaatgttaatttataattgtttttttcgtttgtgtatttttgttgtatttgtattggttttttggggatggtgtttaangatttttattngtttaattatttgantttatagggttgggatttttaaatattgttgttagtttgttnngnccntcntcnnattccnncnccntccctcnnaccacaccccaactanntttccntcctncttannaacccntccaaantttanntcttanntaaatttccnattccccacnacannctacannncctcctcntnnnctntnannannnnttcntanactaatnanttccaanattctttnancctctncnattctnnntntctannatntcntctncaatcnancaccctctgtgacattctttatcccttcttccccgggttggtggccatggagggtcttgtctgctgtgaatcgactctggatgctgtgagcttgatgctggccagggaagcagaggatgtgagaggcagaggcaggggggtgggggggaggggggggggggggatganggngggggtggggtggagaggaggggggagtgagagctgtgggcctcaccctctggcagctgagccaagcactgtcattcttggtgccatcttcccctgccgcaccggcagtctcagcccagcccccacctttgggttgtaggttgggctcccaagcaacacagaccactcttccccttgcccctcccccagagggacttgactttctttctggactgtttgtattgaaacaaaantngtgttaaaataatgcn

SEQ ID NO: 541070 - DNA, 341 bp, Homo sapiens
  misc_feature (100)..(100): n is a, c, g, or t
  misc_feature (114)..(114): n is a, c, g, or t
  misc_feature (198)..(198): n is a, c, g, or t
gcgccctttttagagtgtttgccacaaatttatttcataagaaaaacttttttgcgttcaacaacacaagaataaaggtatgcacagggtttgaggcggngagcagtgtggtangcccagcaggaagaagccccctatacttctctaaagcctgggtgcctgcttgaggagggaaggcaggaacccaggggcaggggnggggaggccaaggcgggagggttattagttgaccatcctgggcaacatggagagaacctgttcctacagaacttttaaaaagatttaaggccagttgaggtggctcacgcctgtaatcccaacactttgggaggctgagacgg

SEQ ID NO: 541071 - DNA, 935 bp, Homo sapiens
ggctggatgtccaggctgcgggcgctgctgggactcgggctgctggttgcgggctctgcgcctgccgcggatcaaaagcctagactcatcgcctgtcgctcgggagccacctggtggggaccgcagtggctgaaactcgtggtggccgtctgggactcacgaatggtcatgggtgagcacggatggtgaagtacctgagcctatggagtggcaggcccatgccgtggatcaggagctatttaacgaataccatttcagcgtggaccaacttatggaactggccgggctgagctgtgctacagccatcgtcaaggcatatcccccacgtctcatgtccatggagcccgccctacgtgtcctggtcatctgtggcccggggaataatgggcggagatggtctgggcaatgttgctcgtacaactaccagctcattcagggtaacgagccaaatgcatctattactctagaggggcatacctcgatcgcccgtgcattgcacgagcgatttgggtgacccagtgtcgagaacaatggactatccctttccttggggaaatgtccgcagagccatgacgattgatgaagcctgtattgagctgctgggtggattgcatctttgggttcagcttctgagggccgatgcttcggggaaacctgttccccacacgcaattcctcgaagttggttcctcgaaaaggtgacttcaccttgttggccccatttgccccagcattcgacacatttcccctccagcgaatgggggaccgtggacggaacgtgggacaactcggtttggaacgggcatcccagcaccccaggacttttgcctccagtgctcccctctctcgaggcccccgcacagaaagtcccttggaaccccaagcttaacgcggggacaggtaaaccgaattaacctcggcgcggtcacttcttga

SEQ ID NO: 541072 - DNA, 138 bp, Homo sapiens
actttttggcatgtcaggcctgaagatcctgtgtacttctctcagcgtgttgtttttggggaaacgttcaagctttaccccagtgtgagacaatttcattagggcgcatatacccaaataaacctgtttttcatatta

SEQ ID NO: 541073 - DNA, 1696 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 541074 - DNA, 1063 bp, Homo sapiens
gcagcacaccccggcacctcctctgacggcagctgcgcctcgacaagcgcagtgcctgcagcgcacgccggagtggctgtagctgcccggctgcggctgcctgccctgcgcgggctgtgtggctgcgggcctgcgcccccggctgctggccagctctgcacggctgcgggcatctgctgtggcccggtgctctgcaaacgctgcgtgcgggcggcatggggataacgcggccatggtgccgccgagatcggcctccgacagggatgagggagttggtgggtccaaggtggaggctgctgggcgcgtgcccccatgacttgaatgactgtaaccattggcacattccaaccccgactcaggattctacccagtggcacctttacaggtccatgggaaggatatacaaggggaaaagagttgatgtaaagtattatacaagtgtgtaactgtgaggataaacgtataataatcaccagagaggaataattaatgagggagaaatgatggaatggacaagatggtccaaagaacgaataaaataaggaggacttaaaaaagcaagaggatttagacaagaaagagcaagaagtaacgaagcgtagtggcattcaccagacacaatcttacggggaaaaacagggatctgaacaccccccttggacacgcgcaccaccaaccacgagcagctcgaatatctggccaccagtgtgacacgaaccaccaaggagccacatagtgacgaatttgacgactgacaccacgcacgccgggagagacgccacgcattcagccataatcgcccaataattttatgcagacaacgagtccgccggccacatagggctggcacagtaccggctattctttgctacgggcacattctggagggcatctcccaagaaaacccagacgagaggataccgaaccgcgattcatgtgcacctcgcagtggaacaataatgggacgcaacacatcatgttgggatatgacaatccacggagaacacgactctccgttaatcacccagagaggactcaacacaagacaaaagcaacacaatca

SEQ ID NO: 541075 - DNA, 1552 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacc

SEQ ID NO: 541076 - DNA, 84 bp, Homo sapiens
ccaaagcaatttgaaagcataatttttgtgccaagaataataactgggtgagaaataaaagcattaatttttcagtgtttccca

SEQ ID NO: 541077 - DNA, 899 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctgatcaagatggccttcgtgctgtggctgctctcaccctacaccaagggcgccagcctgctttaccgcaagtttgtccacccgtccctgtcccgccatgagaaggtaccccacggggaagcgggaacgggaggcttaggggtgggtatgagggaaagagccctggacctgggatttaggatgctggggacaccggggttctatcccagtcctgctgctattgaggggcaggaccttgacagggcccagcctacctcatcttctggg

SEQ ID NO: 541078 - DNA, 839 bp, Homo sapiens
atggcacatgcagcgcaagtaggtctacaagacgctacttcccctatcatagaagagcttatcacctttcatgatcacgccctcataatcatttccttatctgcattccgtaggcctgatatgccctttgccttaacactcacaaggaaaactaactaatactagacatctcagacgctcaggagatagaaaccggtctgaactatcctgcccgccgtcatcctagtcgctcatcgccctcccatcccgtaggcatccttttacatagcagatgaggtcaaatgaggccctcccttaccatcagttcatttggccaccaatggtgactgaaccctacgaggtacaccgactacggtcggacttaatcttgcgactcctacataattcccccattattcctagaaccagggcgatcggcgactccttgacgtctgactatcgagtagtactcccggattgaagacccgcatacgtataatagttacatcacaagacgtctgcactgcatgagctagtccgcacattaggcctaaaattcggatgcgattcccggacgtctaaatccaggaacaattgtcaccggctaacacgaacgggtggtatactaacggtcaatgcttctgagatctgtgggtgcataaccacagtttcattgcccatcgtcctaagaattcaattcggcctaagaaatcttgagagagagggcccgtatttaccctaatagaacccctgtgacccctttatgggcaaaaaaaaccaggatagaaaaagctgttgcggggcccgcccgcaaagttttaaccattttggggggggccagagattactgccgaagggca

SEQ ID NO: 541079 - DNA, 790 bp, Homo sapiens
  misc_feature (614)..(614): n is a, c, g, or t
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggcaaaaaaaaaaaagggttcccgaggctcaacntcacatcaacacaaacaataaaaccaaagaggcgccgcacacagcatgtactcgtgaggggaccacaatagccgcccaccctcttcttacacgaggcccaccaaagagcacattaaccacacagtcgcctaaaaccccctcacagagaaagatcgtactatgagaaccactttcgg

SEQ ID NO: 541080 - DNA, 253 bp, Homo sapiens
  misc_feature (3)..(3): n is a, c, g, or t
ganccagtgtcgattggggtccctcgctcattgggggtggaatacgaggttatcaactgagttgtgtagtgtagatcccagtagtagctgcatccagaatatgctcgtccgatcaaggtgtctgatctgtagtggaagatccgaaagtccgccatagtcacaaacagtattacaggatcagagcgcatcatgagagtagccctctggtcgtccttcgttcccttcatttcagatttctacttgtcgccaagca

SEQ ID NO: 541081 - DNA, 1902 bp, Homo sapiens
  misc_feature (1726)..(1726): n is a, c, g, or t
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggcaaaaaaaaaaaagggttcccgaggctcaacntcacatcaacacaaacaataaaaccaaagaggcgccgcacacagcatgtactcgtgaggggaccacaatagccgcccaccctcttcttacacgaggcccaccaaagagcacattaaccacacagtcgcctaaaaccccctcacagagaaagatcgtactatgagaaccactttcgg

SEQ ID NO: 541082 - DNA, 139 bp, Homo sapiens
ctattgttgaaggcagtgggtactcaggtgaattcctgttaataaatgaatcatatgctagcagaatagaacatgaatggtacaggtgtaccatctgacattgaacttggagatagtttttcgacgctgaagggtaacc

SEQ ID NO: 541083 - DNA, 364 bp, Homo sapiens
cgggggacctcccctgggagatcaatcccctgtcctcctgctctttgctccatgagaaagatccacctacgacctcaggtcctcagaccaccagcccaagaaacatcacaccaatttcaaatccggaccccactggaaatcggactgtccaactcacctggcagccactcccagagcccctggaactctggcccaaggctctctgagtccttccccgatcttcttggctcagcggctgaagattgatactgcccgatcacctcggaagccccctagaccatcacggacgccgagctttgggtaactctcacagtggaagaagacaggaatgtcaggccgctgagcccaagctaagccatcatat

SEQ ID NO: 541084 - DNA, 1677 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 541085 - DNA, 834 bp, Homo sapiens
accagggggggccccccacaacccctctcccccggggggaacacccccgcgctgtgtaagaaaagaacctgtccacacgcgcggggaaaaatatcccccccgcgagatagctctggaagcacaaacaccgcgggaaagacatacctgaggcacccctcctctcccacatacatagcccgcgcgcgccgaggtgatcatcagcaggggagaaatgcaacacgccactgtccgatacatgcgcgcttcgagagacagagagcagacggtgtctggagtagacatataccttcccaccccgcagcgcggagctccccccagcacggtcacagaattaagcagtacatccggcacacacgactacattgttggaaaggaagaaaacaccaaagagagagggtccccccacgacgcgcaggatcttctctccggcgtaattctcacacagaagtacagtgcctcggcgcacgctacacacacgccaccctatgcttggcaccggggccgcccacctcgcttcgcagcgcgcccacagaggggcacacccccacctggtgcggaaaggacaaaaaaatacggtggccacccaccttttccatcaacagaagaaatattggacacacacgcaaataatactcgccctcatcaaaatatctcttcccgtaacccccttctgtcttcattacagtacacacactgtgtcaagaatcaccctctgagataatcgtcaggcaagactcatccaccactaaattctgataatcgtcatacatacaaaggccgccctcttatctgacaccgccactaaaaacaatctctttccccccccacataaca

SEQ ID NO: 541086 - DNA, 446 bp, Homo sapiens
  misc_feature (48)..(48): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (85)..(85): n is a, c, g, or t
  misc_feature (100)..(100): n is a, c, g, or t
  misc_feature (110)..(110): n is a, c, g, or t
  misc_feature (122)..(122): n is a, c, g, or t
  misc_feature (130)..(131): n is a, c, g, or t
  misc_feature (147)..(147): n is a, c, g, or t
  misc_feature (164)..(164): n is a, c, g, or t
  misc_feature (166)..(166): n is a, c, g, or t
  misc_feature (187)..(187): n is a, c, g, or t
  misc_feature (193)..(193): n is a, c, g, or t
  misc_feature (201)..(201): n is a, c, g, or t
  misc_feature (216)..(216): n is a, c, g, or t
  misc_feature (258)..(258): n is a, c, g, or t
  misc_feature (268)..(268): n is a, c, g, or t
  misc_feature (306)..(306): n is a, c, g, or t
  misc_feature (343)..(343): n is a, c, g, or t
  misc_feature (347)..(347): n is a, c, g, or t
  misc_feature (362)..(362): n is a, c, g, or t
  misc_feature (386)..(386): n is a, c, g, or t
  misc_feature (433)..(433): n is a, c, g, or t
ctagctgctgagcctcgggctggaccacgctgctaaggcctagggtgnccggcgcctccancgcnanatctgccgcctctacgantacacaaagccaaanactaactgtngggtgtgcctgngactgctnncccatcgcacaaagcntcccccagctgctgggncntgccctggccatcagcctttnccagtngcgatgancatgagcaagctgtngccctcaatcaaacccaggacttcctgaacacaacctcaggnaggcctatgnaggttctaggcacaaccagctcaacctatctggctaanacagctagctaggtcgatctaacatgacgagggaggnagcnagcgggccagcaccnccgggcctggccaggagcccaggntggcaagaacggatagctgtgtggcgccatgagagcgagctctgctntcagtcgctagct

SEQ ID NO: 541087 - DNA, 1883 bp, Homo sapiens
  misc_feature (1707)..(1707): n is a, c, g, or t
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggcaaaaaaaaaaaagggttcccgaggctcaacntcacatcaacacaaacaataaaaccaaagaggcgccgcacacagcatgtactcgtgaggggaccacaatagccgcccaccctcttcttacacgaggcccaccaaagagcacattaaccacacagtcgcctaaaaccccctcacagagaaagatcgtactatgagaaccactttcgg

SEQ ID NO: 541088 - DNA, 1657 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgtaccaaagcaggctgggcccagggttctatttattgccttgctctgccctctcccttccccggttgtgggacaagagccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 541089 - DNA, 1522 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccagcctgctttaccgcaagtttgtccacccgtccctgtcccgccatgagaaggagatcgacgcgtacatcgtgcaggccaaggagcgcagctaccgagaccgtgctcagcttcgggaagcggggcctcaacattgccgcctccgctgctgtgcaggctgccaccaagagtcagggggcgctggccggcaggctgcggagcttctccatgcaggacctgcgctccatctctgacgcacctgcccctgcctaccatgaccccctctacctggaggaccaggtgtcccaccggaggccacccattgggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 541090 - DNA, 881 bp, Homo sapiens
atcacgagggccggctatactgtagagctacggacgcgagcgacaataaccgggatcggggagatgcctactatgatccacagactatcggcattcctatgaatatcagcgggagaacagcagttaccgcagccagcgcagcagccggaggaagcacagacggtcggaggaggcgcagaacgtgacattatacgccgactcatcttacgatgaaatcgttagcaccttaggagaggggaccttcggccgagttgtacaatgtgttgaccatcgcaggggatgcgcgggctcgagttagccctgaagatcattaaagaatgtggagaagtacaaggaatcatgctcgactatgagatcaagcgtgctagagaaatatcaatgagaatagaccctgacaagcaagaagcctctggtgtccagatgtttgactggtttgactaccatggccacatgtgtatcatccttattgagcttacctgggccttagcagccttaccgagtttcctcaaaagaccaagcaagcctacacctgaccgcatactcgccagtccaccaagatgcgccactagtggccttccagctgtgccaggctgtcaaggttcctccagtgataacaagctgacacataccagacctcaatggctgaaaagtattctgttatgtgaattgcacgactatgagctcacctacaacctagagaagaagcgagatgagcgcagtgtgaagagcaacaggtgtgcgggtggtagacttgggcagtgcccacttggaccatgagcagccatagcacccattgtctccgactcggcgattaccgagcaccagaagtcatccttggagttgggctgctcacaggctttgggcatgaggtggagtataag

SEQ ID NO: 541091 - DNA, 161 bp, Homo sapiens
agtaagctttttagggccctttgccaataggtagtcattcaatctggtattgatcttttcacaaataacagaactgagaaacttttatatatacctgatgatcacataaaacagatttgcataggatggccatgatgccgttatgttaatatttaacttgt

SEQ ID NO: 541092 - DNA, 313 bp, Homo sapiens
cggaacttcgggacccgcggtgttggtaccgggaatccagcgcgtcgacataccaagtattatagtggtatatctcagaagtggccccagtgtaattatgggtatctgtcatggatcacaatattatcatagtaagtcttgtgatacaaagtctgttccacttcccaagtaagcctacatatatctccaagtaggagtatgtccttcagggaacaaagaaaacggatcttcttttgagctgtaagagcacaccagtcaagaatgtatcggcaaaatttagtaatactgttcatactgaacttgaatcttacga

SEQ ID NO: 541093 - DNA, 1085 bp, Homo sapiens
gcaagccggagccctggggttgggcagcactcggttccgtgcaactttcaagtgagttgcgaactccgccctgtaggccggtgctggtggcccggcgcgctggaaccgcggcgacccgctccagcgcgggaccagcagcaagggccgagcgccaggttctccgcggcagaaagggcgggtgggagctgtaactgccccggccgcggggcgcgcccgctcccaagtcggcttcctccccgccggggccgctttgcctcgggtctccccattctccaggtcccctgaactgcacagtcggaggccgtgggcggcgggctctgcctccgccgagggacagccggatcgcccctctgcttcccgcaactgccctgatcaccccccgtcccagcccttgagtgaacgtccttctgagcggcttcctggggtcctccccacgtcccaaaggccggcaagatggtgtcctggatgatctgtcgcctggtggtgctggtgtttgggatgctgtgtccagcttatgcttcctataaggctgtgaagaccaagaacattcgtgaatatgtgcggtggatgatgtactggattgtttttgcactcttcatggcagcagagatcgttacagacatttttatctcctggttccctttctactatgagatcaagatggccttcgtgctgtggctgctctcaccctacaccaagggcgccaggcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggca

SEQ ID NO: 541094 - DNA, 1407 bp, Homo sapiens
  misc_feature (1229)..(1229): n is a, c, g, or t
caaaaaaaaaaaaaaaaaaaagtaaaaattccctttggatgctcaagtttttttttatttccttacttttaaacaattttttttttctttaatttataagaaattggtgtctccgtgggccattgggtggctcacgcccgtgttaatctcagcacttggggaaggctgaggcgggaaggatgtgctggaaggccaaaagtttggacttagccccggcccaaccattaacaagaacccgtgttcttcttatttctctttttaaaattatttaaaattaggcgtgggtgccaggtgattctcagtgcccgtgttaatctcccagccactttgtgggaaggcccacggggggcaaagacactccactctgtgagaggtctcgaggagagtttgtgaagacaccagagcgcgtggcttaacacgtgtggtgtgaaacaccccgtgttctctctttacttaaaaaaatataccaaaaagtttaaccataaggccgtgtgggtggccatatacaccctgtgccatatccccccagctttaacctccgaggagaggctctgaagcgcccgagggaagaatataagctctggtgcacatctgtgggtgtgtggccggagaaggtttgtgacgagtgtgaaatccccagagaatcctccaccccaatgtggccacgtggacaacgccctggggggccacacaacaagaatgtgcgcaggaactctccgggtgcttcccaaagaacacaaacacacacacacacaacacagacacacaccaacaccacaacaaccaacaagaggagggcgcgcggcgcgcgcgctcccaccaaaaaaagaataaccaccaccaccagagaggggcggccccccaacaccgacaacaacgcgcagtggtagcaccccccaggaccttgacagtcatgtcgtacccacaccgacggggggggccccccccaacaaaaatgagaagcgaagccactcaccacatttaaaacaaaaggtccaagcacaccacacgaggccgccgtcgcggcttataccaccaaccacgctgctcgtcgcagcatcagtgcgatacacaacaacggcgacaaccacgtggggaagaacacaccactagatagaacgaaagacacagcccccccataccaacctgacgaggggaggagcacgcacaacacaaagtggcgcgagccaaacaccaccctcctctcgacgacagacgaactgatacancagccctccagaggggagaacacatatcacccaccgctgtcaacgaggcgagcgaaactaaacgcgggggaatctaacaccacacacgcgacgacatcatgtcattcagtgatgcaggaagaagaaaaaatgtgtcgccaccgcacaggaactataagcacgagaacaaaatattaag

SEQ ID NO: 541095 - DNA, 714 bp, Homo sapiens
ggatattggctgtcttgagtaggacttatgagtaggtgggccatcgactcctatgatgatcgaggatgagggataagaattaagcatgctgcctggatgcctattcactatgtttatgtgctatatcctttctgtaataaatcagtttccttgtcacggtttctgttccctctgagtgcttgatgcttctgctgccttccccttcatgctgtctgctgctctgtttgctgttcatgtcccttatcccttccatcgttgaaggtgagactttcattatggggttcttgccaggcccatgttgtagcataaccccagggaatctttttaattgaagtcctagggtttactctagtatagggaggttatgatggtacctatctatctcaggcacatatctgtgtgataggatagtgttcttctagtctcctttgttcaaggttaggtagtattaaatccagttggtttctgtctttgaaagttagactgctaccctgttcttcctgctgcctctacatttaccaactctggaagcaaggcttggcccaggctcctctgtgcattaggagggtttgggagtggggctgggctggcccagagttcctgggcatggagccacgtcataagcttgggggatgggagggtacacaggcgatctcctagagtgtgtgtgccactgcacctctgagcagtactgcctaggtcctgtctgctgct

SEQ ID NO: 541096 - DNA, 695 bp, Homo sapiens
ggaggccgcgcgcacagagcgagctcttgcagtctccccgctccccacaatgaaatcaagttattttctcattcccaaataataacatcaactactatgcctaaaaaggaataatactatcagatgataccattaatagctactctcataaccctcaaaaaaccaatccactcttagaccaagtattgtgcctagttgccatactagtctttgccgcctgcgaagcagcggtgggcctagcacctacttagtctcaatctccaaggacagtatggccctagaactacgttagcataaccgtaggagcctactccaattgctaaaactaatcagttggccgagagcgaattatagttactaccgagtgacatgacttgtgccagatagaaacagagtaatttggaattcagtcacaaacaccgcagagcctaattattacgcatcatcccccttactattcttttgtaaccaaaattcaacaacacacctatttagcctgttgccacaagcctttttcactccgaaccccacttaagaaagcgcgccttccgtgattagctaagctaccctgggcgttcctaaccccgtcgaaggaattcaatgtggaggaccaaggtcaactttcattccaggtggaaaccactattcaaggagacaagaaattataagccgtcctgctaatacgaattctagct

SEQ ID NO: 541097 - DNA, 350 bp, Homo sapiens
actacatacttccggacttttcctcatttacctacttccatatttccataaaccaaaataaatttgtttgggggttttaaaattttttcttcgcataacgggaatcatcttgcaactggattctttcactccatgatatgccttaaatttctttccttcccagacctgaaagggtcaccccatccatttaaactcctgcataatccatagtatggatccatcatggttaattaaataatccccccatggatgaatgttaaaataatgctaagttttcttgttacatgcattgctgcaatgaaatccctgtacatgcttctttgtgaacatgtgcaagtattcctgtagca

SEQ ID NO: 541098 - DNA, 1808 bp, Homo sapiens
  misc_feature (380)..(380): n is a, c, g, or t
  misc_feature (384)..(384): n is a, c, g, or t
  misc_feature (562)..(562): n is a, c, g, or t
ggacgttgcatttccttctatgtaggcagaaatggtatcagaatgtacgccgatctccattgctcccagaagtgcgtcgctctctagtagcaagtcaccttcatttacgcatttggttcattctgtagtcggtaagatgtcgtgcagcgtaattctgagcccaagaacatacactctgtgaaaactctgtggacgtggagggtggattgcatgcactgtgcggatacaggggccttcccctgtacaataaggtcagtggggcacatggggagatcttattgaggatttgagacaactcgaatataggccatggcatggcggttagaagaacagttgagcttcatttctatctcaatttagagaatgagcttgctcacgtnttgnattgggcatatactctatggcaagaagcacgaggccaagaacgattaccatgattcgattgggaggtcttatttcaattcatagcaattgtctcttcccagtggggtatcgaccatgcaaggaaaacatatctgtagttcgtagagagagatcctaataggtagtatgaaacgacgcngttaaacaatttcgatgcaacgaggctttggtaggggtgggttggtcctcggtttccccctcggtaatacagatcgtgtgtttgtctttgcgttcgctaatgtgtttcgacatattcgtgccaccgcactcgcgaatcaatttcttttacacaaatgtacatatggtgggagggcagtgttattacacgcatgtaatgtacacctcgtggccgaaatgttgggacactatgagtcgagtcgcggcttgggaagagagggatggttcggaaatttacgaaaaaacagttaattatttattgttttcggggggcacgaattttatagccctaccaccaccattggtggtatctcgtcgccaaaaccttggtaatgtcctccaatctcaccacattattctatggcgccccacggcaacaatgtattgaaataaattggcactgcgggtcacaccaggtatagggatgtgtcacccccgaggcacaaagggctttcaaagtggggagaccattatgacgcgcactttctcaacacctgtggcgtccacatacattaacaggggggggtgggatacaatatggcgcacaagcaagaaaacggattgtgatttattaggggacgagtttagaagggttggggcggagaaaaagtttgaaacagtgggagagcaaaaagagatagagatttgaggggctgtaatctgaaagaccaacacatatgttcgttgggagaagaaggtctctagagggcgagtgggcctcacaacttataatttgtggaacattgctgtgtgggttttggaacaatttgtgtggaaacttatgggcgacacatacacaaggttccacaagtcgggccgagacagaacaccgctgtggaccatggaggggaagagaagtcgccctacacgagtagaagaggagggccccaaagaggcgcttttcgccaccaataggccagagggaaaagattctcgtacgcaagagcagcggccgagaaaacaattaaaacccacacgcgggagaattttgcggacaacacaccacaatatcggagaacaggagatgtgttcgacccccaagaacaacgacgccgcggagggacccagctcattcacaagagggggaggcatcatattgaccaagcactctacgggagagagagcgacaatatggcgcgaagagacaggcggaagcaactcactatatgaggacgctcactttgtgcgatgtcaacaactcggacgca

SEQ ID NO: 541099 - DNA, 311 bp, Homo sapiens
gcacattatgctagtaaaataagccaggtacaaaatataaatactctatgattccactcacataaagtatctaaagtagtcaaaatcatagaaagtagaaaggtggttgccaagagctggtggaagagagagaggaaattaacgctcaatgggtatagagtttcagttttgcaagatgaaaaagttctagagatctgctatacaacaacatgaatatatttaacactattgaactatatgcttaaaaattgttaggatgataaatgtaatgtttttttcaactacaacaaataaatagggcaaaataatta

SEQ ID NO: 541100 - DNA, 365 bp, Homo sapiens
  misc_feature (38)..(38): n is a, c, g, or t
  misc_feature (100)..(100): n is a, c, g, or t
  misc_feature (185)..(185): n is a, c, g, or t
tttgttttcaggtggggcccccccgttttgtttccctngaatccaagtcaggaaaaccggggggttcctgccctccccccccccctcaagaccatccccngggttgccgggttgccccctgccattttgcaatcagccctgggggcctgtgaagcctggcccccctgcctgccgggggttcttgnagcccccccctattccagggtccccatttccctgaagcttccaggggagcagctggggggaccctgatttgtgagctttggaaagtttgcttaaaattttgaaaggcaggaactgctctgtttttgtaactactcaaggccccctgtcccatgaaggaatgaataaaaagttttttctga

SEQ ID NO: 541101 - DNA, 264 bp, Homo sapiens
aaaaaaaaaaaaagtgggtttcacaagtgtcagggtggagtgattcccagtgggatggttgtggccttagtttaagctgaataaataatttccatttggggcagttattttgctttttgtaaaaccgtggcccattgtctcctgtaatgactgttggttcaggcatgttgtactttgtaggggccaatgtgcctttgtttgtggccaaagcctcccattgaccaacttgttaatttttttgtatattaactagctgtaacctta

SEQ ID NO: 541102 - DNA, 735 bp, Homo sapiens
cttagggaacaagcattaaactgacactcgattctgtagccggctctgccaagagacagtggcgtcggggtgatatgagggcaggggtcatggaacgaaagccttctggttttagacccacaggaagatctgtgactgcgctcttcggtcagagcacacgttgctgggcgtgcgcttgaaaagagcctaagaagagggggctgtctggaatggaaccgcaacgccataggtgagggctgtccatgccttcccgcttcaacacctggagcacattctggaaagtttcctagagaaagccagaaacaatacttttatagataaatccagaggccagacgggctaatggggctttactgcgactatctggcttaatcctccatacaaccttgccataccagcccatcagtcctctgagacaggcaagcccaagaaagtcaggggcctatgtgagccaaagaggagagaaggtgatgcctcagcccagtgttctctgcacccgacctcgcttgtggccttcggaacttgatttgcaccgcaggaaaatgggcaatgaaaagccctccctaactggcttctcagttccactctgaccatgcccactgcacagcagccaccctgcagctcccagatgaggcctcactctgtcaacccaggttggggtggagtggcacagtcaacaagtcactataaacctcaagctcctggggctcaagtgatcctgccacctcagctcct

SEQ ID NO: 541103 - DNA, 198 bp, Homo sapiens
  misc_feature (118)..(118): n is a, c, g, or t
tactatctcgctggcgcccgctgatggcggcgccgctatgcactcctcggcctcttcctacttccggcgtctacgtcgccggctccgttcccacccggtccctctcgaccctactcgntacgatgcgccacttcacgcgctgactactcgctcgcgcgcagatctgtcctgctgctccttgcacatggctccctctct

SEQ ID NO: 541104 - DNA, 993 bp, Homo sapiens
tgagcgtggactattctactatacctcacaaagaccttggaacactatacctattattcggggcatgagcggtacgcctcctagggacatgcgtctaatcctcctttattcgggccgagctgggccagcctggcgaccgtctagagtagcgaccacagtctatcatatcgtgatcgtcacatgcccatgtcggttgtgttgtcaatcttcttcatagttaatcacccagtcattatcggggagtgcttatggtaactgtaactagtttcccctatagtaattcggtgctccccgcataaatgtgcgtatcgcctcgcataatatcgaagcagtaagcgttctgcatcgtcttatctcccatcgtactcctattctctgactcggcatctgttgataagtggaggccggagcaggaacaggttgaacagtctaccctcccttagcagggaactactcccaccctggagcctccgtagacctaaccatcttctccttacacctagcaggtgtctcctctatcttaggggccatcaatttcatcacaaacaattatcaatataaaaccccctgccataacccaataccaaacgcccctcttcgtctgatccgtcctaatcacagcagtcctacttctcctatctctcccagtcctagctgctggcatcaccatactactaacagaccgcaactcaacaccacttcttcgacccgcgaggaggagacccattctataccaacactattctgatttttcggtccccttgagtttattcttatctaccaggcttcggaataatctcccatatttgtgacttactatctcggaaaaaagaaccttgggtctacggtggctggcataatcaagggtccaaggatcgggagcccaatttagggtaacgtgacccggttttccgcgcaaatctccccggaatttggcccccgacaaaaatggggccacaatttcgcggggcggacacacacaacactccacag

SEQ ID NO: 541105 - DNA, 167 bp, Homo sapiens
tctgacggatcccggcagctatccggttcaatgagttgttgaaagtctgctgggtgcagtaagtacagaatacagaacatcaatgtttaatagttaatacggtaggcacagagacccagtcagtctacctgggttgctttactggacggctgatgaactaggtacta

SEQ ID NO: 541106 - DNA, 117 bp, Homo sapiens
aattagacatgcatcctaaaagtcacttatgtcattatgtattagttctatagcagctaattgaggtgtattcacatatgcacaagtcacctttacagtgtacaagtggtaaactaa

SEQ ID NO: 541107 - DNA, 675 bp, Homo sapiens
ggggaaggatggcaatgccaggggaactacgctgcttgaggttctggactgcatcttaccaccaactggtccaactgacaggcccttgcgcctgcctttccaggatgtttacaaaatggggggaattggaactgttcctgttggccgagtggagactggggttttaaaacccggtatgggggtaacctttgttccagtcaacgttacaacggaggtaaaatctgtcgaaatgcaccatgaagctttgagtgaagcttttcctggggacaatggggccttaaatgtcaagaatgtgtttgtcaaggatgttcgtcgtggcaacgttgttgttgacagcaaaaatgacccaccaatggaagcagttggcttaactgttaaggggattatcctgaaccatccaggccaaataggcgccggttatgcccctgtatggaattgccacacggttaacatggcttgcaggtttgttgagctgaaggaaaggattgatcgccgttttgttagttgaaagatggccctaatattttgaagcctgttgaggttgccattgttgaaatggttcttgtcaggcccatgtgtgttgggggtttttaagattatcaaccttggggtcgttttgttgttcgcggattgagcacggaaggttccgctgggtgttatcggcatggtccaggt

SEQ ID NO: 541108 - DNA, 429 bp, Homo sapiens
cggagtttctccatgttggccagactggtctcgaactcctgacctcaggtgatctgaccgccttggcctccgaaagtgctgagattacagttgcgagccactgtgcgtggccagaactttttaataagagacttgaagctgggtgtgacggtgcacgcctctagtcccagctactcgggaggccaagacggaaggatcaccttgaggccaggagtttaaggccagcctgggcaacatagcaaaacctagtccctagaattaaaaaaaaaaaaaaaaaaaaaggaaaataaaggagacttgaaatttttgaactaaatagtggtgatggctacacattgtgaatgtaattaacaccactgagttaaacacttaaaatggttaaaatggcaaattgtatgttatacctattttactacaataaaaagtata

SEQ ID NO: 541109 - DNA, 353 bp, Homo sapiens
tggaatgtttatggtggttcagaagaatgatgactcctctttgctgagaactgttcatccttcttcaagaagaagcttgccaggccgggcacggtggctcacgcctataatcccagcactttgggaggccgaggcaggcggatcacaaggtcaggaattcgagaccagcctgaccaacatggtgaaaccccatctctactaaaaatacaacaattagccaggcatggtggtgcatgcctgtaatcccagctactcagaggctgaggcaggagaattgcttgaacctgggaggcagagggtgcagtgagccgagatcgtgccattgcactccagcctgggcgacattctgtctc

SEQ ID NO: 541110 - DNA, 137 bp, Homo sapiens
ttgcatggacggcgcaaaagtgcacgcaccctgctatatgcttacgtacacaaacaataacaagctttgtacaaaacaataacataataagacgaatcgactcactgcatatcaataaacaacacgcgtcggacgcg

SEQ ID NO: 541111 - DNA, 143 bp, Homo sapiens
tgggtgattacaggatctatcctaacaggtgtggcttaactggtgtggatggtatgcattgagggtcgagagaggactgacagtggtctaacttaaatggtaataactcactgaattaaattgtgagtgattttgcagctgaa

SEQ ID NO: 541112 - DNA, 160 bp, Homo sapiens
gatagggagatccacgaaacttacttcttgacagactgtcaactgacgcaatccaaatcgtatggtattgtatcttagttccaggaagtccccatacgataaaacaggaagacttcttctctgctcctccatttgtttctatgtcctcttcatcatcgaa

SEQ ID NO: 541113 - DNA, 443 bp, Homo sapiens
tggatgaattccccctaaaaaaaaaaaggtgttgatttgttgttgccccccccttattaattcattaaatttctgggtttgggttgtgcccccgggtgcctttacttaaaagattccctaaagccgcccattgccctggggaccctggcccccaaaaacttttttttttatatcaagggtgttccggctttccctttttttttttagccgtaaaaacctgttggggtgtgtaaatggggcctttccctattggaaagggccttttggccctctgcatttataaatgtgtggggccccccgtttgtgtctttttccggggtggtcccccagagcccacccccccttttgaaatgggcttttacaaaacaagaaagaaacctcctttactgtgtgaagaaatggaacccgctttttataaaattgccaccctttttttcccccca

SEQ ID NO: 541114 - DNA, 144 bp, Homo sapiens
gacacacaatctctagacgccctcggcttactgatcttccttctctccttaatgacattaacactattctcaccagacctcataggcgacccagacaattataccctagccaaccccttaaacacccctccccagatcaagccc

SEQ ID NO: 541115 - DNA, 150 bp, Homo sapiens
ttagaggatcctggacgcaatggggaacggatccacgggctcctggaggctggccggccagcttggtatctgaaggcaacatccacgcggacaagatccgggaaaaggcagattccatggagaggaggcacaagaagaatcaagacgcag

SEQ ID NO: 541116 - DNA, 1223 bp, Homo sapiens
ttgcgcttcccaagtgaggcaatgcctcgccctgcttgggctcgcgcatggtgcgctcacccactgacctgcacccactgtctggcactccctagtgagatgaacccggtacctcagatggaaatgctgaaatcacccgtcttcttcgttgctcacgctgggagctgtagacaggagctgttcatattcggccatcttggctcctccccgcacaatagatggagtctcactagattgcccatgctgattttgaactcctggactccagtgatcctcctgccttggcttcccaaagtgcttggattggagacatgaaccactgcacctggactttcagacctttaaatgtattatactctcagttaatcttttgtagataggacgagggagagccccagagaaagcctggcagcatcaatgaacgatttcgtacaaatgcaaatctcccctccaaagacagctttgcagggctacctctgtttgcagacttgctgaacagccacctcaaaatatgtcacggaagtatatttggggatgaaatactttgatttccctcactcttcaatgcaacatcggactttcctatccagagcaattaggccaaaaaacaaacaaaaaaggtacttaactcacaaagaagtacacattggctcctaattttgccgatgacatgatcttacgtatagaaaaccctaaaagacttcgtaaaaattttccgtgggaacctaataaacataattccggtaaagctttcagcaatacaaccatttagcattaccatacttttcacctttgccgaccacccattaaccatggactatgcactgtgcacattgcgggacacacattcccctttacactaggcacgcaaagtaatttaatacctagaaatatagcgttcactacaggagagacaaactccggcgttttaccccaaatcctcacaagtccctttgttgggtaccgcacttttcacacagcaagcccagccacacgtggtgaaaacggccctccgtggggtgctcacgtgctggttgaccacgctcatcattgtgttcgcacccgtgtgccaaatctgttatcgccaacccgcctgcgttcacttgcgggccctcatcgaaatcattgtccggtttattttcctacatactgacacaaccaacatacattctgtccccccaacagcacaatcacccccttgtcgggcgacacaatgccatccc

SEQ ID NO: 541117 - DNA, 446 bp, Homo sapiens
gggtttatcgatgcatcaaaggctcaactctacggggaagggaatgatgcccaagatctggttgcctctcagacccgaacttcgtcttgagtctccagacgctgcttgcgtggaaatctccacctgacgagtcatgcgtggtacctcaaaccttcatgcgagcactttattaccctaaggcaggcatacctatacattataactataatgtatagttattattggtatactgtctcattagactgcaagttctatgaaggcagtgactttattatttatacctatggtcaagcagtgccctgctcctaataggtggttaataatttattgtttgttttgggatacggagtctggctcggtcacccagatgggagagcagaggcatgatctcagctcacggcaacctcggcctccggggttcaagggattctggtgcctcagagacc

SEQ ID NO: 541118 - DNA, 136 bp, Homo sapiens
ctctgaggactcccctcctcccccaatatatttcttctcctccgtcggcttcagtgcctgaccacggcttcgtgcctgatcaggcttcagtgcctgcccaggcttcagatgcctgaccaggcttcagtgcctgacc

SEQ ID NO: 541119 - DNA, 531 bp, Homo sapiens
tcgacctgcctgtagtcccagctacttaggaagctgaggcaggaggatgccaccatgcctggctgattgttattttttgtagagatggggtctcactgtgttgcccaggctggtctcaaattcccaggctcaagcgatcctcctgcctcagctcccaaggtgctgggattatgggcatgcaccaccgtgcccagttcagactgagttttcggagccaaatgtgaccagaaactcaagacatctgctccacagtcatcaagggacaaagcaggagctttgacggaagtaccaagtatccagacccagccgaggctaccccacaagccagtgccccaccaaggagccacagcttctcctggacccacgctggccttcagctgctgccacgagcccccgggccctacactgttgtggcgtccccacctcagtgccttggaacccaggcctgggctcctagcctgtgggcactaggcaggccctgaccattttcttcttttctttcttttttatttagagacagggaaaaaaaaa

SEQ ID NO: 541120 - DNA, 1599 bp, Homo sapiens
  misc_feature (1599)..(1599): n is a, c, g, or t
gcctacagaaaaaggaaaaaaggccacaaaagttcccatctccactttcagctaaacaataaataaacacagctagcagccaacacaacataacaatgaaataacaagaaaccacaatgcaacataaatattgtagttgtgcagccattaacaacaaaatcaacaatcaacaacattccaactgctgagccacaacaacagagacaacaagaagaaacaaaaacagagaaaacacacaacaacaaacaagacaaaaacaacacacaacaaagaacaacaacaaacacaacaacaaacgaacacaacaacgaacagaacaaacaaacacaacaaacgaaagagaaaccaacacaaagaagaagacgacaacaacgagaagagcacagaagagagagaccaagagagagagccggagggcgggcacggaggagagagagagagagaggacgaagggaggcggggagggaggcaggcgggggggaaacaaagcccgactcaccgaaggaagcgtgcagggtgacgagagggaggcaggggggtgcccgcagacgcgcggcgaaaaagagacagaagagaggagaggcaatcaaaggacggcagagcggagagagagggaggggcaaacagacatgaagcagagatgagagagagcgaggcgaagagcagagacaggtacagggaggaaccacgacaaggagtagaaagggatagcagacagccggacgaaaagaagaaagagacaagagagaaaagagaagagaatagaggacagaagacatggcaggaaggaaaagggaaagaagaggagcgaagggaccggacggcagaagagacagagtaacaggcaagaatgaggcgcgaggcagaggaagaaggaagagaagaagacagacgaagagaagaggcgagaaggcagggacaggaaggcggaggagacgagagcgacgcgggcgactgagaaggggggagagaacaagtcgacgagagggaggaaggaagggagagagcgaggaggtgtggagagctgcgaggacgcagagggcgtggaggagaggaaaagagcgcaaggtggcgtagaagaagggaaggagcgagagtccggagcacgatagacgaggcagaagagtgagggaaggggaaaggaagaggcgggatggaggagatatagccagacgtggaaagcagcgagggagatagcaggaagaaggcaaggggagcaaagaatagatagtcaaagtatgaacaaagcgatgagaaggaggtgacaacgaaactagaggactcacaacaacggaccgatagacaacaactaggacaagagagtggagcagagacaatgcatgagcagagacgaagatcagcgtgaaacgaagagggacgtagggaagagtacgaaacggttcgaagagagagagaaggacgaaggaagagacaggaagtaagagaacagagaagaggcagagaagaggaggagaacgaggagcgaaggagcgggaagaccggacagagcgaggagagagcagctaggagagaatgtacacagcgcatgggatagactagcagcaactaggagagagatgcctatgagcgtagagtaan

SEQ ID NO: 541121 - DNA, 416 bp, Homo sapiens
tatcagtcagagaaaaactgcagtgggacttgaagccctgatgtgctgttcggtcagacttttttttttcctgaattttaaagacagagtttctctattgtaggaaaacatatcttagttattttttattttaaatacattcctctggaggaagaacaaaaagcaaagcaaagaaaaacaaaacatagctttttctatgttgttttatacttaatatctaaagctcttcatgaaagcaagaaattttgaccttaagactattcctgaatatatgtattcttgaatataatatcatatatattacacatatctgttatgaaagcccaaataaactgcacatctatatctattcatactgccacttgaatgaaagcacattcaaggtaaaatgtttctttgaataaaaaagcttggca

SEQ ID NO: 541122 - DNA, 1124 bp, Homo sapiens
gcctgtgaacgaggtgccttccaccgtgattgttaagtttcctgatggccttcccagccatgtggaactgtgagtctgaaaattaaacctcttttataattaaacaaagaaagaagatgacaggcacatcaaaagaaacgtcggacggtgtcactaattgtacgggcgtcggtaaaagacggtgaggacacattcggcccatgtggacttatccggtgttccgtgtaaccagacgtttggctggtggatacaccggtgggtaacaattgagcggtcctccccgtactaaaggatgtcgtgtataattgttgcaatagagcgccgtgggtataaaccgtgtgatttagaaggatgttctgggaaacaatacgaacaagaggcggccacaatcttcaaagcagacgcaggcaacgagaggaggaaaagcctcattaccatcagatcaagggtccacctgccagagaacgggaaggacaccgagacaccacaaaaaagtaagagacatccccagggagccaacaaaacagaggtgtagaagctatgacacagacaccgggacattaggtgagcaaagaaggattcctagaacgtcgggagcacgagagaacacaaagggaatacattcatagcaaaggtcatctcttataattgttacaagagataagaatatgagaacagggaaccaagaagaagcaacaatattgacagaataccaagggacagataaacaacgccaaaaacacacagaaagacacaaaacacagggaacaggcgacacaacaatataagacagcgaacggggagcagggaagccaagaggacgaagagctacgaagactacactccccacttgacgccagtcacgagaagttggaaggactaagtgcaattagaacgactagagaaacaccgagcaccgaagaagaaacaccccaaccatgaagaaaacagaagcgaaaagggagcaccctgatcaagacgcgacggacgaggacggcacatacaggggacgaccgcaagaaggaagagcgacccaggagtaaccaggagacgaacataagagcgaagcataggggaaagaaacaaaggtgcgagaaagaaagcacaaaagacagaagcacgag

SEQ ID NO: 541123 - DNA, 199 bp, Homo sapiens
ccgctctgtgagatgcgaccagatctgcctcttctttgaggtgtactagagtgagatcttccacgtctaactaagcttctactgcgggatcttcctcgtcttggtgtcctagaccgaggactccctctggtggatggtgtgctggaccgtgagcgaccactgcatctaactggggtactagagcgtgagcggccacgtc

SEQ ID NO: 541124 - DNA, 235 bp, Homo sapiens
ctttacaagcatcctgcagcttgttagctccagcatacgcaaatgatgtgcttgactcactgggtattagtcctgacctgctatcctgaggactttgtcaggtacctgcttctccgatagatggccccagatgtgtgccggtgtgttggacgggacttattggcacatggaatattgtgaatggcccgtgtctcaagcgggacccttccttcacaagctaacttcgttcgttcat

SEQ ID NO: 541125 - DNA, 303 bp, Homo sapiens
gggagggggggccggaaaggagcattaatggagcaaaatggcggatcatgtgcagagcctggcccaactaaagaatttgtgccaacagctgtatgaaaccccagaccctcatcaattagggtttatttttttttttttcctctacccccagaaacaagcctgttaattttttttccttttcctctggcgactgtgtgatgaatcctttcttgggtgatcaggttgcggataaacttgtaagggtgttttctgcatacagtgtaagcattgtggccgccaataaacttcaatggttttttctta

SEQ ID NO: 541126 - DNA, 496 bp, Homo sapiens
cggtgttcctttgtcttagacttgtgttcacttgacctagaactcttctgcttacacagattaagtaagattcagtcagactggtgcggtggctcatgtaatccctgcactttgggaggctgcggcgggtggctcacctgaggtcaggagttcgagaccagcctggccaacatggtgaaaccgtgtctctaataaaaatacaaaaaaattagccgggcatggtgacccatgcctgtaatcccagttactcaggaggctgaggcaagagaatcacttgaacccaggagaagtgaggttgcagtgagccgagaccgcaccattgcacttcagcctgggcaacaagaaccaaactccgtctcaaaaacacacaacattcggggcagccatctccttccacaccccatggggagaggaatagggcttggtcagtctgctgctatcactgtcacacaccagcgtggtgcaggctgctgctgatggctgtccagtactgaag

SEQ ID NO: 541127 - DNA, 112 bp, Homo sapiens
accagatgcaagggtcacacgaacagtcctcagtcatttgagcatattgctcgatctggcaaaagatcacgccatatccctttcttgagcctcgtatgcccgtgggggtcag

SEQ ID NO: 541128 - DNA, 882 bp, Homo sapiens
  misc_feature (59)..(59): n is a, c, g, or t
  misc_feature (519)..(519): n is a, c, g, or t
  misc_feature (590)..(590): n is a, c, g, or t
  misc_feature (821)..(821): n is a, c, g, or t
  misc_feature (855)..(855): n is a, c, g, or t
ggattagaaggcagcaaaaaaagctctgtgtctggctggagccccctcagtgtgcaggnttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcaggcggctgtctccaaattcggctatgacctgtaccgggtgcgatccagcatgagccccacgaccaacgtgctcctgtctcctctcagatgtggccacggccctctcggccctctcgctgggagcggagcagcgaacagaatccatcattcaccgggctctctcaatatgacttgatcagcagcccagacatccatggtacctataaggagctccttgacacggtcactgacccccagaagaacntcaagagtgcctcccggatcgtctttgagaagaagctgcgcataaaatccagctttgtggcacctctgganaaagtcatatgggaccaggcccagagtcctgacgggcaaccctcgctttggacctgcaagagatcaacacactgggtgcaggcgcagatgaaagggaagctcgcaggtccacaaaggaaattccgatgagatcagcattctccttctcggtgtggcgcacttcaaggggcagtgggtacaaagtttgactccgaaagacttcctcgaggatttctacttggatgaagagangaccgtgagggtccccatgatgtcgggacctaangctgttttacgctatggcttggattca

SEQ ID NO: 541129 - DNA, 398 bp, Homo sapiens
ttataggctctcgctgtatgttatctcacggactatacagagtttgactttacaaattatgcacgcccctatgtgggattttttaaaaagcaaactggtgtgtcttctcatgtggtctgcacagcccagcctcacagcactattgtaaaccctgctctttctgtctcgctagacagattttaaagtatgtatactttatactggttgttttttgtcgttgttgttgttgtatacagctgaaaccaaccagcacgcccttgatgaccaagaggcgtttctttcaaagctatagggcaccaaacaattgaccatagatgactccgtttgccttcttctgcagacttatttccttcagggacagattttccaacctaagaaactacctaccgtgtgtattc

SEQ ID NO: 541130 - DNA, 923 bp, Homo sapiens
  misc_feature (59)..(59): n is a, c, g, or t
  misc_feature (560)..(560): n is a, c, g, or t
  misc_feature (631)..(631): n is a, c, g, or t
  misc_feature (862)..(862): n is a, c, g, or t
  misc_feature (896)..(896): n is a, c, g, or t
ggattagaaggcagcaaaaaaagctctgtgtctggctggagccccctcagtgtgcaggnttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcaggcggctgtctccaaattcggctatgacctgtaccgggtgcgatccagcatgagccccacgacacgtgtctgtctctctcatgtgcaggcctcagcactcgaagcaacgtgctcctgtctcctctcagatgtggccacggccctctcggccctctcgctgggagcggagcagcgaacagaatccatcattcaccgggctctctcaatatgacttgatcagcagcccagacatccatggtacctataaggagctccttgacacggtcactgacccccagaagaacntcaagagtgcctcccggatcgtctttgagaagaagctgcgcataaaatccagctttgtggcacctctgganaaagtcatatgggaccaggcccagagtcctgacgggcaaccctcgctttggacctgcaagagatcaacacactgggtgcaggcgcagatgaaagggaagctcgcaggtccacaaaggaaattccgatgagatcagcattctccttctcggtgtggcgcacttcaaggggcagtgggtacaaagtttgactccgaaagacttcctcgaggatttctacttggatgaagagangaccgtgagggtccccatgatgtcgggacctaangctgttttacgctatggcttggattca

SEQ ID NO: 541131 - DNA, 424 bp, Homo sapiens
tgactccagaggattccctcgaatcgacggtttctcttccactggtaccaaaacagatacatagaccaatggaagagaacagagacctaagaaataaaaccacacatctacaaccatctcatctttgacaaacctgacacaaacaagcaatggggaaaagattccctatttaataaatggtgttgggagaactggctagctatgcagaaaactgaaactggaccccttccttacaccttatacaaaaatcaactcaagatggattaaggacttaaagataagacctaaaaccataaaaatcctggaagaaatcctaggcaataccattcaggatataagcatgggcaaagacttcatgtctaaaataacaaaagcaatgggaacaaaagccagaattgacaaatggaatctaattaaactacag

SEQ ID NO: 541132 - DNA, 157 bp, Homo sapiens
cacactggtgcagaaggctgggggatttggaggtgggaacacaaggtgtctgcaggatgaagtctatcttttcagtgaagtgcaatggccagtgcccgaaggtgagagtaacagtggggagatatcgaggtgagagatggaaattgttactacacca

SEQ ID NO: 541133 - DNA, 483 bp, Homo sapiens
cagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaatataccatagacagtgagtcttttctcaataccagtagcttaataataccagattcaaagcagacagaaaagagacaggggtgatggctcatgcctgtaatcccagcactttgtcgggggtgggaggattgcaggaatccaacctgggtaacatagaacccctctctataaaaaaaaa

SEQ ID NO: 541134 - DNA, 148 bp, Homo sapiens
caggttatcctactggcaacgtgacacgtgcagatagcaacgagcaggcttgtttgatgtgcacagcgtcctgcgggtggtgctcgggtgcgacatggcacctacatgctgccgtggtgcgcaacccctgtgctgcagcaggatgcgc

SEQ ID NO: 541135 - DNA, 411 bp, Homo sapiens
  misc_feature (121)..(121): n is a, c, g, or t
agaaggaattcacctggtgtattaaagtgaataatcataaaccactcacctttgttgttattagcagcagaacaatgatgtggttagttaattaaagctgaaaataagctttttgcctggntttttatggcggcttacgcgccgttgaaactttaatcatcacccgccacgcggatcaccactttgccgaagtttttacccttcagcaggccgataaacgtctgtggcgcattctctaaaccgtcagtaatttcttcgcggtagtggattttatcctctttcacccattgccccatctccctctgaaactcatggatgcggtgaccataatcctgagcgataataaaaccttgcaagcgaatacggtttttcagcactgtagccatcaacagaggtaaacgatcccgaccc

SEQ ID NO: 541136 - DNA, 153 bp, Homo sapiens
  misc_feature (121)..(121): n is a, c, g, or t
ggtgcataatatagctggcagtgcggtgcttggtacacctgaaaatgttaggcttatgaaaccttcaagtagggatggtacattatttcatctgcaatgatataaatccttgttattatanctatcccgaggtgtgggctgtgtattatctga

SEQ ID NO: 541137 - DNA, 904 bp, Homo sapiens
acagttccgggagcatctgtcgtgttctgtacggagagagggggaggacctgttcgggtagttgtgacggagagttactggcgtcgttacacgacagtacagtttccgtgatggaacttcagcagatatatattataaggacttgaaaaatacctgtatacaaactactctgccttctatatatctcctggcgacctgcccctgacagcgcgatgtacaatacggtgtggagtatggaccgcgatgacgcagactggagggaggtgatgatgccctattcgacagaactgatatttatattgaaatggatcctccagctcttccaccaaagccacctaagccaatgacttcaggcagttccaaatggaatgacggacagtcctgtatctctttcaggatgcagacatggtactggggcgatatttcaagggaggaaggtaactgacaaattgagggatatgccagatgggacctatcttggtcccgaagatgcctcaaccaaaaatgcaggagactatactttgatttgcgggaaaaggaggcacgaatacagtccatcaagatctatcacccgggctggtcacatacgggctctctgatcctcgaaattcaacacggggaagctcatcaacccctaccacagaactctcgccacgacaaccccaaacttgaagtgcagctacagtaccggggaacaaataccaacgaaccaggggaacgcagcaaactagacgcacaggcaacaacggcaccatacccaaccacacaaacggacaaccacagtagacagagagcgagcacacaaaatccagaaacagagagacgagcaaacaagaccgacactgaccagcgccacacaaatgcacaaagcgccgcacgatcgcacaaacacacacaaccacac

SEQ ID NO: 541138 - DNA, 640 bp, Homo sapiens
  misc_feature (79)..(79): n is a, c, g, or t
  misc_feature (90)..(90): n is a, c, g, or t
  misc_feature (313)..(313): n is a, c, g, or t
gatccccacctgagtctctgcgtaggattgattacgaccataacctccacgcctcggatgggctccggcccgtactgcncaccaggaggnttctttttgcctgtagaacagtcagctggacgctcatggtgcacgtccagcagccacacaatgggtagataagggcttcaacagcacgccggaataacaccgtaatagcctgtgtcccttaccaaggaaacccgcgcccaggcaaaaaaccagtagcctgcgtaacatttacgatgtgtgcagaaactcacctacgttggcgcgtgcaaattccagcatgccngtgtaaaccaacgcgctcgctgtgtgcgcatacccacacacagcgtcttgaccgcagcgaaccactcgctcgcagatgtcggccatgtcgagcccaaaccgcttggctgtcactagagttagccgacgtaacagaacgttgaatgacttgatcctgaccaattcaaacaacgaacaaacgtgtgaacaacccatccagtaacaaccaacgtgaactcggacgctctgtatcgaaatctggacgagtcagcacatcaataccccatacatttcaacgaaaggcacgttcaaaccatgaacagacgattctgactacagaccagtgctt

SEQ ID NO: 541139 - DNA, 281 bp, Homo sapiens
gctgggtactccagtctcctctcagcccagtctttcctcttggacacttccctcatatctcttcccagtctacctcgacccctgtccgtgtcatgcacaagtaacaaccattccagtttttttgtttttttttgttgttgttgtttcgccagggtctcgctctgtggcccaggctggagtgcagtggtgccatcatacctcactgcacacttaacctcctgggctcaagcaatcctccccactcagcctcccaaattgctgggaattataggcatgagcca

SEQ ID NO: 541140 - DNA, 3041 bp, Homo sapiens
cgagttggaagaggtgagtcctgtctcaaaatggaggtaaaaccgccgcctggttgcccccagcccgactccggcagtcgccgtcgccgctggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatcggtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtcgtggaggtggatctggcaattgtatgggtcacagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaaaagtgcagctattgattaatgcaatgtagtgtcaattagatgtacattcctgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaagatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatatatatgtatatacatatatacatatatatatatatatggatatatacatatatatatatatatggatatatacccatgtctactgttttgcttcagctagtgcttacaatttcattcaagtcctgagtatgtgtcctgctgttactccttctttggtagttgaaagttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccacatggaaattggcctcatggc

SEQ ID NO: 541141 - DNA, 132 bp, Homo sapiens
aatgtagaatgccttctcaagtgagatagaagatttgcgtactttccagcacagaaatgtatctgtgtcgttggaccagcctcccccatcaccgtaccattacgggaatcctctccaaagaaggaggagact

SEQ ID NO: 541142 - DNA, 2987 bp, Homo sapiens
cgagttggaagaggtgagtcctgtctcaaaatggaggtaaaaccgccgcctggttgcccccagcccgactccggcagtcgccgtcgccgctggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatcggtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtcgtggaggtggatctggcaattgtatgggtcacagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcaaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaagatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatatatatgtatatacatatatacatatatatatatatatggatatatacatatatatatatatatggatatatacccatgtctactgttttgcttcagctagtgcttacaatttcattcaagtcctgagtatgtgtcctgctgttactccttctttggtagttgaaagttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccacatggaaattggcctcatggc

SEQ ID NO: 541143 - DNA, 3041 bp, Homo sapiens
cgagttggaagaggtgagtcctgtctcaaaatggaggtaaaaccgccgcctggttgcccccagcccgactccggcagtcgccgtcgccgctggggggaggagggccatgatccaaaggaaccagagcagctgagaaaactgtttattggtggtctgagctttgaaactacagatgatagtttaagagaacattttgagaaatggggcacactcacagattgtctggtaatgagagacccccaaacaaaacgttccaggggctttggttttgtgacttattcttgtgttacagaggtggatgcagcaatcggtgctcgaccattcaaggttgatgggcgtgtagtggaaccaaagagagctgtttctagagaggattctgtgaagcctggtgcccatctaacagtgaagaaaatttttgttggcagtattaaagaagatacagaagaatataatttgagagactactttgaaaagtacggcaagattgaaaccatagaagttatggaagacaggcagagtggaaaaaagagaggatttgcttctgtaacttttgatgatcatgatacagttgataaaattgttgttcagaaataccacactattaatgggcataactgtgaagtgaaaaaggcccttgctaaacaagtgatgcagccggctggatcacagaggggtcgtggaggtggatctggcaattgtatgggtcacagaggaaactttggaggtggtggaggtaattttggccgtgatggaaactttggtggaagaggaggctatggtggtggaggtggtggcagcagaggtagttatggaggaggtgatgtggatataatggattaggaggtgatggtggcaactatggcagtggtcctggttatagtagtagaggcgggtatggtggtggtggaccaggatatggaaaccaaggtggtggatatggtggcggtgttggaggatatgatggttacaatgaaggaggaaattttggcggtggtaactatggtggtggtgggaactataatgattttggaaattatagtggacaacagcaatcaaattatggacccatgaaagggggcagttttggtggaagaagctcgggcagtccctatggtggtggttatggatctggtggtggaagtggtggatatggtagcagaaggttctaaaaacagcagaaaagggctacagttcttagcaggagagagagcgaggagttgtcaggaaagctgcaggttactttgagacagtcgtcccaaatgcattagaggaactgtaaaaatctgccacagaaggaacgatgatccatagtcagaaaagttactgcagcttaaacaggaaacccttcttgttcaggactgtcatagccacagtttgcataaagggcaagtattgattcatgcaccgtaatgacaattagatggacattactgaggtcttttatctgttgtagctttgtctttttctttttcttttcattacatcaggtatattgccctgtaaattgtggtagtggtaccaggaataaaaaattaaggaatttttaacttttcaatatttgtgtagttcagtttttctacattttagtacagaaactttaacaaaatgcagtttcgaaggtgtttccttgtgagttaacaagtaaagaagatcattgttaattactattttgtatgaattttgctaaagttaactgtaaagaaacacctgctgacttgcagtttaaggggaatctattctccccatttccaaaccatgatatgaatgggcgctgacatgtggagagaatagataatttgtgtgtttgcaatgtgtgttttagataaataggattgggtatttaaattagcatttgtgaatttaatagcattaagattaccttcaaatgaaaaaaaatctcaaaatttctatttggtttttgtgcattttcttttaaaatgtaatcatatgattttagtgtgttagacttgctgagtcctagctgtgtttagaacagaacatctctattctacatttaccttggtcaaatttgaactgctgccataggttttgggtgtaaagaatgtttactgccctccatttaaattctgaaaagggatggtggatgttttccctctcctacgttagaaaccattcttaaaaacttttgaaaatatagaaccattaagcctgctatatctgagcaaattagtgggtaaccttttttccttttttaaagcacaagaggcccataaatcttgagttatttgcattagtttacattttttgatacaacttttcagaccaagagaataaaaatcatgcgttattaaacccctagctggctggcatgctttcctgtttgtactgtatacattttgctggatgaaaccaagatagtttaggtataattgtccaaaataacctaactgcagcagaaatgtaggacagttgcttagtacaggcttctcacttcctacagacctgaattcaaatttggatagtctgagttattaaattcccaaagacaaagaacacactcttatttcttgtgtatatttcaacataaatcatgttgttaccaatttgttgggaaggccctggttgagaagagttttagataataaggctgtatatatatagatatatatagatatataccaatgtctatatatagagatattttatatatatatatacaggtatatatatgtgtgtgtatatatatatatgtatatacatatatacatatatatatatatatggatatatacatatatatatatatatggatatatacccatgtctactgttttgcttcagctagtgcttacaatttcattcaagtcctgagtatgtgtcctgctgttactccttctttggtagttgaaagttgaattcaagtctttccttctgttttaagaagtactaagcaaacaagcaataaaaaggggaatggcgcatgctagtgtttgaatatgctctcttgttgctctaattctgtgcctccgtgcattaatatttggatgcatgcaatgccacatggaaattggcctcatggc

SEQ ID NO: 541144 - DNA, 939 bp, Homo sapiens
ctcgcgagcgaggcagccatgtattatcccgcgtgatgattatgaggtctgaggcggattatgacccctacgctgtatcccagcgacctatgatatgcacacaggagatccaaaggcgggatcttgcttatgaacgttgcagtatgaacgagcagaaccttgtatcaggatgatcccatgaggtgatccaagagaagcgttgcatccagatattgtccaccaagaacatgttcctcagaatttggatctgcaccagtaagagtggtatcgagctacgaggcctaggtcgatgtgcgtccagtggatgtcctcttgactcaagtagacggtggtactcgaagaatccgatggactaatcatatctgaggaacaagtctgggaccaaagcgtgacgtgacaaagacttcatctcagagaagatatcactctcttgagacctgcaggggctggagagccaaatgtgcctcgcacagagtttgggctccatcgacgtgcttgggtcatatctcgatgactttgttcataccaatagagaattataccataacagggctacatatatactttgccgcaaaagtcatagctgcgcggagaacgcttttcctgtgtggagaagccatgacgcgttgggaaactccgataagttacagacataactgctaagtcatctatcatgacgtagcagttcgtctaacgtggaccgatttggattccctggcttgcccccgtttgaatggtatacccaatcgcaagtgggacttcgtggggaataatgcaattccgagtggacgatttcattcgtaaccaagattcacaacggtacaatttcaagctccagctccccggcttggtaaagaacctgccctgggaaggataggacggaagcgaagaattgacctatgctgcggtgacccaattcctcaagaatcatggtacctg

SEQ ID NO: 541145 - DNA, 1668 bp, Homo sapiens
  misc_feature (185)..(185): n is a, c, g, or t
  misc_feature (287)..(287): n is a, c, g, or t
  misc_feature (1140)..(1140): n is a, c, g, or t
  misc_feature (1667)..(1668): n is a, c, g, or t
ggaacgtgctttggaatgacggtactgatggcctgggtcgggtgaagtccctagatacttttcctcggattaagtgtcgaaactcgtgtgatactcgaggaagggctcgtggtgccgtcagcgtcgatcatggccagagaggacgagtatctgggagcgcctgtggctagcgcgacttctgtctngctcgagctcgagggccaagacggggaaggcctaggacagagcgtcaagtgtgggcaggatgcggggtgcatctctgggggcggcactacatggcttcaacnatagcaaatgactgtgtgcctgtggtcaatatcaattttggtggtgggcagacacaggggacaccgtctgaagagagccgaggcatcaactggaatagtgcatccagcttgaaattctggtctccagccctgtgggaaatgggctggagatgataagtagtatggtcgcaagctctatgggggaagagcttgttctcaggcggtgggtgaaagagttgactgaactcgcacaaagtggtgcttctgcgaattaaggtgcgggaagggacggctcaagtttgtgggatcgcacgcaaattacacggtgggatcattggagagaccttttggagggatgggacttaccacagttagccatgtaacaagagtaatggggaaagtttccaggagcttatacaagaggaaaaacgaatagagcaatcccgcgtataaatggtggtagtgagactggggaaacggttccaaagtttccaaaatgataagttcgttttttcaagggggctatagagagcgaggttcttaaagttcaattccccaaatataggataattccaaggtcttccagtaattaatccttggaatcttaaataaggtaatcctgattatccttttaaaaacagccagtgtgacactggtgtgtgtcgtaaatatccgatgaagccaaactgttgaagctgggacacttcctgagcacacagactctcccttggaaaagcaaggtacgggggaaaagaaaaccccacggggcctacctcctgggacgcccgaggaactaaagcaagggcattcgtgttgccattgaaaaggcaaactacattacacagttcggtcccttgtgacgtgggtccaagtntcttgcgaggggaaggaaactatagaaatgggaacgccaacggtgggaacaacttatgggtgagcacctccaacgtgttatcacacacacaaagccattgtgtaagaaaacattttacaaacaactctcccaatggagacgaacactggtggtatgccacgccgcctctatatgaagatggtgcccaagaggtagggcggcccaaatgtgttatcgaacttatcccaatttttgtcaaggaaaaaggtttggacttggcgtatgtggggacaaaaaaggattacaaacgaggaaggtgaaataaaacccgtatggagggaatacaacaagaggtgaaacaagtgtgtacagcaaacatagcagacgttcaaacagacacaaaatgaaactaatgtaagatgatgtgaatactaggaatgaagaccaaaatagtgaaaagaagtgtagtataataagtaatgatagaagagagttgagagcatatagaaagagataactaggtagaaagatatataaataaatgaagnn

SEQ ID NO: 541146 - DNA, 189 bp, Homo sapiens
actggggaaaagtatagagtgaagttgacataacagtgcatcatgggctttagcataggtcagagtccaggccagcccttcgagcttggcacgcttctaaagcaataatatagacttctctacaatactgtacatctagtaatgacttgaaaaaatgggttgctcccttttaccacgtgtggcagagag

SEQ ID NO: 541147 - DNA, 190 bp, Homo sapiens
aacgaaaaaaaaaggaaaagtaaccttcagagattctaagaagagttgctcattcaaacccaggcccttgcccaaggtgggcccacttagagcgaaacttaccttttgtctggatgggcagagaagtacgtctacccggagggttgccatgtcgaagagtgagaggtccaagtgattctgtgcattgaaa

SEQ ID NO: 541148 - DNA, 480 bp, Homo sapiens
  misc_feature (51)..(51): n is a, c, g, or t
aacagctcacagtctgaggaagatgatattgaaagaaggaaagaagttganagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaaa

SEQ ID NO: 541149 - DNA, 201 bp, Homo sapiens
cggacctacgttggtcgcagtcactggggttacaggcacctccacatgcccgctaactttttgtatttttttagtagagacgggattttgccaagttggccaggctggtcttgaactcctgacctcaggtgatccacccgcctcggcctcccaaagcactaggattacaggcgtgagccaccactcctggactgtgccttg

SEQ ID NO: 541150 - DNA, 283 bp, Homo sapiens
ccccttaaaggtgaccggcccagaagaccgtccctctgccacaccccacaaaaaaaattaggatgaggggggacgactcccgcaatagaaactcaccccaaaggcatgcagggcaaaaccatccagcgtacctctactctcctctgcagcttacatggttggaatgctgagccattgctaggacgatcaggctacaggaaagcgaaatgctcctgctgcgatctgatccaactgaccactcctgctgctcctcccttgcacctcaggcatctccttccaatct

SEQ ID NO: 541151 - DNA, 696 bp, Homo sapiens
  misc_feature (70)..(70): n is a, c, g, or t
gcatgcccacccactgccctgctcccctatcagctgcccccagatgcccggatgtcgtggtcccgatccntcatgacctggttaagaagttaccataaagcgtgttcccaggcccccgtgccccgcgctgcgggaagtttctgccaggacggccttcccccgacatggagggatttccgaaccctcgaagccttcccatgacaacctgccggcacgtatgcccccaccgctggccccacagcctcagagccccaccccacgcaccctttcccacgacacacgccacgggagcccaccacgaaggctcacagctggtgtcctcacctgcccacgaatgtgtacacgctgctcctccccttcataaagcacgcgccacatgtgtgcacgaggccacctcttgagaggagcacgagctccctctgtggctgaatgggactaattaattccccctatgccacgcggagcctgaaggcccaagaagaccccttttagaacctggtagaaaggaaagctgtgcacgcactgctcctcgtccacatgtgtgtcggccagtgctggtgtctgtcgttctccgccgagctgttactggaatgagcccttgtgttcatgggtatcgtcaagcggggttcttgtgttttgtggggcttgggttttggtaacttatttttataagccataaaccctttgtatccctga

SEQ ID NO: 541152 - DNA, 3233 bp, Homo sapiens
gctggtatgttggagcagcggaggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttccaccttccagtctccctgcccaccctccatggtcttctgtgtgtgtgtggctgctggcaggccagcttgaagatatagggaaagtggtcccagaaataggcctgcctatttccgggggttgtgggaggaggcagctcctgggcccctttggagagatgaggggaaattggcttctgtggttgtctgagaggcatcccctgaatgcagaagcagagccactgtgaagtaagacacttccctttgaggctgctctggtttgtgatccagacaggccccattcaggacagtaggccccatgcaggacagtaggttccatggggaaccttgcagctagtgggtttttaggtccaggaatggagcctttgtggtacttccctagggaccaaacagacagcctggctaaaatcttggggcttagcctgggcttttctggtgtgggtccaggcccaaaggggttgaggtgcttctccccactctgctctcgtggcagagagtaactatcctcaacttcgattggtggcaaggtactggtggttgagtcaggaccacagagcttgccctcagtgaccaaataattttctccttggttgggtgaggttttccatgactgcctcatcagcagtgctttctgtatgaatcttaagtgctctctctactcccaggtccagcctcatcatgccctccaacatggtccatatgttaaaatacattgtcacccttcctgctttagagagggggctgggccctgggacctgaaggaggtaactgtcctgcccatctgtagtccatcactggctgcccaggctgaatggcagtgcctggggttggcagggaggggcacacattccccctccctggggtaggggcatcatttcagtgagaatcagatgttttctgtttctgggtttgggccccacaagctgccagctgccctgggtggtggacctgtggagaagctctgtgcttcttggtgccctcctgccccttctgcatcttgtggcatgcttcccctgggtgtgtcctcccttggtttcccaagctctgggaccttgctcccagctgtgctgtcgccccactaccttacatgctacttgcctctgacaactctttcattcatgatgtgaatatggggaatgacctgagagccacactcagctcctcaagggcagcccagcttggggctcacgcctgtaatcccagcactttgggagtccaaggcaggtgggtcagttgaggtcaggagtttgagaccagcctggccaacatggtgaaatctcatctgtactaaaaatacaaaacagccaggtgtggtggcacacacctaaagtcccagctacttgggaggttgaggctggaagatcacttgaacctgggaagcagagtttgcagtgagccaagatctcgccactgcactccaggctgggcgacagagtgagactctgtctc

SEQ ID NO: 541153 - DNA, 1262 bp, Homo sapiens
actgaacggcaacttgagactgggtaccgtggagattctgaatgtgccttggtgtatgtggttttcaaagaatagttaaagattggtattcaacgtcaaagaaaattaatataaagggaagggaaaacaatataaaagaagataaaagagaaaataattacggtgaaggaaaaataagaaaatgagtatgagagaggccagaataacccccacaggaacattacagacagagtaggccacagacaaaagaagagcaaaacccagataagagtggaaacaccaaacccaacgggaagaaataagagaagaccagaaacgcgacaacaaaaacaacgagaaaatacgacaagagagacacggccagtaggccaatgaaaccaatcacgccatagagcaagtcacaacgaaacacacaataacagggaaacaacccagtgcgagcccagcataagacacaacagctaaaggggacaagccaccaaggaaaatcacaaccgacaagaacaagaggcgagacaaaacacgagcacaaagcaaacaacaaacaacgggatacaacaacacgacagcaaaggaggaaaacacagagaaccacaaaaacacagaaaacaagaaaacaaagtcaacaaccggtaatcaacgtgtagtaaaaaaaaaaaatcgcagaaaaagaagtcaatagtggcacgtgtacaagacatcgaggagactaacacaaagaaataaacaggagaaagagagccaaaatagaaaatgagaatagagaaggatcaaaaacatagaagaagacacaaagaaaaagaacatagaagacgcataagatcaatgacgcacgaacatgaagagtaggaagaaagaagaagcaaaagtaattaaactagaataaaaaacagacaatagaaaagaaaaagttcaagaagatgagagcaggtagggtagaggcaatgagagtgcgcacaaactggaagtacatccagcacagagaaacagcaagaagccggggcgcgcgaaaatctaaaagcaacagacggacagaacagaagcaccggagacagaaggacaacagacaaacagcaccagagaacagacagcagatacagaacgagcagctagacaacaaaagcaacacgccagaggcgaaaagaaggaacacgacccacaaacacacagaccggaggagccgcagacacaagataggcacaaaaatcacacgacagacagcaccagaaaataacgacaacacaaaggaaccccagaagaca

SEQ ID NO: 541154 - DNA, 220 bp, Homo sapiens
catggtccgagagaaattagagatgaacattctagaaatcaacgagacattgcgcccccagctggcagagaagaaacagcagttcagaaacctcaaagagaaatgttttctaactcaactggccggcttcctggccaaccaacagaagaaatacagtaagatctataggctcaccatcatgaaagtgatgaatgatatcctaatttctctcggaccaatg

SEQ ID NO: 541155 - DNA, 147 bp, Homo sapiens
  misc_feature (58)..(58): n is a, c, g, or t
  misc_feature (89)..(89): n is a, c, g, or t
  misc_feature (113)..(113): n is a, c, g, or t
  misc_feature (140)..(141): n is a, c, g, or t
ctcgtgcactttcaggagctctgggtgtgctgtatactggagctacgtggaggtgtgntgtggaaaggtagaactcgccattgtcatgngatcccattccaaagctgcttggnactccctcttcaaagaccacgttactnngctgac

SEQ ID NO: 541156 - DNA, 270 bp, Homo sapiens
attcaagttgcgtgagccatcgcgcccggcccatagttttggtttttgtttgtttttttgggatggagtctggctctgtcgcccaggctggtagtgaactggtgcgatctcggctcactgcaacctccgccttctgggttgaagtagttctctgcctcagcttcctgagtagctgggattccaggtgcctgccgccatgcctggctaattttttttttttaatagagacggggcttcgccacgttgcccaggctgatctcgaactcaagg

SEQ ID NO: 541157 - DNA, 760 bp, Homo sapiens
  misc_feature (99)..(99): n is a, c, g, or t
  misc_feature (101)..(101): n is a, c, g, or t
  misc_feature (139)..(140): n is a, c, g, or t
  misc_feature (185)..(185): n is a, c, g, or t
  misc_feature (197)..(197): n is a, c, g, or t
  misc_feature (221)..(221): n is a, c, g, or t
  misc_feature (262)..(262): n is a, c, g, or t
  misc_feature (292)..(292): n is a, c, g, or t
  misc_feature (296)..(296): n is a, c, g, or t
  misc_feature (301)..(303): n is a, c, g, or t
  misc_feature (317)..(317): n is a, c, g, or t
  misc_feature (333)..(333): n is a, c, g, or t
  misc_feature (335)..(337): n is a, c, g, or t
  misc_feature (343)..(344): n is a, c, g, or t
  misc_feature (349)..(349): n is a, c, g, or t
  misc_feature (356)..(356): n is a, c, g, or t
  misc_feature (360)..(360): n is a, c, g, or t
  misc_feature (373)..(373): n is a, c, g, or t
  misc_feature (389)..(389): n is a, c, g, or t
  misc_feature (402)..(402): n is a, c, g, or t
  misc_feature (427)..(429): n is a, c, g, or t
  misc_feature (453)..(455): n is a, c, g, or t
  misc_feature (466)..(466): n is a, c, g, or t
  misc_feature (474)..(474): n is a, c, g, or t
  misc_feature (479)..(479): n is a, c, g, or t
  misc_feature (512)..(515): n is a, c, g, or t
  misc_feature (526)..(527): n is a, c, g, or t
  misc_feature (538)..(538): n is a, c, g, or t
  misc_feature (542)..(542): n is a, c, g, or t
  misc_feature (551)..(551): n is a, c, g, or t
  misc_feature (558)..(559): n is a, c, g, or t
  misc_feature (565)..(565): n is a, c, g, or t
  misc_feature (569)..(569): n is a, c, g, or t
  misc_feature (579)..(579): n is a, c, g, or t
  misc_feature (599)..(599): n is a, c, g, or t
  misc_feature (601)..(601): n is a, c, g, or t
  misc_feature (611)..(611): n is a, c, g, or t
  misc_feature (616)..(616): n is a, c, g, or t
  misc_feature (646)..(647): n is a, c, g, or t
  misc_feature (711)..(711): n is a, c, g, or t
aggcagtaacttttactagtcaataaaaagcagttctaccaatccactggtaattaatacactaaacagagttggaaagaattttactgaaagcaaaananttagagaaaatagacatttatacaaaattataaaatgnntgtaataagaataaaagcatttaaaggaaagcacaaacttaattnatagagccagtnaaagcattaaaaaattaaagtggnaattgaaatatgcaaaaatgtataaacattctacaaaaganggtcattcttttcctgagtatactaaagcnatgngacgnnngggggcgggggggngggggaggcgtggggncnnnttctcnngggcntttgggntctncacactgcgtccntccttcttcatattcntgcgtgggaatcnacatctgttgagagggacccaaagnnnctagagtggggccgccaatccatnnnctaaacctccnttccactnttgtnttatttgcgatcaatttcaaccgcatacttcgnnnncttttcttttnnatctctctatncaancagtcagtnaaactcnntaatanattnttttctcctnccaatattaaattgccatananacctggtctnatgtnaatatcacacatcccaacacttgttgtgannacatgactgactcctaacattgtgtttcctgataacccctttacattggaagggtcaaataatncttctggaatctttagccgctctgcaccaaaatcacaattgtagccatt

SEQ ID NO: 541158 - DNA, 366 bp, Homo sapiens
gtatttttcttgaaacagttagagctcttttatatatttttagtagtgaaatatttgtatacaacacataaatacatataaagatgtattaggcatgctgacggaagtacattttatagatttataaagtcacctccctttttttttctctagcttagactttcagattcttgataacctctttcacaaccctaggcagttgtcagctaaatagccctaaatttgcacattatttaactcagtttgtgaaaatcaaatagcaaattttacctcacttaaggtacagagagaaaaggtctggtggtgctagagggagacgcttttatttttctttcagccaaattaaacataaccgagcgtggcaat

SEQ ID NO: 541159 - DNA, 310 bp, Homo sapiens
cttctatatctacattgcaccttccatatctacatataacctgatacctgtttttagtgtgaggtttaaaaaaaaaaaaagtaaagattcccccttttttggttttggttttggagacacagtctcactctgtcacctaggctgaagtgcaggggcgcaatcatggctcactgcagccttgacctcccaggcttaagcaatccacctgccacagcctccccagtagctaggactacaggtgtgtaccacagggctcagtaatttttattatttttgtagagataggctggagtgcagtgacactatcaca

SEQ ID NO: 541160 - DNA, 125 bp, Homo sapiens
gctgatttcgccagtggtgttgtgtgctgaagattggggaacacactcccctcaggcctcgccatcatggaagaatgccagatgttctggcccgttatagccagtatcgtgccatacagtaatgg

SEQ ID NO: 541161 - DNA, 276 bp, Homo sapiens
gctcggtcccgactgaacactgcgttttcgatcagcagacgacggctatcagagcttgaagacagcttcatgaaataaagcgtgaagacaagattagagaaaaaagaatgcaaaggaatgagcaaacgcttccacaaaatatgggactatgtgaaaagaccaaacctatgattgactggggtccctgtaagtgatggggagaaaggactcaagttggaaaatacacttcaaaaattatccacggagaacttcccccgaaaaccggcactcttcagt

SEQ ID NO: 541162 - DNA, 309 bp, Homo sapiens
ctcatagcaggatccccattgagacagaggcccagtcagttgttcacggttcactcggcagatccaccagccccctgctcccacagcctgatcagattcatcgcggtcctcaccaacccgcagggagattatgacatgagcactggcaagttcacctgcaaagtccccggactctactactttgtctaccatgcgttgcatacagccaacctgtgcgtgctgctgtatcgcactggattcgaagtggtcaccttctgtggccacacgtccaacaccaatcaggtcaactcgggcggtgtgctgctcacg

SEQ ID NO: 541163 - DNA, 753 bp, Homo sapiens
gctgcgcatcccggcgttcgctgtgtgctgccgctttctcctccatctcttttcctccggctccggcggtgcgcatggcgacgcctgtgactggacacgcgagaagcggaagcgagctcagcgtgcgcgtgctgtgcggggctagtgcgacgtggcctgagtgtgcggaagagcttcaaccggcacttgcacttacacagctggtcaaggaccgaaactgtggccacgccccggcgactacttactacgcgctggcgcacacggttgcgccgaacacctcgatgggccgcatgaaattccagcacgcatgcaagcactactacagagcgcgaccaccaagacgcatatattatcataaccctggaatcctacatgggtcgacacgactgcagaaaccccgatggatgaacctgggccttcagaattgccagtgcgaattgaaagaccatactatatcgagatggaggtaagaactttggaatggaaacttacgaagagatgaatagaaagacaagactgatagagccatatgggagaaatgggaagagacataggaacacggcaagaaagaaaagaatgaaatcacatatgaacatcaaaagggggctaaaccacgatggtgaagcccatgggaaagtcaaaaacggagaatacgtggcaagtaaatggaagtaatgcaaaatatcggaaagaaataaatataaaaccatgaaagaaagtggataagaggaagttagcaagaggtcaaaagta

SEQ ID NO: 541164 - DNA, 154 bp, Homo sapiens
actcctccccctactccaccggacctcaaccaggacttcagtggatttcagcttctagtggatgctgcactgaccctggtcgccaaaatctgccatccaggcctctgaatttgtccgggttcaaattgtggccggggaatccttcataaagctc

SEQ ID NO: 541165 - DNA, 155 bp, Homo sapiens
ccgataatcgcacggaggtggcgaccctgctcatggcggccgacaccaggtggatgaggtccccgtaggtgggggtggtcagcttgagggtgcggaaacagatgtcagagagtgcctcgttgtcgatgcaagaggtctcatccgtattctacacc

SEQ ID NO: 541166 - DNA, 300 bp, Homo sapiens
cagagatgatgccactgcactccagcctgggcgacagagcaagactccatctcaaaaaaaaaaaaaaaaagctgctgaaatcgggcagcgcctttcaaattccgggcccaggtgattccgaaactccgggggcaccctggctacggcccttcttaggccctgccataaccctcttcctccatattagcactggcgccattgtctcttacatctccttacccagtttatacaggcgccgtgtaaagagcctcacccatgggaacagtacaacctgccgggggggggaccctcaagagtcga

SEQ ID NO: 541167 - DNA, 293 bp, Homo sapiens
ctggtacaggagcttcgctaccatcctgactaagatggcatgatacccgtgttgcttactagcaatacaaattagctgggggtggtgatgcatgcctgtaagcccagctgatgtgggaggctgaggttaggaaaatcacttgaacccgggaggtggaggttgcggtgagctgagatcacaccactgtactccagcctgggcaacaagaacaaatactctgtctcaaacaaaaaagagcaaggaaggaagaaggtttcaaaaaagaagtccgtgcatgtatgtgggtttcgggg

SEQ ID NO: 541168 - DNA, 367 bp, Homo sapiens
  misc_feature (247)..(247): n is a, c, g, or t
ttctcatcctgctctatgggaggacgcccatgtatgtttcccatacgcccatgtatggctctggctggcgaacagggcatgtacggttcacagacacccctccaggatggtagccgcaccccacactacggctcacagacgcccctgcatgatggcagccgcactcctgcccagagtggggcctgggaccccaacaaccccaacacgccgtcacgggctgaggaagaatatgaggatgctttccacnatgagcccaccccggccccgcaggcctatgggggaacccccaatccccaaacacctggctacccagaccccttgtccccacaggtgaaccccacaatacaacccgcagacgccagggacg

SEQ ID NO: 541169 - DNA, 117 bp, Homo sapiens
aatgtaaatatattgcagtacatcagcgtcatctcttcagctcccttaacacttaaacagatccattactggaatttcttgctagaggagagtagcccaaattctgtgcccatacaa

SEQ ID NO: 541170 - DNA, 1112 bp, Homo sapiens
gcccgcctgtgcccccaccgccctacgtatcccccagagtatacctgcaggctcataagacagatgcacgagagcatcacgtacaagggctccattggacagcccagtgccctgtgtacggcctagccgattgccccccttcttatgcaggcagtcatggcgagctacgaggagagagacaggccactctctttgaccctcagcttcacgatggctcgtgcatctgtgaacgagtggcctccattgtagacgtgtccatggacagcgggtctctggtgctgtcaggcattggtgacctccctgggggctctagcccgtcggaggactcgtgcctgctgggagctgcagggctccggtgcagctccgatggactacgttcgtctttcgctccatccagcgcagcctgtgccggctactgcctcagcctggactgtggcgctgcggggccccgttcgaggcacagccccctgcacactggtgccccccgaggggctgcccgatcctattcctgctctgtccctgaagctcctagccccactgggtgtccccacaggtggcccgaggtggcagtcggtaggacgggctggcgagcctggcgtcgggaccctgcttccccgagctgaggcgggggtcccccttgggcacgggagccgccagacgtagcttctgctacagcctgaggcaccgaactgcgaacgcgatcagtggagagaacaaggttcccacaacgcgtgcctggggcaacccgcgcttacataatcacaggaatccgcacgccagcatgtaggatggcccacgatccaaagggtgaccacgagcgatacgccgcccaccgggacaatgggtgagcacaggggagacaatacccaagggctggtagaagaaaaacggtttgcgatgcagatggaagtccagagtatcgtcagtaagtcggatataacaggcctacaaacaggccaacccccaaagtaagtgcaggcacgcataaaaaaagcccgtgatcaactcataaatgcaatacccaccagcttcgttcaccactcgggcgcacatggtcagtacgaaaccaaggatcacgtccaagcatgatccacccatccggtgaggctttg

SEQ ID NO: 541171 - DNA, 161 bp, Homo sapiens
aggatgtgtgcggtgtttagaggatcccctcagctggccccaagttccggctgcagtcccgtttctgcttctcagctttattcctggaagcacgctcagactccaggtcttcctggaataaagctgagaagcagaaacgggaccttggggccagctgggag

SEQ ID NO: 541172 - DNA, 419 bp, Homo sapiens
gaaagaactggcgataggacatcgcttctcgacgggacagagcgagcgaggccacgatccgcacagagacagcgcatgcaaccaaccgcaaccagcagccacacaacaacgggcaccgagcgcccgacaaagagaaacgacaaaagacacaacacagcgcccacagcgcaccaaagaaagaagagagcgcgagggaaagaccaacagcagccgcgacggaacagagggcccacgcacaaagaaaaacgacgaagagccaacgcgcagcgaacaccgcaaagaaacacaacacaccgcggcccaccaaagacgagaggggggcagagaacacggccgcgcgcaccaccagcagccccgcagaggacacaccgggaggcacaggcgccccagcgcgtgcctcgagacccaccccgagacga

SEQ ID NO: 541173 - DNA, 395 bp, Homo sapiens
ctgcgggggtccgctgctcgggctgtttgcgcgcagactgtggctgctagctggctggttggtcgtctcgtctgccacagcgtgccatgtgctccttctggccgcctggctgatgcggttctgtcgctcctctgacccgctgcggttcctgcagcccatgccggctcgttcgatgagtcacaaggcgtgcctagagcgcaggcttaatgctgggatatcgacaatcaagttgtgcgtggaccttgagataggccagtgaatctgtacatactcatgtccccgaagtcctcgagtacactggaaccggtgtagcaccaggcctgagcagaagatgagcttgtcctcgcctggcttaaacctgtacgccaggcggaggatgaagagctccaggaagg

SEQ ID NO: 541174 - DNA, 101 bp, Homo sapiens
tcggtacctacttttcacagggcagcataaagcccttctaagtaatcattgtttccccatttgattattcaggattcaattggcattcaatccgtgtctct

SEQ ID NO: 541175 - DNA, 409 bp, Homo sapiens
atcatcatcttttggataccatttcacttttttccattgacaacttgtacctattagctatatattacttgtttatttatttgaacatttatgttttttttaatctttcagtagcccattgttttttaattgaaaaagttatacacgcaaatggttaaaacaaattttatacaagagcatataatgataaaaatgtttccttaccaccctagatcttttagtcccctttctcagaagcagctatgtatgctttttcagttttctgttttattttcctgttgttctatttaatacagataccaaatgtgagttgtaataatcagcattgcattacatttttatacacttaatgcattcaaggtgtatatcacattctaaataaatgagatattggtgacattgctattta

SEQ ID NO: 541176 - DNA, 514 bp, Homo sapiens
tcctgcccatgccttgccaccgttccttggccctgtacccctcacagtgtcgtgtgaaggacgtgaagtgtgtggaaggacacttctggcatgataaccagatctggtggcgagacaaacgacagggctggtcctgatgtctcctaccgccagggtgtctgttgtgctgttcggggcctctgctgtcctgctggcttccgctgcgctgccgggggtaccaagtgtttgcgcagggaggccccgcgctgggacgcccctttgagggacccagccttgagacagctgctgtgagggacagtactgaagactctgcagccctcgggaccccactcggagggtgccctctgctcaggcctccctagcacctctccctaaccaaattctccctggaccccattctgagctccccatcaccatgggaggtggggcctcaatctaaggccttccctgtcagaagggggttgtggcaaaagccacattacaagctgtacctccccgtagctgtactcacccg

SEQ ID NO: 541177 - DNA, 328 bp, Homo sapiens
tcacttaggcctcacaaattaaacacaaagcttcagcttcagtcaaatttttaaaaataatttaaaattttaaaaatatatcaaaataaaataatcagaaagtatagacccttaaccctttgtagtactgcctcaagactatttaactcctgcatgactttttgttgtaacttactttttttgaaatgctatattatagagaaatgttgcaaaaaacatatagagtggtcctaaggacacaacacccagcttcccatcatgatgacatcttatacaaatacagtacattaccaaaaccaggaaactgttggagtcagtacagtgaact

SEQ ID NO: 541178 - DNA, 145 bp, Homo sapiens
cgcaggtgtaggtatatcagataaagtagacttaagagcatcaatagtacaaaaataatccagagaaagtcattacataataattaaaggatcaagccaagcaagaggatattacaagtcctaaactttacatgccccgtaactc

SEQ ID NO: 541179 - DNA, 276 bp, Homo sapiens
tacacaaatggtcaattatgtaaatcagggcaaatttggtgctgcagttctggttaaccacacaaccatgagagttgatattgctcccacatctcatgtatattcagatgtcccaaataataccaattagctggcttttatctggcttgcctgatgtcttgtttatcatatgatatggatgattgtttgtattgaatgttaatttataacatcaagcatatagtaaatgatcacattttgcttactattgttcattaaaacaaatccaaccattaa

SEQ ID NO: 541180 - DNA, 397 bp, Homo sapiens
cggacgtagatcatacctagaagaatctatgtttgccgttcatgtagcgctcatttggctatataagtgttgatcagtactaggactggcttcacctctgggtgggaccgaggacttctaggaacttgtctgatcagtgtccatctctgtagttcagttaacactttactcccaacttgcttcatcattgctattgcctcacagtggcaggcagctccttggatttgaaagacttcaactttggaaccacacactttgaattcaaaatggaaaacccattccctggaattagactgcttcattgcaaaagaatgatgtatgtatctttgtatgtccttgcttcttatttcattgatgtaaatctctttaacttaatatgaaaactctccaagtcttg

SEQ ID NO: 541181 - DNA, 119 bp, Homo sapiens
tgaagtccaatgtagaggagatattcttagcagcaaaactctgaaaaaaagcaacatctgagcagcaactatggatgtctatccaactctgcagattgtcttgtcaggcgttcttgcat

SEQ ID NO: 541182 - DNA, 529 bp, Homo sapiens
  misc_feature (35)..(35): n is a, c, g, or t
  misc_feature (71)..(71): n is a, c, g, or t
  misc_feature (78)..(78): n is a, c, g, or t
  misc_feature (98)..(98): n is a, c, g, or t
  misc_feature (136)..(136): n is a, c, g, or t
  misc_feature (138)..(138): n is a, c, g, or t
  misc_feature (152)..(152): n is a, c, g, or t
  misc_feature (180)..(180): n is a, c, g, or t
  misc_feature (244)..(244): n is a, c, g, or t
  misc_feature (250)..(250): n is a, c, g, or t
  misc_feature (285)..(285): n is a, c, g, or t
  misc_feature (391)..(391): n is a, c, g, or t
  misc_feature (456)..(456): n is a, c, g, or t
  misc_feature (496)..(496): n is a, c, g, or t
ggtctccctgcggttccctccgtgtttttttgtgntctttcggggtggcccttttggggttatgggttacntgttagntcgcgtgtccactgtgtggnggtgtctggtacgttgtgtttttcttcctttctggatntnccctcccacttttnattacttttttgtccctcccgccctccnatgcttatgattatatatcccctattacttaaacttgattacacaaagaaataaaagcaatgcnattttncacagaccaattcaataccattctacaatctaaanacaacaaagaactttcagtctcatcagatgtgcattctctctttagatgaaaatgtagcatggttcccgcagcctctccatttctgcccaggtctttccagcaggntgttctctgttgtcaatcttggaactgtctgtatctgatgtgagatgtctgtggtggatgacaantggatcaattcagaagtccaaagaggtacctacaaacttnaacagaattccagactgcaccatatagatgtgg

SEQ ID NO: 541183 - DNA, 405 bp, Homo sapiens
  misc_feature (26)..(26): n is a, c, g, or t
  misc_feature (220)..(220): n is a, c, g, or t
  misc_feature (224)..(224): n is a, c, g, or t
  misc_feature (260)..(260): n is a, c, g, or t
  misc_feature (296)..(296): n is a, c, g, or t
cctcagtgttgtaggttgagcgaatntaccagagtgtgagagaccattgtctcgttggctggcgctcacggacatgcagtcacggtagcgggacaactcacaaaactgtaatttacttaccaaatctcttcctttccatagcctcgcctgcctgacttagagaaagaaagcaataatttacaggcattttgaggtgtctctttctttgggtctttctgtntganaggatatttgtcgaaaaaagagcaaaccgttttaantaaactcccctggaaaaaaccaaacactggcatctnagtggatataaaatgacacttttcaatattaattggaaacaggtctcaaatcatgatactttttaaggcaggcattctttttcggcagtttgatagcagggtaggtcca

SEQ ID NO: 541184 - DNA, 516 bp, Homo sapiens
  misc_feature (493)..(493): n is a, c, g, or t
catttcagatcaaaagaagatagcgtctcagtgtcgtgatgtcccactggaagactgtgctaatatgcattagtaatcgacaaagatcagggagtaaagatcccagaaagaaacagaaagtttacagttgcgacgtatgtaacaagagtccagataatggcttcaggtcaatcgacaaaagtgttgacgtatatagtcaacttatcatggcggggtagagtcactagtgccctggacaaaccgtctcatgcaattcacgacggagggacactagagtggttcgcaaggaacttaggtcgggaggcgcattcaacgatggtgctataaactcgatcagaagggtgctccaagatccgtcatttcgcaagccaagggtcacgtgcttggcctcagtaagacacttagcatagccgtctaagagctgcgatgcgttacataggagaaaagtagaggaacgccaaacccgtgaccaagttagagcgcttagtacaantaacgtagtgccaagctcggggt

SEQ ID NO: 541185 - DNA, 602 bp, Homo sapiens
  misc_feature (5)..(5): n is a, c, g, or t
  misc_feature (80)..(85): n is a, c, g, or t
  misc_feature (118)..(118): n is a, c, g, or t
  misc_feature (122)..(123): n is a, c, g, or t
  misc_feature (126)..(126): n is a, c, g, or t
  misc_feature (129)..(129): n is a, c, g, or t
  misc_feature (136)..(137): n is a, c, g, or t
  misc_feature (146)..(147): n is a, c, g, or t
  misc_feature (158)..(158): n is a, c, g, or t
  misc_feature (167)..(167): n is a, c, g, or t
  misc_feature (197)..(197): n is a, c, g, or t
  misc_feature (229)..(229): n is a, c, g, or t
  misc_feature (242)..(243): n is a, c, g, or t
  misc_feature (246)..(246): n is a, c, g, or t
  misc_feature (253)..(253): n is a, c, g, or t
  misc_feature (257)..(257): n is a, c, g, or t
  misc_feature (264)..(264): n is a, c, g, or t
  misc_feature (313)..(313): n is a, c, g, or t
  misc_feature (448)..(448): n is a, c, g, or t
  misc_feature (496)..(496): n is a, c, g, or t
  misc_feature (539)..(539): n is a, c, g, or t
  misc_feature (596)..(596): n is a, c, g, or t
catcnctctttcctggcatgatctcgttcctctggggtcgggcacaagactccagagctgtttttttttttcacacgggnnnnnnggttctcattctccacaaggggttatggggggnctgnntcntcngggagtnnctgggctgnnctgcaaattcnaccttattnttgcccttgggcctctggttcctttttgtntggggtcatatttacatgtgtaatcggccaangggcactcctgtnnggncatcgtngggnacgtggnggcttgatctggactgcccatggcttcccaactggggccttcgggacanctgcaactcacaaccagtcttttgttgaccttcagctgatttcccagggtacttggcccctcttctttggtctcaggggccccggaagcccaaatgctcctactgaatgtcccaaatgaggaagaagtatcaaanacatcacatggattcccaaacttgttaaggtaaactggacagtcaggngcccaaatcgcaccttgactttaaaaagaccaagagggtaggngcaccctggggcagggtggacttaacagagaattccaccctgaggtcacctcagggncttgcc

SEQ ID NO: 541186 - DNA, 315 bp, Homo sapiens
gtcgctggcagacacacaggctgctctgggggatgagctggtgcgtttaaggacaggccagcactgcattcgcaagcagtggggaaggggagagatgccgaggtggtcagtatcctgactttcagaggcctttttttgtttgtcttaatttttgctagattgatattaaaactcatgtggaggactcaaggatgtttagagacaaagtcccatgacaggacaaagcaccatttttacttctctctcatactgtttcatgattccacatgtagtctttgctcaggagtctttgggaattaggatctttgagcctta

SEQ ID NO: 541187 - DNA, 918 bp, Homo sapiens
cctaattattgcaggaggggctctcttccaagccccaccctaagggttagccctggccaaatcttttgccgtctaggccacagaccaggtttttctgactaaataatgcaataagaggctctaagctgactgagattgcaagggaccctttgccgtcctcccttgtgttctccatgtctttccagatggcggaagagcatgtgccacccccttttcctagacgagatcttgtcctggtgcttgcgcgtgggatcctttggaccgaagagcccaggtatggtctgtggtgtggagttgtccctgctgcctctgcatgaagcccctgcttgttaggcctcactctccatcagaatccctgcctgtcccatctgcaagttcgccccccagacattgtccattcccgcttgccccagagaagctactcggccaaaacctagtcccagaggatctaggtatcttggtgagaccaatatggccatgacctcagtcacttagttatgcgtgtgcggggttctccagcttatacaccccgtgtgttaagtgggtggcaggtgactgatattgtagaacatttgcttcctcaatagggagatcaggccatgactcaaatttccgcagggcaagacacgggaggaggccgccttcatcccagactctcttctagggctttccgccatcaggccctcccacttgagactggtcttctgggaggcactaggcaccatgcctggtccggcaccattccagccatgcccggaattctgcctacctgccagttcaggcttttaaggtgctcttcagggccccagtgtgtgtctctgatgggtcctaaatcaaaagcccgatgttgggtcccctcataaggggggcttggccccggacccgttgggcaagggccggtaggtttccccctggctt

SEQ ID NO: 541188 - DNA, 477 bp, Homo sapiens
gatataaccttgaggaaactcaaaatcctttctccttagccttaaaatagactccacgtccctcccctttctcaccagatatgctcccttttcatttatctaactgtatgctactatttaattgtgtgatgtcttagaagtttcagtggctaatcttgagacagaccaagcctggagacccagctgcaaacctccaaaaattacttcaaaatggctaattaacaacctgaccattgttaaaataatgtcaatccgaggtccaggtggactgaagcccaagatagccaccagaacaaaacacacagacatcatactcagcccatttcttgcatgccttccttatcaagtcttcccttttaaaaaccctaaaaattgctttcccctctaaaaattgaagcagttactttaaatagcaatctggctacttccccctttactagttttgggtaataaatttgctttttattactaaaaaaa

SEQ ID NO: 541189 - DNA, 414 bp, Homo sapiens
ggagctttagatcataaagttataggccttctgccaaaaaggtgcatatatgcacagaaaattttgcatattattgtcagcaagtcacagagcctctgacgctatccaatttaaacagctctggcttggagaaagatgactctgatgaggaggagggcaagccattcctgaaagacaaagccctgactactccaaggctgagccccaggtcaggagagagaacaccggaacaggtccaccttcagacaagaaccccaagattttcaaatgcaggactgtgttatcaccctagacgttaagaagcccaaaagcccccaaaaatagcacccaggagaggacccacctcaaagggaatgattattttccacagaaaagcttgtctatgcctcaagtcagtaaggaaggttgctagcg

SEQ ID NO: 541190 - DNA, 125 bp, Homo sapiens
agatgtagtacagatttactttgaaagaatcgaagtatgtgaatggatggcatgaatggaattgtgaagcacatatgagctctttcagactaccaaggacacagctcatcctatgcttctgggac

SEQ ID NO: 541191 - DNA, 110 bp, Homo sapiens
ctctagaggatcctcaaaagtgcactcttctatatctacaattcaggaaggctgtaaaatgcatttcttgcttgttttagatacctttacaatggggagtgataaattcc

SEQ ID NO: 541192 - DNA, 389 bp, Homo sapiens
ccgtctcccaatccagatgggagcaggacagaaggtctggacacgatgccccaaagaaagtgaaattcctgaatgttctgcaggtaccgagagcagatttagatagttggggaaaattcccgtgatgaattagctaataaatgcagagaaaactgaacaagtaaacaatgagtcaacaacaagtaaacatgaggcaattttttttttgagacaagagtctcactccatcacccaggctggagtgcagttgcacgatctcagctcactgcaacctccgcctgccgggttcaagcgattctcctgcctcagcctcccaagtatctgggactacaggcgcccaccaccatgcctggctacgtaaagtataaaaagcagagatcaggtatcac

SEQ ID NO: 541193 - DNA, 184 bp, Homo sapiens
cacgagggctacccaccaaactgggaaaagaaatcacgcatatcaacattgcacgtcattggccacgtaaattctggcacttccatcactaatggccagccgattgacaaatgccatggcagctatacctgtcccattaagtatttttgcacggacgctgctgatatgggaacgggctccttca

SEQ ID NO: 541194 - DNA, 319 bp, Homo sapiens
caggtaccccagatgctcgcctgggtgagtgggtgctgttccaggctgtcaggtgcgcacctgggggtgcagggtgctgttccaggctgtcagatgctcatctgggcgtatgggtgctgttccaggctgtcaaatgctcgcctgggggtgcagggtgctgttccaggctgtcagatgctcatctcggcgtatgggtgctgttccatgttatcagatgctcgcctgggggtgtgtgtgctgttccaggttgtcagatgctcagctgggggtgcagggtgctgctccaggctgtcggatgctcacctggaggtgaggatgc

SEQ ID NO: 541195 - DNA, 106 bp, Homo sapiens
gggaccagggcgggggctgcggcggggcttgtaatgggggtcccttgctgtggtgagcctgggcgtgtgtcggtgtctggcttttgttgtcgtcgggagggagaac

SEQ ID NO: 541196 - DNA, 338 bp, Homo sapiens
tagcaagacagagtctcgctctgtcgctcaggctggagtgcagtggaacgatctcagctcactgcaacttccatctgccagattcaagggattctcctgcctatctgcctcccaagtagctgggatcataggcacgcaccactatgcccggctaatttttgtatttttagtagagacagtgtttcgccatgttggccaggctggtctggaactcctgacctcaagtgatccacctgcctcagcctcccaaagtgctcggattacaggcgtgagccaccgcaccctgccaacaaattgatatttttaaagtatcttgacagtcgacgcggccgcgaatt

SEQ ID NO: 541197 - DNA, 284 bp, Homo sapiens
cctcaagactgcgcgcgagtgactggcactctccgcccctacctgagatgccgtgcgggccacattgcaagctgtcctctgcctggagaatttctcctcccagctttgtggaacgacacaacaacgccggaccgtggaaggtcaggtagtagcaaaagagctccgtgtgacaaccttgtgacccagtcaacaggacctgagacaggagtaaggttctgagttgacgggctctcatcaacgtctgatccgggacgcattcgcgtgacgcgggtacgcgagcgtcg

SEQ ID NO: 541198 - DNA, 1498 bp, Homo sapiens
aggcgtgcgctgcggcagggggcgtggtcgtgctgtcgtctgctgcgtgctcgcgtgcgcggaggtagacggttcctgtggcgtgtgtgcgccgcggcgtgtctggcggcgggctgcgctcgttcggcggggggtggcccttgggctctctgtgtcgttgctgtccgaggcggggtggctctgctttgattgggtgggtttgtgtcatgggcgccgggcagccgtgcggggttgcgctccatcccgccgtgttgttgcgcgcccccgtgggtgggtgcgccgcggcggctgcttgcgtgcggccgcacgggggaggtggtcggccggctgcttggagcgtggctgtccgcggtggcgcggctatgaatttgtgccgcgccgccgtgttggggttcgtcccgcccgcgtgtcgtgttggtagggtgggcccacgcgcgctcgtggttggttgtgcgggtggcggtggttgggcagggtctgtgcgtctgggtggcgggtcgtgcgggtggtggtgagacgtgggtggggggggccggggctgcttgtgggttcgttatgacgtcgtgggtggtgtgggatggcggggcgcccgttaggtggtgctggggtgggggtcgcggtgtgcggtgggggcggccgcgcgtgcgtgggatgggataggcgctctggtggcgcgtgtgcgcctcagtgttgttgttggggacgggtggtctttggttcggcggcggggtgtggtggccccccggtgggggggggcgccgccgctggtgggcggcgtgttgctgccgggtggatattggcgcgtggggcgccggcgcgcgagggggtggcgcggcggcgggggttgggtgcgctgggtccagggccgcgcgtgggcgggtcgcagcggcagtggctgtgcggcgtggagggggtgcgggcggccccggagtgcttcgccccgagaggttgctgtgcgccccccactcaggggcgcgtgcctccagtatgggggtttgcgtacgatccgggttgtgtgtgtgtccccccgcatgtgatctgcctttcccccccccgccgctcgctgtcgtgtcgcctcgtcttgtttggtggccagcacccgtctgtctcctcacccgtctctctgtgtgctgttccagctcttgggcgcgctctttttatgatagttctcagtgtgagtgtggacaaggacgcgcgtgcgtggtattcagtgcgggccctctctcccgcgtgcgcgggtgcgacgcccctccgcgcccggtgtgtcatgtgtgcctttcttttttgtggcgcccctctgtgtgggttttgttctttgtgtgtcgggtggcccgcttcttgttgtggtatctgtatgtgttgttcttatagacacaccgcacgttgtcttgtgtgcgtgtgccccccccttttgcgcccccaacttgtgtctgtccccagtacttttgcgagagcgccccttgtccaaaagatgtatcaccgcaaacaataaacagaa

SEQ ID NO: 541199 - DNA, 781 bp, Homo sapiens
tctgctctccgttcggagggctcaccttcttgtctgcgctcttcgttggccccctggcggcagaccctcgggtcagggccccgtgaccccgccggctggctcccccgaggggcctcttcccgggttgtctttctggtcgaggtcttccgtgtctgtctgaccttccggataattttcaggggttgtcttcgtgtgtaatccaaaagtggttgcgcgcacccttcagggatcatacttggtcgtcccagcgggcgggtaccctgcggccttagccggcttctatcgcgcttgacgtccagcggggtgtgcttcccgccgggggctactcgcccgcgtcagcgttgtcaccgccgtggtacctctcgggggtgtaaaggctgtgccgtcccacccgggggcctatttgaccccttgtgctgtttgaggggttgcagcggcacttttgacgtgcttgacaatcttttcgtacaccacttcgcagggatactcctcttggacttttcgtccccgtgattcaccaatcgcacatatcctatccccttagcaaagggttacccaacacccacctttatggaaagatgctcccccaccggccgtgttttccccaaaaaaaccatctttcttgatagatgccacattttaatacgccaaccctacaccacatttcgttaagaccgttccacaaaatatgtcggagccccctttttcgttccagccaatttcagcgctctactcacccctttggtcaacgtaccaaaacccaggggctcaaccacaaaac

SEQ ID NO: 541200 - DNA, 480 bp, Homo sapiens
ggagatcggaaagtgaactgatgtcttacctctcccatgtcactccaagtgaaaaatgaaagcatggggcttttcttgcttctgggttagtatgagacatggtgttcatctagagagcaaaatcaacactagacatcacagacagaagtgcccatttcagcaaatccggtaaaaattgtaagttggcatcaagggaaccaatggataccttagggcactgacaattctcaatacatagaaatgcttgagggttgtgtcggttcccctggccacagtttgtcaggttgtttagccagatgccccattggtaaggtagactgaaatctcggtttagggctgaccccaagaaacagtctggttcgtgctttggtatggtggactccagtgtgcatagcagctgctgtcttgctacaagttactcagcttaagttcagattgtgattggtggctcatttcaaaagttttgagattgtactgatt

SEQ ID NO: 541201 - DNA, 143 bp, Homo sapiens
  misc_feature (80)..(80): n is a, c, g, or t
  misc_feature (106)..(106): n is a, c, g, or t
  misc_feature (126)..(126): n is a, c, g, or t
atctaggaggctgaggtgggatcgccccagtactggaggtcagggctgcagtcagccatgatcatgccactacactccancctgggtgacagagtgagaccctctntcaaaaaacctcagtcaatncaaacatacagtatatt

SEQ ID NO: 541202 - DNA, 898 bp, Homo sapiens
gtcagtgtcgttgtgtcaaatgcctagaatgctggtacaaagacagaatatggaagaacctcgtctcactatagttacttttgtcacttggtaatatatgtatttattagagcatgggaatattggtacctgtgtacaagagggtcatttggtgtgagggtgatgagctggtttgtgagtgcactagtatcttgggtcttcctgtatataatgccacgtttaatcttccatacactatagataagactgtgaacattatctttggttacctaatgctgtcctactgatgaggagtgcaaagttgggcataatgtgaactaaaattgagtggaatatgtaagtgggcattttgcaacaaatgaagaggatagcactttatttagatgaaggctggatttctaatctttgaaatatctggaattgtttattgctcagatatttgaagtatgggtgctaacattgcgattgtaaaatgcttggcgtgccatgtttactggcactggagaagacaacaatgggtgatctgggtgatgttttatacaagtgatggtaatgtaccttgcgttgttgagttggcatagcgattgtattaatatcaggattgctccatgaaattcgcggaattagtaccggagaggagtagaagcggaaaggggaggccccacacatgagagtggggggtcggaaggctggtccaatagagtcactattgaggggcgctgtacagaagcgggggctggtattgcacttacggggccgttacactgttttggacaggaacatggctcggagtcacacacgtaggactcaaagagacaaaaagatgagggcgcggaacaacaggtggacgaacacaaacagtccgttaacgcgagacatcgtcaatgcataaaacatg

SEQ ID NO: 541203 - DNA, 123 bp, Homo sapiens
  misc_feature (73)..(73): n is a, c, g, or t
tgacatgatacgactcgagcttagtaccattattttacaattcgcttctgactttctaaatctatttccaggnattcattcatgctacattccaaacactgatttgctttggcccttatcgag

SEQ ID NO: 541204 - DNA, 299 bp, Homo sapiens
ggatctcgtgttcttgtgtggtgcatatatggtgtacagcacttagtagctgtggaggaagatgcagagtcagaagatgaagaggaggaggatgtgaaactcttaagtatatctggaagcggtctgcccttggaggtgggtcgcaaggttcccccaaaaaaaatgtaaaacttgctgctagatgaagatggattgacgatgatgaatgaagaggattgatgatgaagatgattggatggatgatgattttgatgatgaggaagctgaagaaaaagcgccagtgaagaaatctatacgag

SEQ ID NO: 541205 - DNA, 157 bp, Homo sapiens
tcccccaaccggttctttggggtttttttgggggtcgggtttaaaatacccctataaaacctttttttggggttcccggaaatttgggggggtttttttttggttttggcgaggcctttttttttaaggcctcgggggggaaggggggccgcccaag

SEQ ID NO: 541206 - DNA, 822 bp, Homo sapiens
gtagtgttggtgcccgcggggctgcggggctccctgggctgctgcgtgccctggggtctgctgtgcagctgctgcggccctgggcagctcccgctactgtgacacctcagtgcatgtggccttgtctgtcgaatgctctaggcctttccctgatggcctggaaatgtgattgcttgtcatgctgtctgtgtgcatttgctagtgtctggtgcatgtggtggttgctgtgtgtgcttggtcctgtgtgctcttgcagttcgtgcttgtgatgttgccatgttgacctgtgatgcttgcaccccccccagtgctagtcctgtgtgtcatcacctgttgtgcctacctactacttaccttgtgaaccaacaccatgcaatcctggatgtgtgtgtttccatgtgtagtaataaagcaggggtagttgctgccatccttgcacacaggcattgagactatcagttggcgctacctgccacctttggtgcgtgctgttgttgctaacaacggtgatgtgattgaatgctaaaatgtgacggcttggcgtttgcgtgaggtgtcgcgagggttcaaatgacgggcccccaagttgagagattgggggaggagttgttccaattgcggtgcccatgagggagatgcttggttcggacatagttatcccccagagaaagccaataaccccaaaacaatgattgatgtggtttggatccgaaggctatgacaagacaacagtggaggcacatttggccccccttgaacactcaagcttacaatctgtgcgagaacgctaagggcattggtaggttcgaggactaccgtact

SEQ ID NO: 541207 - DNA, 647 bp, Homo sapiens
  misc_feature (598)..(598): n is a, c, g, or t
ccataaatataggctaaggtacgagctggttaatcggccgagggcgttcatcctgacagcacacttcacatgaggctgatgcacagggtgtaattggcttaaaaattctttggtatttttttgagatggagttcactcttgttgccaggctgagtgcatgcacaatcctccagctcagtgcactccgcctcccgggtcaagcgatctcctgcctcagcctcgtggagtagctgggattacaggcgtgccaccaccacgcccagctaattttgtattttagtagaggcaaggtttctccatgttggccaggcttgaactccggactcaggcgatccgcccgctcagcctcccaaagtaaccgggattacaggcgtgtgccactgcgcctggctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggaaatcacaagtccaggagtntgaggctgccgtgaccgcataggtgatgacgagcgagaccctgtctctt

SEQ ID NO: 541208 - DNA, 236 bp, Homo sapiens
tccaggttccctcgttctctaagagtgtccctcaccaccccagcccagttttaaggcacctgccttaaagacctgctcctaacagcatgtactgtacttggtgatgtgtatctaacatcacctggtgtgcattagaaatgcggaccctcaggcgctacctagatctattagatcagaatctatattacatcgagattccaggtcatgtgcatgagcctcaggagtcgccctgtcgt

SEQ ID NO: 541209 - DNA, 1085 bp, Homo sapiens
gagacgttcttcgccgagagtcgtcggggtttcctgcttcaacagtgcttggacggaacccggcgctcgttccccaccccggccggccgcccatagccagccctccgtcacctctatcaccggaaccctcggactggccccaaggcccccgccgccgatccagcgccgcgcaagccaccagccagccgacacgcacgacctctccctaaagtcggccgccatgacgaccgcgtccacctcgcaggtgcgccaagaactaccaaccaggactcaggaggccgcaatcaaccggccacgatcaacctgggaagctctacgcctcctaccgtaaacctggtccatgtcttaataacttgtgaccgggatggatgtgggctttggaagaacgtttggccaaatacttactttcagcaaatctcatgaaggaagagggacacatgctgagacaccctgcatgcaagctgcagcacccacaccagggggcccgaactctaccctccaggatcatcaagcaacacgagaccgtgctgcacggcaaacacccgccctgaatgcaacggcaggtgtgccttaccattgggacacacacatggcgaactcaggccacttacggggaaccgggccaaaaactggccaagtggacaaaagtcgcaccccaaagtggtgtgacttccatcggacgacacattaacctggaactgagccaggtgagaggcgatcaaagaatgtggggacccacggtgaccaacggtgcgcaaagagggaaccgcacagaaatcggcggagcgcaaaacatctccttggaaagggcacacctggacgcacgggataatggaagcaaagcccgcgcgcaagttcccccaatacgggggggagacactccggggccaccagggcgcaggactgcacattggggcacgcctaaaccatcataaggtcgtgccacgaccccacataagagcctgcagtgcgaaaccactcagataaacgcgtgccgcgaaacaagccacacaacaagctgtcggcccccgcgaacacaacaaatggggcgccaaaaatgaagcctgcacccacgagggtcacaa

SEQ ID NO: 541210 - DNA, 150 bp, Homo sapiens
gtcgtgtactggaatcctgggcacattcatctccagggggcagaggcaggactcagtatcatcatcctgaggtccgcagtcgcccaacttccatgggcagctgggtgtccggtgccggaactgcacctcagcaccaacctggctatccgt

SEQ ID NO: 541211 - DNA, 424 bp, Homo sapiens
  misc_feature (165)..(165): n is a, c, g, or t
  misc_feature (169)..(169): n is a, c, g, or t
ataaagccgatatcaaagataaataaaatcgctcaaaacgattttccctgtattcactgccgttgcgcaaaatttatctatttgttcaaaaaatgattgagtcttgactggctcatccaatgtggaaaaatgtgacttttatcacataatagtactaagtctgantttnccgggttatctcaaaatggaatacggttcgacaaagatggaagagagactctctcgcagccctggcggcaaactggctttgtgggctttctatacatggtgtggctatttcgtctgggcaatggcgcgttacatctgggtgatgagccggattcccgatgcccccgtgtcgggatttgaaagcgattttaggctctaccgcgggaaatggttaggggcactggtcggatttttatttatggctctggtcggggcc

SEQ ID NO: 541212 - DNA, 404 bp, Homo sapiens
gatgatcatgatgtgcacatgatccgtctcctctccctgcgtatccggtattaggtgatcatgattactagatagaatcatttcttgcgcagagagcctgatgccgagatgcatatttgtgacctgaatcggattacggctctcaccgttgaaaggccgatttgcgggcacttagcgcccgatgagcattaacagactacctgtgaagccctggaggctgtccgaatttgcgccaacatgaacatggtccctagcctgtgttcagaaagcttgcatatcccagaagctctccaccccttacacgatgtgcggataaacggagcgtgcacagcacagctcattgaggtgttcaacaggcatgcttatgagccattaggcctcattgcactggtcggtgctcacat

SEQ ID NO: 541213 - DNA, 469 bp, Homo sapiens
  misc_feature (24)..(24): n is a, c, g, or t
  misc_feature (54)..(54): n is a, c, g, or t
  misc_feature (408)..(408): n is a, c, g, or t
  misc_feature (437)..(437): n is a, c, g, or t
  misc_feature (444)..(444): n is a, c, g, or t
tgagacagaatttctttcttcttncccaggctggagtgcaatggcgcaacttgngctcactacaacctccacttcctgggttcaagcaattctcctgcctcaggctcccgagtagctgggattacagtcttgcgccaccatgcacgactaattttttgtatttttagtagagacaggttttctccatgttggtcaggctggtctcaaactcctgacctcacgtgatctgtcctctcggtcccccaaagtgctgggattacaggcatgagccaccgtgtctccagccaagacaagttttatgttctataaaggatcggcttattatatgcttcttctccatgggaagtaatatattaaaattcatttttatctacagtgtgggcccttgggtgggggaaaagctccccnttcctgctctgaggagtgaactccataantgggggntgccatgggtgctgccacaacccag

SEQ ID NO: 541214 - DNA, 136 bp, Homo sapiens
ttgtgctgcagctgctgctgctgctgttcgatgagtgtcattgcagcagaaggatctgtttgtggaggaaaaggagatcgaggagctgaagtcagagagagacacgctccttgctcggattgaacgtattgaaagg

SEQ ID NO: 541215 - DNA, 207 bp, Homo sapiens
tgaccaaagtagtacccaaatgctgaaatactagtgaggggtcgggtgtggtgacgcttgcctgaaatcccagcactttggaggccaaggcggacggatcacttaaggccagcatggtgaaagccatccctactaaaaatataaaaattagcagggcgtggaggtgcatgcctgtagtcccagttacttgggtactacgctttggca

SEQ ID NO: 541216 - DNA, 213 bp, Homo sapiens
agctcggccctgttaggtgcagtgcagtcttcagctctgtcatggaagctgagagccctggtaaaccactggtgtaagtccaagagtccacaagctgaagaacttggagtctgatgtttgagggcaggaagcatccagtatgcgagaaagataaaggctggaagaatcagcaagtctgttctttctatcttcttctgcctgctttattctagc

SEQ ID NO: 541217 - DNA, 153 bp, Homo sapiens
aaattaacagcccgtcgacatggctagctgaacagccaggcctacagaagccaggcctacagaaggaatgcgaacatttaggtgacctatacagtgggaactcatgtgacagtacttgaggagctgccaatcagatgactcaattctgtcttc

SEQ ID NO: 541218 - DNA, 401 bp, Homo sapiens
tggatgcggctcatgctaggctgcggctggctcgtaatcgggccacaggccgcctcctcattgttcgggccggctcggcagcacatgtgtcaggcgcacatcaggcacatcatccattcgggcttgcatgtggggcaggggtgtttcaggggttggctcagggtcatcttgtctgggtcgcctcggcggtctggtgcagcatcagtgttcctgtccttccggcgcagccggcacagcagccagtcaagccgcagggcgtctttgcatggtgtcagtcaagggtggcacaggtgcattttcatcggacatgggcaggtgcatcctcagggggttgtttgcatcccgtttcgtgcaagactaggccgcatcccaaagcggggcatcctctcacagtcgcacct

SEQ ID NO: 541219 - DNA, 582 bp, Homo sapiens
  misc_feature (205)..(205): n is a, c, g, or t
  misc_feature (217)..(217): n is a, c, g, or t
  misc_feature (378)..(378): n is a, c, g, or t
gtgagatactattgccagtgagtgaggttgagtgagcagacacgcactgattcatctggtcagtgatctcccactcagtcccgagtagctggacacaggcatgtgcacatggccagtaatttttgtattttagtagagacgtgtttcaccatgttggccaggctggtctcgagctcctgacctcaggtgatctgcccacctgggnctcccaaagtgnctggattacaggtgtgagccactgcacccagccaatatttttaatttttaacttttgtgggtgcataggtatatatatttatggggtacatgagatgttttgatacaggcatgcaacatgaaataatcagagggagaatggggcatccattccctcaaacngttatctttaatattacaagcaatccgaattacacactttatataaaaatgtatattactgactgtagttaccctattgtgctgtcaaatagtaagtcttactcattctaactatgtttttgtacctctgttaaccacccttctactctctatgtccatgaattcattgttttggatttagatcacaccgtgagacgtgtgatg

SEQ ID NO: 541220 - DNA, 696 bp, Homo sapiens
agcggtctcagtcgccgctgccaactctcgacactctgtgcttccgccggctccgccgtcgcgttctctgcctgagtcgcaactggaagcaagagatcgccgcgctggctcattgacaatggctccgtgcatgtgcaaagctggtttttgctgggtgacgtactgctcccctgagccgtgatttccttccatcgctcgcggtcgtccccatcactaccagggtcgtcatggtgggcgatgggccagaaggactcctacgttgggcgacgaggcccagtagcaagcgtgtgcatcctgaccctgaagtaccccgattgatgcatggtcgatcgtcaccaactgggacgcacatggtagaagtatctggcatccagcagccttctacaagcgagctgcggcgtggccccggaggagcacccagtgctgctgatccgagagcccccttgaaccccgaatggaccaacagacgagacagatgactcatgattctgttctgagaccttcatagcatcctccggccactgtacgtggccatccagggccgtgctgtcccttctatcgcctctgcggtcgcactcactggcattgttcatggatctctggaagaccggggtcacccacacaggtgtcccatctacgcatgggctacgccctcccccacgccatcctgcagtctggacctggcatggccgtgga

SEQ ID NO: 541221 - DNA, 257 bp, Homo sapiens
ggagatgggatcttgctttattgcccaggctggagtgcagcgtgtgatcatgactctgtcccaggctcgagcatacttctacctcagcctcccgagtagctaatttctgttttttgttttttttttttttgagagggagtctcgctctgtcgcccaggctagagtgcagtggtgtgatcttggctcactgcaagccccacctcctgggttcataccattctcctgcctcagcctccaagtagctgggtctacaggtg

SEQ ID NO: 541222 - DNA, 437 bp, Homo sapiens
gactgtcgaccaggttgcccagggagggtgaaccggcccaggttgcgaatagagcagatgaaacatctctcctatgctgatcagtagtgggattgcacctgtaaaaagccactgcactccaacctggacaacacagtgaaacccgtctcttgaaaataaaaaattaaaagaattttttaggctgggcacagtggcttatgcctgcaatcccagcactttgggaggctgagccaggcagatcagttgaattcaggagtttgagaccagcctggccaaaatggtgaaaccccatctctactaaaaatacaaaaaggcgtggtggctcgcacctgcagtcctagctattcgggaggctgagacagagttgcctgaaccctggagggggaagttgcagtgaacagagatcgcgccactgtactccaatctggtcgacagtc

SEQ ID NO: 541223 - DNA, 317 bp, Homo sapiens
aaaaaaaccaattatggcttattttttattttgttgcagtggggttaactgttaactcatgtaagggtctgtgatttcctccctggttggtctctctctctgtaatcctccttgcaaattttcccccgggcagcgttttttgattaaaggggagctttggccccgtatgcttttatttagccgggacttcccgatggttttaattctcgatgctgtgatgacccccatatggtcttttgtgtttttgagcggctcttctttccttgtttgcccgcgtggctcgttgctgttgccccattaagcttgtgttcgttcca

SEQ ID NO: 541224 - DNA, 365 bp, Homo sapiens
aaggtggcacttgtggggaatccgggggcggaaagtcccgttggtgaacctgctgctcggcctctacccggtcaccgagggcgccatcatggtggccggcaacgatatctctcaggtgaccccggatgccttgcgacgccgtatcggagtggtcttccaggatccggcactgttctccggatcgatccggaagaacatcgcctacgccgaccgcttcatcaagcggttctcccagcagtacgacaccctcgtcggggagcgcggtatcaagctctccggtggccagaagcagcgcatctcgattgccagggccctgctcaaggacgcccgtcgacgcggccgcgaatttagtagtagtagcgacc

SEQ ID NO: 541225 - DNA, 122 bp, Homo sapiens
  misc_feature (7)..(7): n is a, c, g, or t
tcttagncaaaaaaggcaacagatgttttattcttcattgcattttactgtcattcaccagtcgttttacaacgacacatctggcaaacacatggagttacccatcttaatcttttttgagt

SEQ ID NO: 541226 - DNA, 334 bp, Homo sapiens
  misc_feature (59)..(59): n is a, c, g, or t
gtacatttggggggggcccccctcccccctttttttaatttaaaacagcccctttttantgtggggtggagccttcccccttttttggcctcctgggagggtcccctttattttttacccctgccccccccccccggttttgggggggggttttttaaaaaaaaaaaaattaaagccccccaaattagtccgtttgggggccgtgggtttaaagggggttttttttccccccaatttttttgtaaccgttggggggtttcccccccccccgggtttggcccttaaaataaagaaaaaaaacccccttctttattaaagtggccaaaaatgggga

SEQ ID NO: 541227 - DNA, 428 bp, Homo sapiens
agtgagagttgtgcgactctcctttttgcttgaacacatagaagcattgccgggttattcagtgacctagtttcaatattgtgtcccagggaatagagaggcccaaggagagggagagagatggaacagctggttggtggagcaatcagaacaaacatacatttattgattcaatttacagtcttatgtggggtggttcagtcatcccaaagcaattaccatagtaacatcaaagatcacgatcaccaaaacagatataatgaaaaagtttaaaatattgcaagaattaccaaaatgtgacacagacatgaagtgagcacatgctattgggaaaatggtactgacagacttgcttgactcagtgttgccacaaaccttcaatttgtaaggtgcagtatctgcaaaggcaataaagtgatacacaataa

SEQ ID NO: 541228 - DNA, 254 bp, Homo sapiens
aggttgtcaatattgtaagtcaaaatgccagctaaggtgaatgggtattcatagggcatgttcttatgcgttgtacgttccttcaaggtaggcgcaatgtggaatgtggtgttgtaaaccacattcatggaagcgatgtgccttcagagtctcgtggagtgatctcagagataacaccgtgaccgtgatcagccttgtatatgtgcgcacctctatttacacagctcgcgtgccgtattcgtacagcccggggg

SEQ ID NO: 541229 - DNA, 183 bp, Homo sapiens
ccccccccccccccccttttttttaccttttttatttggggcaaagggcttgttccctttttcccccaaccccttttgggttccttttttccccagggggggggaaaaaaaacaaaacttttttttcctcccccttttcatgggccttttttttttgggggcaaaaataaatccccgtcccca

SEQ ID NO: 541230 - DNA, 374 bp, Homo sapiens
ttatatttacaaggggatttagagggttctgtggggggatttaaagttgaactaagattctatctcccacaaccagctatcaccaggctcggtaggtttgtcgcctctacctataaatcttcccactattttgctacatagacgggtgtgctcttttagctgctcttagggagctccgctggtttcgggggtcttagctctggctctccttgcaaagttatttctaggtaattcattatgcagaaggaatagggggtagtccttgctatattatgcttggctataatttttcacctttcccttgcggtactatatctattgcgccagggttcaaattctatcgcctatactttatttgggtaaatgggttcatt

SEQ ID NO: 541231 - DNA, 344 bp, Homo sapiens
taacatgatacaatcgagctctgtacctgtgggtagcagaactagggatcagttgaggttgtaagccatttaccaatgatagttgtaggtaagaagggcagattattagagaaattgtgaaaatatgttgcagtgggcagctcagcagagaaggggctacctgcaaggaggcaagggctggaggaaagttttatagggtcctggtgaagggtgctatgtgctgaaatgaggtcattgtgcccgcaggttgtttgtgattagctgtctctaacaattgttcatacaataattgttcattattgttctcaacttggggctctccccaacctggggacccttcctta

SEQ ID NO: 541232 - DNA, 553 bp, Homo sapiens
  misc_feature (22)..(22): n is a, c, g, or t
  misc_feature (33)..(33): n is a, c, g, or t
  misc_feature (35)..(35): n is a, c, g, or t
  misc_feature (38)..(38): n is a, c, g, or t
  misc_feature (101)..(101): n is a, c, g, or t
  misc_feature (290)..(290): n is a, c, g, or t
  misc_feature (442)..(442): n is a, c, g, or t
gacgccacttctatgcacagtnccaatccctgngnccntatttgaagaagaaggatgaatctccggaaggccacccccgtatctccgtccctagaagagcntgagaaactggacgggctctacgagtgccattctctgtgcctgctgtagcacccagctgcccccagctactggtggaacggagaccaaatatctggggcctcgccagttctttatgcaggcctatcgctggatgattgactcccgagatgacttcaccgaggagcgcctggcccagctgcaggaccccnttctctctataccgctgccaccacccatcatgaactgcaccaggacctgtcctaagggtctgaatcccgggaaagctattgccgagatccagaaaatgatggccacctataaggagaagaaagcttccgtttaactgtttccctgctaaacntgatttataacccgctcagagctgaacataatttatatctaatttgagttcccttaaagatcttggttttccctgaataccgcaatgtataataaaaattttaagaaatta

SEQ ID NO: 541233 - DNA, 420 bp, Homo sapiens
tcgcgacgcgtattatccttacgattatttagtccaataacattgagtatttttcttcttagtcttgaatatcatgaaggtatcagcctgtgacattaaaattttgaaagtccttagtccagatggtatgatacttgaacgttatccaggagcttgtattcaagacgtccttgtaagacgccctttccataaactctcctggccagtcttcctgaaaatacagaaatgacatcacagctgctatgttggattaaggagaggaagaagtcctattcttgtagaagcagagactttgactgtcaacgatgtggagctttcctcgccagtggctgagttacgaacagagcaaacatagagcccgctatgcttagtagtaatatgggggactaaacagatttggtcctgattgctgaaacttcc

SEQ ID NO: 541234 - DNA, 1168 bp, Homo sapiens
cccacgcgtccgggcggagcagaacggattgcacggtcagccatgtcatctgagcctcccccaccaccacagccccccacccatacaaagcttcagctcgggctagctaggacacccctacggagccgtgagcgctcaccagtcccctactagcaggaggacaacgtaggtcccaagcccactgacccactacgccggacgaggaccttctcgcgcgacgtgtgcgcggcttcacagggccccgtctacaaagcgagtactgcaaatgcttctgccggtccaagggccatggcttcattaccccagctagatggcggccccgacctcttcctgcacatctctgatgtggaacggccgagtatgtcccagtgcaaggcgacgaggtcacctatacaaatgtgctccatcccacccaagactgagaagctgcaggccgtggaggtcgtcatcactcacctggcaccaggccccaagcctgagacctggtctggacatgtcatcacgctcctaggaccatgctgcgaagcacccccttgacctgtagcatgtggcaccactccgccccggacgcaggcacgccagacactggaacatgacctaacttccacacgacgacggcgcttcacccgggcattgcctccactctcaacgtatcctcacttgagagcgaacgggcgctactcgcggcgagccacggtgctcaccgatgctagcgccatgctacccggcgcccatcacgacacagcgctactgcccccacttgcccaccaccccactcccacccatctgacagaggccatttacgcagccttcaacaaccgcggcacaccgcacacacccgacgcacataccaaccaacgccaacccacccaacccgacacacacacaacaccaccacaaccacacagggcctccacgctacacatcaatcaagccctcacccacacgacagccaccaccaccccgccatccccgcaccaccgcacaacccacagcgaaccccacaacggcccccccatcaacaggcccaccgcggatgactctaaacccccaaacccaccacacacccacactcccccacacccgacagacgcctaacccgcccgccagccaacccagcccaccactccaccgaccccacgcccaacccccgcgcgctgcacaccca

SEQ ID NO: 541235 - DNA, 109 bp, Homo sapiens
acttcgccgccggcattaacactattctcaacagacctcctaggcgaccagacaattacaacctagccaatctctattttacaccaatccctctggcaaggaacccacg

SEQ ID NO: 541236 - DNA, 157 bp, Homo sapiens
  misc_feature (150)..(150): n is a, c, g, or t
gtcagacagcagcacatgtgaaccgctctactaaaatacaaaaaatgagcggcatgtacaggtgtctgtatccagtaggagctgaggcagagatctctgaactgaaggcgaggttgagtgagcaagatctgccattgcactccagcctgngggacaa

SEQ ID NO: 541237 - DNA, 143 bp, Homo sapiens
  misc_feature (126)..(126): n is a, c, g, or t
tgtgtgtgtggtacactactgtacgacgggacgtatacgggctgtgacctacgtactgttgacgtcctgtacagtacggacgacgtgactactttgactcacggacgacaccgtgggttactacgncacacgacgacgttctc

SEQ ID NO: 541238 - DNA, 605 bp, Homo sapiens
attacaggtgcccaccaccacgcccagctaattttgtatttttagtaaaatggggtttcactatgttagccaggcttatctcagactcctggcctcaggtgatccccctgccttggcttcccatagtgctgggattacaggtgttagccaccacgcccagcctatatgtattttttgagacagggtcttgctctattgcccaggctgaagtgcagtggcatgatcacagctcacaaatgccttgatctcctgggctcaagctatctcctcccacctcagcctcttaagtagctggagctacaggttatctgccaccacactcagctaatttttaattttttagaaagacggggtcttcctgtgttccccaggctggcccaaactcctgggctcaagcaatcctgccttacctcccaaagtgctgggattacaggtgtgagccaccacatctggcccaagtcacccaaattttttacagcttggttggaaggcaatgtagtatattaaacattatgggccctggagtcagaacagatccaggtttgaatacagagtccgcatctattagcttcatgaatttgagcaatttcgtctcacttgtcaaa

SEQ ID NO: 541239 - DNA, 170 bp, Homo sapiens
tggtatcactttataggtaaaatccttatgcaactatgcaaagaatgctcatgaaattaaaacctcttggacgcacaccatctgtatagctctgcgatccgaagacctcccgctatattacaaaatgacatgcttcaaaagaacttaaacttccttggctacagtatcac

SEQ ID NO: 541240 - DNA, 108 bp, Homo sapiens
tcctgatgttgtagcgggacttgttggttcatcttagttaatgtgccaaggtgatctaagttgcctaccttgaatttttttttaaatatatttgatgacataaaggcc

SEQ ID NO: 541241 - DNA, 152 bp, Homo sapiens
ggtacttcgacccattgttggctggcattaaccgctgatgtagtgtagccgacagacccattatagaccatgaactgtaggcttggaccgctaaaatccttatgggattggtcccttaaggttggttataccgttaacgagaataagggggg

SEQ ID NO: 541242 - DNA, 434 bp, Homo sapiens
  misc_feature (245)..(245): n is a, c, g, or t
  misc_feature (249)..(249): n is a, c, g, or t
  misc_feature (255)..(255): n is a, c, g, or t
  misc_feature (285)..(286): n is a, c, g, or t
aatttgtttgtattttttatttacattttatatttttgtacatattgttagggtcagccatttttaatgatctcggatgaccaaaccagccttcggagcgttctctgtcctacttctgactttacttgtggtgtgaccatgttcattataatctcaaaggagaaaaaaaaccttgtaaaaaaagcaaaaatgacaacagaaaaacaatcttattccgagcattccagtaactttttgtgtaagtnactnatcgtnactaaaaagatggtttgtctagaatagttnnaaaaagcccaaatacaaaagtttcctttttttccttttttgtctatgaagttcctgtttcctttttttggcctgtctgatgtatgtgtgaaacaatgttgtccttccttttacagaaattttattttgataagttgttaaaacaaaaa

SEQ ID NO: 541243 - DNA, 183 bp, Homo sapiens
ttcccattgccctcgattcccaacgaatgaataagttttgccaaagcttgctgtaataaagtataaatggggccaggcgcatgttgtgctacagacgcgtaatcctagcactctagtgaggccaaggtcggcagattcgcgtaagcacaggaggtcataggaccagccggtcgacaatcagtc

SEQ ID NO: 541244 - DNA, 265 bp, Homo sapiens
gcttgggcacaggagttcatacactagcctaggcagcagtagcaagaccttgtctcaaaaaaaaaaaaaaaaaatcggggcttaaccaaggcatttatttcccgggggattaagttttaactgtttttgaggaaagctttttttttatttggaaatggcatggggtagatatgaattttacatgaatggtaaagctgggagacttcaaagaaggtttatacttatggcggcaggttctttccaagtttatgggctccctctaagg

SEQ ID NO: 541245 - DNA, 409 bp, Homo sapiens
  misc_feature (103)..(104): n is a, c, g, or t
  misc_feature (124)..(124): n is a, c, g, or t
  misc_feature (271)..(271): n is a, c, g, or t
  misc_feature (290)..(290): n is a, c, g, or t
  misc_feature (299)..(299): n is a, c, g, or t
  misc_feature (312)..(312): n is a, c, g, or t
  misc_feature (339)..(339): n is a, c, g, or t
  misc_feature (355)..(355): n is a, c, g, or t
  misc_feature (407)..(407): n is a, c, g, or t
cattttccttttcaggtatggcagtggatatcagaccgtggagagagaatggggttaacttttgaacaatctgaatccaatccttcctcaaggcccaacaacnnaaaaacaagtacctctttgnttggaagagttaaatttcttgcattcagtacactggccctcatcctcagaggtaacctctacatcggtatcatcacttaaggacttagaagtcctccaggtcatcattttttcccacttcaatcacctgatttgtctgtaaatcagntgagccattacttctaggngtataagtngctttctcaagtntccctaaaaaccaccaaggcaggccanctacatcccactcctnaaatccaaggtccagcctagatgtttcatctttgggctaaatttttcaattnaa

SEQ ID NO: 541246 - DNA, 129 bp, Homo sapiens
cagaggatccccatacagtagtatactagtgcatgaaccacataaaagctggtgcaaaatctgattttgagattaaattattacatagcagcttatcttctgtcaacattttaaagccaaaatcagttt

SEQ ID NO: 541247 - DNA, 869 bp, Homo sapiens
  misc_feature (239)..(239): n is a, c, g, or t
aagcggcacacacagcactcgaacacgggggcgaccagttatcacccacagcgcgtgtcaccactcggggaagaaggcgccgcctcgtgtgttgctgtaaaaaccggctgggaatcgcggtgcccgccgccgcggggtagccacgggccgtcggcacgggggtgctccagcgcaaggtggggtgtaccaaaggccccggacgggaccccgcaccagggggagtttccctgtcgaaagcngcggcacgtgcctaagaaaaaaggcgcttccgggcccaaccaccgtctgttttaatgtggggtaaacaccatttcgtggtttcaaaaacgctggtttgccgccggtcttcgatagaaaaatgggagtaagaaggaaatccccgcggaactcgcgccggttcgtgggagcaccccctcgcccccctgtacgcggggcgccaccccgtcttgctattatggcggacaattcttgccttgcgcccattttttcagacgaaagtgtctccacacgcctgtccctgagctatggggaaaaatgcttaaaagcttgcgtcccaaaccagtgtccctaggagtctgtcttctttatttgggccacacccccccgcgtgttgacgtgctcctcatggatgcttaccaacaggggggggggattatataaagaccccacgcgcacttttatgcgggggcccgggtctgctgatgtgacaccggccttgttctcccccccgtaggtttaccccctgccgaacgattagtccccgggctgtagttccgtcaccagtctaatacccggccgccatctgggggaaaaacacgtttataagggcccgggatagcaaaaaagaaaaatatgaatccttcataaca

SEQ ID NO: 541248 - DNA, 944 bp, Homo sapiens
cgggagagagcaggcgtggtaagggtgggagagaggacagaaagggagaggaacaggacggttacaggtggtgacactgggacgagctggggcaccaactggtagacgtgggggcagacgtggcaaccccgatgggaatgaagcgcactgcgggtatcaacgaaattcctgggaaggttgcataaacacaggcggcaagggatttttcctccgtgcaagcaaggcgggcctctgtaaacacccaaacggccagcgctggggttacaaccacgccgtcgcgggtggtggtggccacaggccccacaaaccgtgggggtacacccatgagcccgttactttaagccccgccgttaatgatcacacttccagtaggcccacgaatcaaaatatattctcaaggggggagaaaaatcacccccaacttttaaacgggcaaactttggttattaataaagaaccactatgggcaaggaggtcattaaactgaggtatattaccgctggacatgtattccccgctcccaggtatcggtcccgtagtaaagtgcccccacccttcattggatcgcgcgcactttcattgtggcgcctcaacagatgtcctccttaataacaaaatacgctctttcttagagcaaatactactagaacataaacaattgagaaacaataacgtgactcgtttacccctttttcaacacactttattacttcgggttgtagttacaacaggccgagtaaattcttttacatcaaaagcgtgcacctacgagtatattggtctgtcttcgcatgccccgcgctcgtatttcgtgtctgccactaaaaattccatgcatatggttacacgaccttttcttatttttacaatttgaaagttcgcctcaaaacgcctttttttaaaaaaaaaaacccaaatacaccaagctttttacaaacataaca

SEQ ID NO: 541249 - DNA, 792 bp, Homo sapiens
  misc_feature (107)..(107): n is a, c, g, or t
  misc_feature (196)..(196): n is a, c, g, or t
  misc_feature (459)..(459): n is a, c, g, or t
aagccagaactccacagggccacggctgggctgggaatggaagccgaggactcggcgcggaggcggctaccaagccggcgaagaatcggcgcctcctcctgtgaggncccggtggctggctcctggaaaggtgggtgagcgacaacggagagcaaccctcggagggcagcaaacagatggaccattaacatggttnaccagagttcctttaattgggcaaggttacaaccaaggtccagatggaaggggtaccagcaattcatgggtgcatcctctcccttccttcatggtggtcctggccattccattagacacaacagggaagagttgggaacatggaaccttcaacatctctttaacagcaacacgttggaatctaaacctctcatagcaaccaggagaggaccaggttaagggttaacaatgtgcaggttcaggacagcaacccagggtaccttnaccaagatttccatccagcaacattcccttataaaggaattccggaaggtggcctttaataacaatgcgcggaagcaatccaaagcgcatttccttcaatccaggtttcctgggagccagggaaactccatctctttccggcgcgcattaacaaggcatattgcgtgaactgggccaaaccttggagtggacgaatccttgggaaccatgattagcccagattggagagatctaacggcatcttgcttacctttaaggggtttcccaaattggcttatgtgataacttcagaataattgatgaccaatatggtccggagggagctcccctgtg

SEQ ID NO: 541250 - DNA, 116 bp, Homo sapiens
atgctttggggtaaaccatggcgtcggcgtcatcatcagaataagaataagcagcaattaacaggcaatacactgccacagtgaggcgggtgtcataccaggtcctggggacctgc

SEQ ID NO: 541251 - DNA, 351 bp, Homo sapiens
gtggagcgctgtgcctttgtcaagataccatctctgtttgatgatttctttctatgctgtttttctacaaaatgttagtaagctctgtcatgcttctagcaaattgtaagactaattatttgtttccacctcataacctgttgcaataaatattactgctcatacagtttaatattgttgtttgttggagaaatgaccgtaaacttgatttgctgttcagtttcaatgattcaggacacccattaaggtgcagttatggtataaataggggaatggcctgtaatgcttttgaggggtttgagggtcccagaggctactggaatggggcgtctcccattcgaccccccgaat

SEQ ID NO: 541252 - DNA, 222 bp, Homo sapiens
gcacaaggagggggggaaagatgtatcagcggctctgcgagcggctcagccagccccatggaactcctatcgtacttcaagcagccggtgatagccaccaggacggcggtgagggccgctgactgcctgcacgtggctctagacctgctgcagaggaagctgcggcccctgtggcgaaggccattcaagtgtcactgagtgtgctgcacgcccgcccagcct

SEQ ID NO: 541253 - DNA, 683 bp, Homo sapiens
agcgggagtggatgaggagtgagtggctgggctggtgctggcgtgctgtgtcagtacccgcgggtgactccccgtctcaccgcttcgcaggcagtaccagctcccgggccgggtgcctgaccgggactgcgggtcctcattgcgcgttcccctggggctccgtgaacctgagcagcaacctgattggcaacccgtgtgtagagggtatcgtgatacggcgcagcctgggccgtcgagccatcgtgcacgcagtattgaattcccactcttgaagcagaactgcaatgcgaacgagcatgtaagggctgtcgctcgtgcaagtcctcacgactcgatactcaatgtgtgtgaaatcacccattcgggagaaaccatgcactgtgcccgagtggactaggactgggacagagctgagacgagtgaaggcgctggtctcgtacttcactccgctggttgctgcgagttgacagcccaggatgggactctcgtcaataacgttgctttgaaagcacgccgtgactcaacttgtttcaactccttcgtaggtaggggcccccttatgtgacccagtggtgtatattacccggtccctttaaatctggtagtgacattgtgtgcttttggcacgtaaatcaagcgatattcgtagacaataaaagcaattatccaacgggcgaacaatc

SEQ ID NO: 541254 - DNA, 339 bp, Homo sapiens
taaaaatataccaaaattggaggcaggtgtggaagtcatacccgtaatgcaacactttgggaggctacaggcacgtaccaccacaaccggctaatttttgtttgtttgtgtgtgtgtgtgtgtgtgtgtgttttgtagagacagagtttcgtcatgttgcctaggctgttctcaagctcctgtgttcaaggaattcgcccacctcagccttccaaagtgctggcattacaggcgtgagccaccatgcccagctatttgtgtatctaagcatagaaaaggtacagtaaaaatatggtattatattcttgtgggaccacaatcattgaaccggatagcttg

SEQ ID NO: 541255 - DNA, 158 bp, Homo sapiens
tacatctatgcatcctcattttaaggactcctgtaacgttaacgtttaagtcggaaattgtagtctagcaattcacttatctgttatagttcattttgattatataaatcctatttctgaaggaatttttagccagtctgtatatggacctaccaaat

SEQ ID NO: 541256 - DNA, 354 bp, Homo sapiens
tagagatccccaggggggacagttcagttcatggcaaaactcgtaagcacattcagcactcacaatagtcatgcactcggataggcaaggtcatgcagaacagtcaagtaaaccatcttaaaagcccagctaatagggtaagtgccagcaaactatggcaggaatagccagcaatactttcccttcttccgcagacatggtagcatggtatcagtgaggaatcacgagaccggggctctagttccaagtcggcccttactagcacggtgtcacttcccctctcagaccctaaatatcacttgacagttaacaacgggacggcggggctacaaatgatctcccgtcgcttcctac

SEQ ID NO: 541257 - DNA, 392 bp, Homo sapiens
  misc_feature (264)..(264): n is a, c, g, or t
  misc_feature (285)..(285): n is a, c, g, or t
  misc_feature (329)..(329): n is a, c, g, or t
  misc_feature (378)..(378): n is a, c, g, or t
ctacctcctccatctccccgaccaagcaatcctcccatgtcagcctcctgagtagctaggactacaggcacaccaccatgcccagctaattttttaaatttttagcagagataaggggtcttgctatattgccctttctggtatcaaactcctcagttcaaacagtcctcctgcctcggctcccaaatttgctgggattgcaggcatgagccactgcgcccagccttgctattattcttttatctcaacccccaatggtgctgntctgtaactatgacagggagntttggcactggcattttttgaccttagctttagtaggtaggaantctgcagccataggttaacagaaaggcaccaattggactattccaaatnggagaattcataga

SEQ ID NO: 541258 - DNA, 200 bp, Homo sapiens
tattttctccagggaaaaacgatcgctatctttcaattgcataatacacatcgactaattcagcaggcaacactgactaatcaaactaacctcgaaacaaatgataaccatacacaacactaaaggacgaacctgatctcttatactagtatccttaatcattattattagccacaactaattatactctcggaccaatg

SEQ ID NO: 541259 - DNA, 150 bp, Homo sapiens
ccaagtttggggccaatgccatcctgggcgtgtccttggccgtgtgtaaggcgggagcagctgagaagggggtcccctgtaccccacaatgagatttggttgggacccctacctatactccagtgcacgcttcaatttaataacggggct

SEQ ID NO: 541260 - DNA, 524 bp, Homo sapiens
  misc_feature (3)..(3): n is a, c, g, or t
  misc_feature (70)..(70): n is a, c, g, or t
  misc_feature (151)..(151): n is a, c, g, or t
  misc_feature (185)..(185): n is a, c, g, or t
  misc_feature (195)..(195): n is a, c, g, or t
  misc_feature (203)..(204): n is a, c, g, or t
  misc_feature (242)..(242): n is a, c, g, or t
  misc_feature (301)..(301): n is a, c, g, or t
  misc_feature (306)..(306): n is a, c, g, or t
  misc_feature (310)..(310): n is a, c, g, or t
  misc_feature (321)..(321): n is a, c, g, or t
  misc_feature (328)..(328): n is a, c, g, or t
  misc_feature (343)..(343): n is a, c, g, or t
  misc_feature (354)..(355): n is a, c, g, or t
  misc_feature (358)..(358): n is a, c, g, or t
  misc_feature (502)..(502): n is a, c, g, or t
gcnggcatgggtgagtgggacccaggcctattacccggccagagggtttgggggcctctctcctgggggnctgctctttccacacgccgcctttgccagccagggctgtcttggacactccggggggtgggctgaggggcacatgattccngatttggtcttcttttgttttgttatttttacantggggtttcntggcctgnnttcccgggggtatgggttatttgcagtgctgttttttnttttagtcccggtttttgttcaaaaacaatgatactccccattgggctgtatttttgcncaagntacnaaagtgccttnacaggtncagttctgctggtcnatctgcttacnnaanggctccatggtgtcagctacgcccaccccactccggcccgatgtcattcgggtcacctcgctccaggtgtctgtatctgggtcgtaacactccacactgtccaggaacgtgtgaccatcatagcctccaaggacgtagattctnccctggtggacagtgatcccca

SEQ ID NO: 541261 - DNA, 279 bp, Homo sapiens
agggaagataaaaaaaaatcttcctagtctcaagtcttcaggcaagagcaatatgactcctgtgtttctgtagcctgctggaacatctaggcagaaagtggctgtactgccctgctaccaacattctccatggcgttgggagaggaacgaagtaccctgcagagaactgaatgtacacaggtagctgctgagatgtgtctagtctggggccacacagctgagcaggatcagttcagaaatgagggaaaaccgtggatgttcctttaaaaagcaaatcat

SEQ ID NO: 541262 - DNA, 524 bp, Homo sapiens
ggtacctgtctataaggagtcctgcttatcacaatgaatgttctcctgggcagcgttgtgatcttggccaccttcgtgactttatgcaatgcttcatgctatttcatacctaatgagggagttccaggagattcaaccaggaaatgcatggatctcaaaggaaacaaacacccaataaactcggagtggcagactgacaactgtgagacatgcactgtgctacgaaacagaaatttcatgttgcaccctgtgtttctacacctgtgggttatgacaaagacaatgccaaagaatcttcaagaaggaggactgcaagtatatcgtggtggagaagaaggacccaaaaaagacctgttctgtcagtgaatggataatctaatgtgcttctagtaggcacaggggctcccaggccaggcctcattctccttctggcctctaatagtcaatgattgtgtagccatgcctatcagtaaaacgattttgtgagcaaacactagaacctaaagcaagagcaaaggcgagat

SEQ ID NO: 541263 - DNA, 880 bp, Homo sapiens
ggtacctgtctataaggagtcctgcttatcacaatgaatgttctcctgggcagcgttgtgatcttggccaccttcgtgactttatgcaatgcttcatgctatttcatacctaatgagggagttccaggagattcaaccaggaaatgcatggatctcaaaggaaacaaacacccaataaactcggagtggcagactgacaactgtgagacatgcactgtgctacgaaacagaaatttcatgttgcaccctgtaagtctcaagccagtgctggccaagagggggacatagctgtcctctgaggaacagctactccctctgtgcaaaattccaatcttcaggggttaagtacggttcagttttcatagactttataatagagtagtttcagattcacagcaaaaactgagcagaggtaccagaaatttcccatgtgcctcctgccctcaaacatgcagactccctgttatcaacatcgtcccaccacaggggggtattctgtatgactgatgaactacctgtgcacatcattatcacctgggtccatagttcatgtagggcttcctcttggtgtgtggaatgggggtaagttcaggacctatttctttcttttaacacatgtgggcagtcacaatggtcagctgtaattccagcattgggggcgaggggggaccaggaggcgggacgaagcctcctaggaaagtggaaccggttctctaaaacaaaagaaaaaaaatgtggggcccgccgagaagttaaacctgggggggcgccaagaaaagaaagagcagagcaagaccggcagacaggggtcccaaaagccgggggtgacagcagctggttgtcgagaacacgcgcgacgcgaaacacacacgagccagcg

SEQ ID NO: 541264 - DNA, 1166 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 541265 - DNA, 456 bp, Homo sapiens
  misc_feature (22)..(22): n is a, c, g, or t
gctctaccgctatctccctcgnaatgaccttcttgatccaaatcagtcaggtttcaagactagtcattcaactgagactgctcttctctgtatcacggaggcgctccgcactgctaaagctaactctctctcctctgctctcatccttctagacctatcggctgccttcgatactgtgaaccatcagatcctcctctccaccctctccgagttgggcatctccggcgcggcccacgcttggattgcgtcctacctgacaggtcgctcctaccaggtggcgtggcgagaatctgtctcctcaccacgcgctctcaccactggtgtccctcagggctctgttctaggccctctcttattctcgctatacaccaagtcacttggctctgtcataacctcacatggtctctcctatcattgctatgtcgacgcggccgcgaatttagtagtagtaggcgg

SEQ ID NO: 541266 - DNA, 827 bp, Homo sapiens
ggtacctgtctataaggagtcctgcttatcacaatgaatgttctcctgggcagcgttgtgatcttggccaccttcgtgactttatgcaatgcttcatgctatttcatacctaatgagggagttccaggagattcaaccaggagtaagtcttggcttttcaatgtttattatgttattgcagcctggtagatggacctgtctgcagatgaaagcctttgtgtttctgtttgttgtttcttgttttttgagatagtcatgctctgtctcccaggctggagtgcagtggcaccatttcagctcactgcaaactcctcctcccgggttcaagcgattcacctgcctcagcctcccgagtggctgggattgcaggtgcgtgcccaccaggcccggctaattcttggtatttttatgtggagatgggttcaccatgttggccgggctggtctcgacctcaggtgatccgccgcctcagcctcccaaagtgctgggattgcaggccagcatacattacagtggggcgagccactgtgccggcccaggtagcttagtttcatctctatgaacactgaatgaagcacacagtacagccaacatatttgggggaaacttagaacacgtgccagaggaagtaacattagtcatactgctctaggtagacgacttccacagagcaggcttccgtttttccacacaaaaaaacaaaaaaatttggcggccggccgaatttaaaatttggggggccgggagaaagcgagtgccagaacgcgcaggtgtccaaaaccggcggtaaccgttgtgttttcgcctccctcccccgggacagaaaa

SEQ ID NO: 541267 - DNA, 369 bp, Homo sapiens
actgtttataggcatgaatcctttgtgcattagtacataagttggttcagtaaagcatttgtcatatgtcctttctatgccaatcactgtgctgccattggactgtaacagacacaaaaaataattcctctgctcatgagtttctagtttagacgagagaaatacaaacgaacagacaagcacaatataactacctctaactacggacgaaaacacgggtgcatcggtgtcacttggtgggacaccaggtcttgactgtgtgtggggtgggactaagggacctgctgacgacgaccgtacatttctaccctgagtaacgtaactctgagagacacgactgagacgtgctccagactacgggtgccggat

SEQ ID NO: 541268 - DNA, 1258 bp, Homo sapiens
gctcgaggttgcagtgactctttctgttcaggccagaaccctctgggatgcttctcagccattgtatccatcagtagtcaagtgaagtgcccgtgcagagtagctccctgagacggtggcctatgcccacgtcgtgcgctgtatctacgatggcgactgaagtgcttgacaggtgtgcaagctgcgccctgcggtggagtcctagatcagcatgcgaagatcgcttgtggtgccattatacgagtgagtaagactctaacacaatcagggcttgtggacaatgaacttgctgtactgagccccgtctggtgcaagtagctccgaggatatgccatgggcatcggtcagtggtctcggcgtggtcatggtaccgaggacatgcgtcggtccactatcgcgccttgttgacattcataggtgtgaggacttccatgtgccgacgtgggtgaaaactctagatgcccagatccgggcgtagggaccgggctggcagcatcccttcgaggagggcccctcttgactttgacagacgacgaaagtgcctacaagaggaaggcacattccacggagggtcagccaacgggggtgcactccgtttgagtgcgtggacaacctctggatttcgcctacgcggtattgctacgcgagcctgagagagcgtacctacgaacgacgagcggggaggtgcggaccaactgtctctatgaggccctaccacttgaagcgactctgtccgtgcatgattctaatcgtattcaggactttacatcctcttgccttggaaaaccgtaaattgcattgagttaccaaatttgccccctggtctacggcgactgcccatatccaaaaggcacgagatgatagaacttctacccttcccagtccggggggcttcagggagatgctcgcccaggggcaatggggagtggccaggtgcaggtacgaaggggaataccgtgtggaatgcccgatgtcaatgtcggccacacgcaacggggaacccccaggggagggaacgcaggacgcccggggacccccggaggcagcaacccggggggaaggccccggatcggaaccccgagcggaagacccgagtccggggtaggatgagcagagcccgccggaaaacctagagcagggagaacggagcagtggtgagcggtccgatgagtacagcaggcagggaacccgagtagccactgtagaacaaactacacaagctcaggagccactgtcaagcgggagtgacacgcacagg

SEQ ID NO: 541269 - DNA, 336 bp, Homo sapiens
  misc_feature (1)..(2): n is a, c, g, or t
  misc_feature (74)..(74): n is a, c, g, or t
nncagggcattcacatttatttctgagcatctgctaaacatcttcaaccacaaaggtaaagttgtttgaagaancgtttctgcaacacgatgtggtcataaagtacctagctatttcactgaggtcacttggcaacagtgtggtgactggtccttctggctgatgggggctccaagaactacttgttctcaattgtgcttatgtgtttcccagcttcttatccctgtccccccagcgggccaaggcagatggcacaggccctcaccccctgttagtggtgtagatagcgtccgcgcttgacgaaggcgcgccaagaacatacgccccgatgatgta

SEQ ID NO: 541270 - DNA, 1096 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgtatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 541271 - DNA, 901 bp, Homo sapiens
atgattgtggcctcattccttaagcacccccacacctggaaagcatatactatattacaaaatgacatttagctcaataggacttgattgaatataatgaagctttacagtattagatgatgtcatctgtcactatagggtcatacaatccattcttaaagtacttgtcattagttattattattactgttagtcttgctgccccagggtatcagtccttcaagggagccatcctgttgcagcgaccatggcagatggccgcctcagctttgagaggctcgtcccttcgaattaactctcgctggctcaggcatgccccgcacttctttgagctgaccttgaagagttctatgtgtagcctggatgtgacttagactcacctggtgtggatcatgtcgctatattgatctaagatggaagaagctgaaagaatagtgtgagggctaattctcatatacagtagactagcgctatcatacagtcaatgatacacttttagctcgcgtatgaagtgagaggaatggcgcgaggaatagaggctatagaaatgtcatgatgatcacgagggagtgtaaagtcagtaagatactttcaaggaggcttacattaaacaaatctggttttagagtagagtgagttggactgacctgctagaatacccattgttgctcaatgatcatgtggccaggtaaacagattatagttgaaatgacctatcaaggctagaccggcgggcaagttcattgaccctgttgaaagaaagatgctgaaccattgattgctagacaaagaagaattcgggtgccaatccgaaaaacctgaaaccatcgcgttgcgtcaccaatgacacacttaactcgattttccccagcaacacctccatgggaaggggaaaataaca

SEQ ID NO: 541272 - DNA, 1023 bp, Homo sapiens
  misc_feature (1023)..(1023): n is a, c, g, or t
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgtggcttcttggtgtgaacttgatggaagggaatggattccagcgttctttgtggggggaggtcaagtaaacaattgctgggggaagtaaaaaagaaatggctatagggaagn

SEQ ID NO: 541273 - DNA, 1021 bp, Homo sapiens
  misc_feature (325)..(325): n is a, c, g, or t
  misc_feature (432)..(433): n is a, c, g, or t
  misc_feature (436)..(436): n is a, c, g, or t
  misc_feature (438)..(439): n is a, c, g, or t
  misc_feature (443)..(444): n is a, c, g, or t
  misc_feature (446)..(447): n is a, c, g, or t
  misc_feature (480)..(480): n is a, c, g, or t
  misc_feature (485)..(485): n is a, c, g, or t
  misc_feature (491)..(491): n is a, c, g, or t
  misc_feature (499)..(501): n is a, c, g, or t
  misc_feature (503)..(503): n is a, c, g, or t
  misc_feature (517)..(517): n is a, c, g, or t
  misc_feature (521)..(521): n is a, c, g, or t
  misc_feature (529)..(529): n is a, c, g, or t
  misc_feature (545)..(545): n is a, c, g, or t
  misc_feature (548)..(548): n is a, c, g, or t
  misc_feature (556)..(556): n is a, c, g, or t
  misc_feature (571)..(571): n is a, c, g, or t
  misc_feature (573)..(573): n is a, c, g, or t
ccaggctggtacgggcggagatgtacggatggttgccggaagaagtggcgaagttacttttgagggtatttgagtagcggcggtgtgtcagggctaaagaggaggacgaagaaaagcagagcaagggaacccaggtcaacaggagtagttcactccgcgagaggccgtccacgagacccccgcgcgcagccatgagccccgctcccccgctgttgcttggagaaggggcgggacctggagagaggctgctccgtgaccccaccatgtcctctcctaccacgagttccctggatacccccctgctctggaaatggcccccctcagnctggcgccccttcttcttcacccactgtaaaggaggagggtccggagccgtggcccggggggtcctggacccatgatgtcccagaggcactgatgtaggccagtctnnagncnntgcnngnnacagactgggtcatcccagatcccgaagagganccacnagcgcnagcgatannnangggcccagccccgnaagnatgctcgngccacgagctttgccngtngtctgtgngggacaaggcctccngncttccacctacaaccgtgctcgagctgcgcataggctcgcaaggtgcttcttccgtgcgcgcagggtgcgtcctgctcggtggggccatggcggctcatgcctgcccgtgggtcggcggcgaccctgccgacattggacccctttcatcgcttgcgccgtagtgccccatcgagttgcccggccttgcgtcacatgttgccacggacgtgcccgcggacttgacccggttgcgggatgccgctcccttttccgtgcctgcatcccgtagtccgggacgcagcgacccgatttcgccgtgactgacacgcccgcgccgacggttcgccagctccccaggtcgcctagtcccctcgtgtgggccgcctgggccagcatcgcgcttctgccctctggtggcctgcggggcttcccctgccctgcctctcgcggccctcccgccctggcgtc

SEQ ID NO: 541274 - DNA, 669 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgagggaaccgcgaaggaaacctttttccggaattccccttgggggggaaaaaaaagg

SEQ ID NO: 541275 - DNA, 923 bp, Homo sapiens
  misc_feature (325)..(325): n is a, c, g, or t
  misc_feature (432)..(433): n is a, c, g, or t
  misc_feature (436)..(436): n is a, c, g, or t
  misc_feature (438)..(439): n is a, c, g, or t
  misc_feature (443)..(444): n is a, c, g, or t
  misc_feature (446)..(447): n is a, c, g, or t
  misc_feature (480)..(480): n is a, c, g, or t
  misc_feature (485)..(485): n is a, c, g, or t
  misc_feature (491)..(491): n is a, c, g, or t
  misc_feature (499)..(501): n is a, c, g, or t
  misc_feature (503)..(503): n is a, c, g, or t
  misc_feature (517)..(517): n is a, c, g, or t
  misc_feature (521)..(521): n is a, c, g, or t
  misc_feature (529)..(529): n is a, c, g, or t
  misc_feature (545)..(545): n is a, c, g, or t
  misc_feature (548)..(548): n is a, c, g, or t
  misc_feature (556)..(556): n is a, c, g, or t
  misc_feature (571)..(571): n is a, c, g, or t
  misc_feature (573)..(573): n is a, c, g, or t
  misc_feature (653)..(653): n is a, c, g, or t
ccaggctggtacgggcggagatgtacggatggttgccggaagaagtggcgaagttacttttgagggtatttgagtagcggcggtgtgtcagggctaaagaggaggacgaagaaaagcagagcaagggaacccaggtcaacaggagtagttcactccgcgagaggccgtccacgagacccccgcgcgcagccatgagccccgctcccccgctgttgcttggagaaggggcgggacctggagagaggctgctccgtgaccccaccatgtcctctcctaccacgagttccctggatacccccctgctctggaaatggcccccctcagnctggcgccccttcttcttcacccactgtaaaggaggagggtccggagccgtggcccggggggtcctggacccatgatgtcccagaggcactgatgtaggccagtctnnagncnntgcnngnnacagactgggtcatcccagatcccgaagagganccacnagcgcnagcgatannnangggcccagccccgnaagnatgctcgngccacgagctttgccngtngtctgtgngggacaaggcctccngncttccagtacattacgtgctcagtctgctaaggctgcaacgggcttcattccgtgctgcagttgtgcgctgccgtgtgtnggggccatgagtcgctattgcctgctcggggctggggtggaatcctgtcctgtatggactgctttcatgcggcgcaagtgccggcagtgccgtctgcgcacttgcttggccggcagggatgagggaacagtgcgtcctttctgaagaaacgactccggaagaagaagaatcggaaacaacagcagcaggagtcacagatcacagtcgcagtcacctgttgggggcccgcagggcaagcagcaagctcagcctctgggcctggggattccc

SEQ ID NO: 541276 - DNA, 334 bp, Homo sapiens
  misc_feature (22)..(22): n is a, c, g, or t
ctggagtacattggtacccacntttgtgtgggaggcctaggtctttgacagtgttctggggcaatttgtgactagaattagtggactaacagttccagtctttgtcacacaccaaagtcctttcaagtgactggcaccacaaggtgaccaaacagtatttgaccagtcgacgcgccaccaacacctaacaagctgttacctgaaagtgcttattaccagcattgactgtaatgtgttttaccccatctagtcatccccaggatacaatactcccaggccatccaacttcttgttagcagttggcttgctacccccaagccccagtagaaaccac

SEQ ID NO: 541277 - DNA, 1573 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaaaaaaaaaaaaaaaaaaaaaaaaaaacaacttgttgggcggcctttggcgtgtgaaaaagtttttttaaaccattgtgggtttggtgggcgcgggggccgccagattgggttaggttgaacacggttggggtcaataagggtgtggttccctaagagagaactctgggggtaaagtaagcttaggttcgttgggagttttttcaaccaatgtataaaagaaaacgcgccggggggggaaaaaaccagagaacgtgtgttcttgagaaacaatttcccaggaatgggagtatcagcgaggggagcaatcatcaagcggggtgattttttattaaaaacggggggattgtacgaaaaggacagagcgttcgagatattaaaattttaagcgcccgcggcagtggtggaag

SEQ ID NO: 541278 - DNA, 437 bp, Homo sapiens
  misc_feature (410)..(410): n is a, c, g, or t
atacggcctttggcgggcagttgccgccagtagcgccaggccggtgggcgcgccagttcttcgtcagtctgttggtcgaaggtgcgcacctcgatcaagcgcgggtccatccattcattgagcagcttgacggtttcgcccttgccggccccttcaatgccgttgatcaggatgatcaccgggaagcgcttctgctgttgcagctcatactgcacttccagcaaggcttcgcgcagcgccggcacctcggcgtcataggtgtctttgtcaatggcgtgaccgatttcggcggattcgaacatgggcagctccgtttcaagatggctcaagactagcggattgggcagcacgccggtcaaggaattccaaccggcttgccgtggatcaatccgcgcggccaaagactaatncccgggcacgtggcaaatgcccagctc

SEQ ID NO: 541279 - DNA, 1591 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaactttttaatctgtctggttttctttttttctctagagacggagtcttgcactccagcctaggggacagagtgagactctgtctgaaaaaaaaaaaagaaaagaaaaaaaatgtaagacagtgattcagaaagcaagctctggagccaaatagcctagtctgagtcctgacccctatgcttagctagctgtgtaacattgattgttttaccgagcctctctgtgcctccgttttcctcatcataaaaatgtggtaatattggaggggggtgtggaattactgtttaatggtacagagtttctgttttgggtgatgataatgttttgaaggctgggcgtggtggctcactcttgtaatcctagcactttgggaggccgatgcaggtggattgcttgagcccaggagttcaagacctgggcagcgtgg

SEQ ID NO: 541280 - DNA, 526 bp, Homo sapiens
  misc_feature (16)..(16): n is a, c, g, or t
aaggaaatttaccccncaatatatttatttgacgtattttgaaatggccctacaaagctgtctcttgtgggggaaactgcattctgtagagaatctccttctcttattaggtcttttctggagagtctgacaccttttaaggcctaaaaagaaaaattcatcatctgttctctctgaagcctgctacctggaggcttcatctacatgacttaagccaagcctcccttactttaacttaagctgacttcatcttttcaggtaaagtttaactctctcaaccaattgccagtcaggaactctttgatctacctctgacctggaaacccccatcttcaagatgtcctgcctttccaggccaaaccagtgtataccttacatgtattgatttatggctttgcctggaccttctgtctccctcaaatgtataaaactgtaacccgactacctcgggcacatgttctaagaacctcctgaggccccatcctgggctttgaaccttggcaaaataaacctataaatgtattga

SEQ ID NO: 541281 - DNA, 1038 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttcccttttacattacaaagtttcctacacaagaagccgggtcctctagagcgccgcgaggggg

SEQ ID NO: 541282 - DNA, 1091 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 541283 - DNA, 713 bp, Homo sapiens
cttttctggaggcagctgaagactgacgctgccctagtcacctcggaagccccgtagaccatcagggacaccgagctttaggtaactctcacagtagagggatggtagagagcggtctacagcctgagacccatcaccagctattgcaacagaggctactctttggttttcaagaaagagtgtggctgcgcgtggtggctcatgcctgtcatcccaacactttgggacaccgaggcgggaggatcacgaggtcaggagttcaagaccagcatggacaacctggtgaaacctcatctctactaaaaatacaaaaattagctgggcatggtggtgcgtgcctgtaatcccagctactcaggaggctgaggcaggagaattgtttgaaccgggacccaagaggtgaggttgcagtgaaccaaggtcatgccacagcactccagcctgggctgcagagcaagactccatcacaaaaaaaaaaaaagtgtagtttaattgtatgtataattgggctcaaagaaaaataaaggcatttccctctagcaccaccagattttcttctctctgtaccttatgatgcaaatttggctattggattttcacctgagttgttccctttaatgtgcaaatttaaggctatttagctgacaattgcctaggatggtgaaagaggttatcaagaatctgaaaagtctaagatagaacacaaaaaacag

SEQ ID NO: 541284 - DNA, 942 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggcgtgctcctcaagctgcgcatggcgcagcaccttcaggctgccgtggcctttgtggagcaagggcacgtacgcgtgggccctgacgtggttaccgaccccgccttccttgtcacgcgcagcatggaggactttgtcacttgggtggactcgtccaagatcaagcggcacgtgctagagtacaatgaggagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 541285 - DNA, 979 bp, Homo sapiens
agcggaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgctgcggcgttaccggctgcagcggcgggaggactacacgcgctacaaccagctgagccgtgccgtgcgtgagctggcgcggcgcctgcgcgacctgcccgaacgcgaccagttccgcgtgcgcgcttcggccgcgctgctggacaagctgtatgctctcggcttggtgcccacgcgcggttcgctggagctctgcgacttcgtcacggcctcgtccttctgccgccgccgcctccccaccagcgcgatgacttcgatctggaagcctagcggatctcccactttgcatggctgtcttttacagatgggaaaactgaggcctgatgctggagattctatgagggtgctctcctcaagggtatcagacggtcgtaggttcttaagaatttgattcatcagtggcaggccatgcatagagccacgggaggtgcgtccttgttttccaggaaatgttcttagaacttggactactgattattaattgactgtgccttgggaaacagtgggaagtaacttggtgcagcactggggtattgttggcttcttgtgttggaaactttgtaatgtaaaaggaaaaactggaaatccccacgccctgtttccctttatcgtcttgtggttggactggttcaattcgtttaactcgaattcttgctcctggccgtggttaagctgtgtacagatgatggagagtttggcctcaagtttttataaactgagcgagactagtgttcaggatctcctcccttgtttaaatgtcaataaatgccccaactgctttgtaagtgcaa

SEQ ID NO: 541286 - DNA, 382 bp, Homo sapiens
cgcgtcgactagctttgaggatttcgttgcaaacgggatatcttcatataaaatctagacagaagcattctcagaaacttctttgtgctgtatgtcctcaattaacagagttgaaccattgcttggatacagcattttggaaacattccttgagtagaatctgcaagttgatatttagatagatttgaagatttcgttggaaaagggaatatctccatataaaatctagagggaagcattctcagaaactgctttgtgatgtttccattcaagtcacagagttgaatattcccttttatagagcacgtttgaaacactctttctgcactatctggaagtggacatttcgagcgctttgaggcctatggtgaaaaaggaaata

SEQ ID NO: 541287 - DNA, 809 bp, Homo sapiens
gaggctttcattgcacacctgctggctaatgcctgccgccacttgctacatgaaactgacctcccaagactgtctgctggtgacccccgtccgctgcggtaccctgcctgattgtggcctccatgacatgcctgacagcaaatggctgcactggctgctgtgctggatctgagcgctggcagtgctgacggtgcactgctgcgtgagtctggtatgactgagaatgctgcgaatcctcaccaagatgcagtttatgaagtacatggtttacccgcatgaccttctgcgctgaattgcctgaccgctgtgtaccagtacttcaccaatgacctgtgttccattgtctgggtcttgcctgcctgccccccagctggatgccctgatggccctggagccctgaagccctgaaccttgaaccttgctgcttgggacctcgctgggctgcttgctgttgctggtctgccttgctgaccttgccttgcttgcatgttgagcgacttcgtaccttgctggtgccgcatgtgtggtgctgttgcaccgtttacgattgatgagcgattgtcatatctttgcccttccttggatcatgcttggttgtcaaaccctcggtggccctccatcagcccacaatgaatccgtgccttggcccgagtggccgcccttcgattatagattgcccagttcatttttcactggggtgctgttggtgacagaagttattccctccgggggtcatcggagatgtcctattgatgacttgcgatccagatagatgataaacgaacaagccaggatcgatatcaagcaac

SEQ ID NO: 541288 - DNA, 339 bp, Homo sapiens
gcactagcatgattgaatacattcctgggcaagagatctgtccgcgtcccagtaagcgagattccttcatctataaaatgttaacacagtgtgtctaaaatgtcgatgtactcgagtgactttacctgagatcattgccaaatctcaaatcaacatccttatggtcattgttgccagaatctcatttattgtgtacagtaaacccaagaggaggcatttagttctatgcttgatcacatgaaaaaatcatacacatgccaacagagcacataattcccccttacaccataaatacaatcacagcacacctaaaaatctccgtaatttcttccttattga

SEQ ID NO: 541289 - DNA, 421 bp, Homo sapiens
ggtagactacatggcgtcgtgagataatatatctattcatacaaagtgattctacttgtagaagaaaataaaccagaagacatgaaataaaccacagctacttgcatcagactaattcaatttattaactcagttcttagctttagttcacatggcagactacgttgcatgtgttaggtctactggcaggtagacctaacccaggtggtgtgtggtggcttggtatgtgctttctcgtgtaacatcgcgccatcattggtatatggttagtgtgtaggttagtaggcctagtatgaggagcgtaatggagtggaagtgaaatcacatggctaggccagaggtcattaggagggctgagagggcccctgttaggtctacctggcagcttaaaactcaaagtgactggcggtgcttcatatcc

SEQ ID NO: 541290 - DNA, 88 bp, Homo sapiens
ttttcttgtcattgctggtcaggattactaatatttgggagggctttaaagacgcatgttgtggtgctaatgtactttcacttttaaa

SEQ ID NO: 541291 - DNA, 110 bp, Homo sapiens
gtagtgaattctcttatggctttgtaacaggctttaactagatatcagactttaccacattcttcacatttatagggcttctctcccaggaaaatccgtcgaatacgaga

SEQ ID NO: 541292 - DNA, 340 bp, Homo sapiens
aaaggcccaaaaaaagaaaccaaggacagatgcggactcctgccaactacacgaatccagaacacgtcagagacgcacacgtcaccgacacgcatacccccagccacagcatcatgagcggaatgagtcgaccctgcgggccgctggccctctgcccacgaggctgacagacacccgcgccacaccaccccgccaccccaccgaccaagcgcctgaccccacgagcccaacaccaggcccaaggcatctgcatacagcaaccaacccacacgagaggcggcccgacaacgagaaaccatcgcacacaccacaccgcacgcgaacaccacaccaccccccc

SEQ ID NO: 541293 - DNA, 136 bp, Homo sapiens
gctctcagcaggctcccccatgggtgctccatccccccaggcaagcagcatcatttcaaccagggcagcaaacagaggcaggtgcagcagcatcggcagcaagcaggtggcaaatcatatggagcattgcaggttg

SEQ ID NO: 541294 - DNA, 329 bp, Homo sapiens
gcattagacttcaggttctttagcttttaactattggacttagaccagtggcttccatgggccacaagctgaaggctacactatcggcttccctacttttgaggttttgggacttggactgagccactactggtttccttgctcctcagcttgcagatggcctatcgtgggacttcacctcctgatgatgtgagtcagttccccctaataaactccctttcatatatatgtgtgtgtgtgtttgtatatatatttatgtgtgtgtatatatacacacacacacacacacatacatacatatgtatatgtattctattggttttgtccct

SEQ ID NO: 541295 - DNA, 146 bp, Homo sapiens
ttacactctgcgcaatggcccctacatcatgaagaaatggggatattactgttttccttacgagaacagagagaggaccatacctctccaggagctcaacgagtggtctttcttgtttataggtattaggactcccacatctctac

SEQ ID NO: 541296 - DNA, 652 bp, Homo sapiens
tgggagacggattctcactttgtcgcccaggctggattacaggggcccaatctcggctcactgaaacctcaatctctggggttcaggcaattctcccgcctaaccctcccgagattagctgggcactacagtgttgtgcaccaccacgcccagataatatcaggtaatatatctgagtaaaacgatgggtgttaacaccaatgtaagcccaaggctggccttggaactcctgaaaatacacagtagattcttcaccgctctatgacctcatacaaaagatgcccggaatacacaggcgcgtcgatgcccaccggaagccccaggccacaaacctcgataagaacacaagacaacaaacaaggaaggctaacacaccacaaccaaagaggtaagaaacgccacaacgtagactcaacaagcacaggaccctacaacccgcaattgaaacaaaacagccgcgccactaccaaggcgaccccatatagcacggctagaaaccccattcgcaccataaaaaagcacaaacatgacaagcgcaaaaaagagaaaaggcaaaaaacacgaggcaaacccaagaacccagaacccatccaccaaacatcggccatacacaccgaccactaggaacccacaacaaaaggaccaacacaac

SEQ ID NO: 541297 - DNA, 242 bp, Homo sapiens
taatcgagctcgcccaattatgtgactcaagcgaaagatccaagggcctgacttctccccaacgtgcgtcacgcttgagtgaggtctgggcaattggaaagttccgggcgacggcgtgtggaccatcgaccgagtctcatctggccttcaccgtgtgttgggtggggagaaggccactcggctgtcctggtaggtcaggccaccccgggcctgcccctgtcgcccggccacagtaaagcccc

SEQ ID NO: 541298 - DNA, 3051 bp, Homo sapiens
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagttaaaaaaaaaaa

SEQ ID NO: 541299 - DNA, 374 bp, Homo sapiens
gtcactctttgttcgaataaatgctgctcatggattctcccttattcaggtgggacaaccacaaaggttaccatgagggaaatctaactgagggcagtgaggcgaaggaaaaggatccctaaaaggtttcaggccctcagtaccgcctggagaggcagagcaggcccaatgtcgccgtttgacctggcagcactttggggagccagagcgcatggaggtcttcctggtccgcggacagttcagggcagacggggttttttaggaggattcgaaatttgcaatgccacagttcaggatatcttagcagcaccattcaagtatcaagtagcatatcacgactcgattcaacgacgtcagctaggattttgggaaag

SEQ ID NO: 541300 - DNA, 2993 bp, Homo sapiens
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagttaaaaaaaaaaa

SEQ ID NO: 541301 - DNA, 3459 bp, Homo sapiens
  misc_feature (1412)..(1412): n is a, c, g, or t
  misc_feature (1415)..(1415): n is a, c, g, or t
  misc_feature (1427)..(1427): n is a, c, g, or t
  misc_feature (1438)..(1438): n is a, c, g, or t
  misc_feature (1528)..(1528): n is a, c, g, or t
  misc_feature (1645)..(1645): n is a, c, g, or t
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggttagtatttaatttaattactatgtaaacatctgaatttaatgtatcctancantagtggaagcantaacatgtatngtgtcttcatgtatgtctatatgacttaggaaatatcacttaaattgataccctttccaagtgatttgtggtctttcttttttacttttnatcctttcttgaattcattatataagaaaattctctccattgagatagtgcatgtttagataatgttaaggataacatatttattatatttatatctatttttaactcttagaaatnggtggttaatgtgtttttaattaacctgataaaaatgtgtaagcttgaataattttgtgtaaaagtttttcttaccctatagcagaattagcagcaaatattgacatttcatttctttattaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagttaaaaaaaaaaa

SEQ ID NO: 541302 - DNA, 1026 bp, Homo sapiens
tatccagttcttactgacagtttcttaattacatcattacatcggtttttcatgtatttatgataataccatgctgttccagtaagaaatagaacaaatcatagttacttaaactctttaaaaataaatagctatttattcctctgaaaagtattttaaggttgggggcctttatacataaatgcaacttttgagattacctttttttcttgtgtgtgtgttttaggttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaatgtaaagagttaaaaaaaaaaa

SEQ ID NO: 541303 - DNA, 2345 bp, Homo sapiens
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttgggtaagaaactcatcatttggaaactgtagtgtttccatttgctttcattgcagtttgtgcttttgctcttacattttgaaattttttatgtttgttgtaatacaatgtttaataaggttatctattgaccagttaaaagaaaataaaacataaacatcattctaaaa

SEQ ID NO: 541304 - DNA, 239 bp, Homo sapiens
tggggtgactctgaggatcctggcgtacggacgctaggctcacgcgctcttcagaaaacccggcagcgccgatgcaagtgagtacacctacctcacttgcctaagcggtgccccatgttcaatacccgcctgaagcaggagctgaccgctctgcgcgaagaattgtcgagcttgctccaggtgaaagagagcctggaaagcgaaatgctctgcctgacactggaccgcgtccgtagcgg

SEQ ID NO: 541305 - DNA, 220 bp, Homo sapiens
aagactgggtttcgccatgttggccaggctggcctaaaactcctagcctcaggtgattcacccacctcagcctcccaaagtgctgggattacagacatgagccaccacactggcctaaaacttaggtgtaatggcattataagtctagctttattaatgctgggacattagtcgcttttaaaattacctcttaactctgctttaattggctcccagaaat

SEQ ID NO: 541306 - DNA, 1990 bp, Homo sapiens
  misc_feature (1934)..(1934): n is a, c, g, or t
  misc_feature (1947)..(1948): n is a, c, g, or t
  misc_feature (1971)..(1971): n is a, c, g, or t
  misc_feature (1975)..(1976): n is a, c, g, or t
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaanctgtttttttcanngatgtgattctgtcaggaaaaangttnnttgtgtttaaaaaa

SEQ ID NO: 541307 - DNA, 406 bp, Homo sapiens
cactggacatggtagccatcagaaaaactaagcttgttggataatgagacatggttagcaaagcttgacatttgaaggcacggcctgtaacatagactaggtagatgtcgtttagttctggatcttttgcccacaaagccttggtatgcaaaaacctgcaaggcacagctaagatgttagggcatggtataaataccctagatactttagaggagtcttatgggtagaggtagtttgggctccctcctctaaacatcccttgttgttaaatgtgtatcaaacactctggagcatgaaaacacaggtaaactgagtcctaattggtacatttgccgtcttgtatttttgctttccttatgaaggtgttaactggggagagttgtgaggcttcttaaccaaagcactt

SEQ ID NO: 541308 - DNA, 2084 bp, Homo sapiens
  misc_feature (2028)..(2028): n is a, c, g, or t
  misc_feature (2041)..(2042): n is a, c, g, or t
  misc_feature (2065)..(2065): n is a, c, g, or t
  misc_feature (2069)..(2070): n is a, c, g, or t
ggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaagtaggttatagctttatgcgtagtttctgctcttattaatgtcctttttcacattgactcagttaatttatttgagtttttcttccttaaatagtgtagaaaaactacaagtcctgttaaattgcatgacagagatttactatcagttcaaaaaagacaaagcagaacgtagtaagtaaaatttgctatttgttaatttaataaatccctcttagtaattagttataattcagttaaattaatttggtatatctgtaagggtagcttcttaanctgtttttttcanngatgtgattctgtcaggaaaaangttnnttgtgtttaaaaaa

SEQ ID NO: 541309 - DNA, 612 bp, Homo sapiens
gcgtcttcacccatcatgagcagaggtgaggagaggcagctgggaatatggagacagtgaaggacaggcctgagagcacaggtcctacctgggcattcagcagaggagccctaaagtcaggagcacccaagaagaggggagggcagcagcctccattgacggcgagcctccagccctctcctactttgatcaccatttctctccaggctttctgcctccgagatgtggcaccatagtgcggtgccctgtggcctcaccgccctacttccacctccgcccagcctgtaatgtttatataagcagcctcaaggaccaagaaccatctgcgaaaggacacacacaggaaattcataaaagaaatctgaatggataaaaccatgaaaaaaagtatgcttcattagtaattaaagaaaggcaaatagagctggaaggcatttttcccttagcaaaccataacagaaaaaaataagacccaatattggcaaagagactactgaaaaaacattcccatacattgcgtgtgggagtatacatcggtgcaggcttcctggatgacagttgggtgatatgtgtcatgtgtgctaaaagcctcatgtcatttgcctacgaatt

SEQ ID NO: 541310 - DNA, 259 bp, Homo sapiens
  misc_feature (12)..(12): n is a, c, g, or t
  misc_feature (146)..(147): n is a, c, g, or t
  misc_feature (214)..(214): n is a, c, g, or t
  misc_feature (245)..(245): n is a, c, g, or t
cacatgcctgtngtcccagctactcagaaggctgaggcaggagaatagcttgaacccgggaggcggaggttgcagcgagccgagatcgtgccactgcactccagtctggtgacagagcgagactccgtctcaaaaaacaaacaaanncaaatggcaactgctatttttattattcttctattctaagacaactattattattattctcctcctnttccctcaacatcaaatcttgtcaatttctncttctaaacaactg

SEQ ID NO: 541311 - DNA, 255 bp, Homo sapiens
cagaggttgcagtgagctgagatcacgccattgcactctagcctggcaacaagagcgaactccgtctaacacaccaccaaaaggtttggtatgtttctctcaagaaaaaggcatggtgagtccagacagcagcaaaagcttttgtgaaaccaattgtgttcatctagatagtaagtactcctatttttactgttaattttttaaagagaatttttccccgtggaactcctgttagtacgtcccagggagaaagcc

SEQ ID NO: 541312 - DNA, 141 bp, Homo sapiens
attatactgcatacgctgcgtatatcatctcgtcgcctgtcgccctgcccgcctcctcgatgatgctggccttctggcgctcagtgcggcctccgccgaccagagcatcgtcatttacaactgcccaacatgacaacctgg

SEQ ID NO: 541313 - DNA, 452 bp, Homo sapiens
acttttccacgttccggtctccggctgagaacgccgatagagttgcgtagtaaggacgatccttgggcgccgcgggagagccgacgctctccaatgggaaaaacgacgactgctttcaagtgtctgatcggggattccggagtgggaagactggtcctttttcgtttttgatgagcttcaatactacctttatttccaccataggagcaaaactaatctcgaaagataaatgaagtttccaggaaaaaactgggatagagaggatttcgaagtagcatatgctaaacgaagacatgagaaaacatgatgatcagggatgtcatgtagactaagactttgatataagaggcattttcacaattttatctgaaagcatagagaaacaaatcaacttgtcattttcaaaaacttaccctggctgtaatctcaataaaggactctttaaaagtcaa

SEQ ID NO: 541314 - DNA, 125 bp, Homo sapiens
  misc_feature (119)..(119): n is a, c, g, or t
gtggtgtgtcatgcagcacctgattgcccgtgagagaggctgcatctaccctcaaaggtatgtctgaggatctatgctgaggagttggcagtgcttcattcaaaacactaaaaacaatntgtttt

SEQ ID NO: 541315 - DNA, 476 bp, Homo sapiens
agacggggtatcactatgttggccaggctggatatagaactcatgacctcatggtccgcccacctcaacctcccacagctgctgagattatagagcgtgagccaccgcgcccggccactcttgcttcattcttgttagggctccgatactacattagatacctttctgcttgtggtgtgactgtcttgtaacatgacatatgacactcagcatactttccatatttgatatacgggatacagcatggcatgggcacacgtacaggtcctcaggcatgattacacttagcttacgctccagagcaaggagcaactcttatcactgttgggacatgtagaaaggcgaagccactatgaaaaacagtctgcaggttcctgaaaaaatctcacaatagaactgcatagatgatccagaaatcccacttctggatttatatccacaataatagacaactcaggatcttggaacgctatctg

SEQ ID NO: 541316 - DNA, 458 bp, Homo sapiens
  misc_feature (278)..(278): n is a, c, g, or t
accactgttggtcttgcccttgaggtaactccaggctgtcgagagaatgagtagaaagcaccaggactgtcagccgcaaagggattgtcatccctgctcctgggccaggtggactccatccttggccacctgcttggggcagttgtacagtgtgctgccagtgcgagtcagtgcaggcacaaatgcaacatctagtccacggtgaaccgaggtgcaggcctacccctagtgaaataaatgccacatagttggtgggagtgcgtgacttaaattttttnttaacttggtgtggatccatgtcaactaaaggggcgagggaagtgcggtgtgcttgtctgtgggaagtctctgtggcgtgtgatccgggagccagaattgacttcagaaggaggtggtgtgatgtgatggtcagagagacctgggatttggttccagctctggttgttaattcttctgta

SEQ ID NO: 541317 - DNA, 270 bp, Homo sapiens
aatgagctgaggcagatgttcccacagtgtaccagagccctggtgctatagtctctgagcacctctaaggaaagagcaccttctgtggacatgtgctgtagggcaggagctatagacaccaaggggaaggcgccataccggggctgttccccgaggaggaagggaaggggctctgtgtgtcccccaggaggaagaggccctgagtccctggggatcagacacccccttcacgtgttatattccacacaaaatgcgagctcgtcataacgg

SEQ ID NO: 541318 - DNA, 476 bp, Homo sapiens
  misc_feature (3)..(3): n is a, c, g, or t
  misc_feature (127)..(127): n is a, c, g, or t
  misc_feature (178)..(181): n is a, c, g, or t
  misc_feature (268)..(268): n is a, c, g, or t
  misc_feature (295)..(297): n is a, c, g, or t
  misc_feature (310)..(311): n is a, c, g, or t
  misc_feature (334)..(334): n is a, c, g, or t
  misc_feature (338)..(338): n is a, c, g, or t
  misc_feature (345)..(345): n is a, c, g, or t
  misc_feature (366)..(366): n is a, c, g, or t
  misc_feature (456)..(456): n is a, c, g, or t
tgntttccttccgtgttcttttaattatgcttgggttgttcatgataatttcataagtcattaaacaaagctagccatcatctcaagttatttccctgttaactatttttacagcccatgcatgttnggcaagtatcaaaaaaaaaaaaaaaaatccccaaggcgaaaatcctaaaannnngttaattacttgggtttttgttttactgctgtgcttgatttacatgaagtattgaataccaggccattcttttttcctgcatctttnctttttcttttgttctttggttgcctnnncctttttaattcnntttccgtgggtgtggccaaaatnatgnaggctanccgcgggtgacttttcaaatnttgggatgtggaccgtttctgcccttttccagagtaaaatgggtcccccctttgtctaaggggccccttctgcgcgctgtggtcaaaggngttccctttgggttttcccc

SEQ ID NO: 541319 - DNA, 631 bp, Homo sapiens
  misc_feature (262)..(262): n is a, c, g, or t
tggagtcgtatgcctcgtcgttatctgtgctatttataattctttgcccgcgtgattaggtctgggagaagtgtcaaaatactttcttccccattctcatgaggaaagggacccttgtggaaaataatgaagctgcaagaccccgaggttggccgtatcttctttcagattatcaagaaacagacctgtgatgcctgggagacgggggctgattcaattggagtgtgctttccttttggaaaaaaatgtgattcagtccctngtgggactgcccaaattggcccttgacaaaaatgacccccatttgtgtgatttcatttaaacccatttcctgaatgagcaggtgaaacccatcaaaaaattgggtgcccccgtgcccaacttgggcaaaatgggagggcccgattttggcttgggggaatttttttttgccaagccccccctgggagccagttttaattaaagttaacccccgggttaatttccccaaaaccgtggggtgatttccttggtccccaaggaagggcatgcatgttggggtttcctttcccttttttttaagttgtcccaaaacatccccttaagtttttttttttgtccctttctttcaaataaaaaaatttggttccca

SEQ ID NO: 541320 - DNA, 853 bp, Homo sapiens
taaaggggtaatataaaaatgtgctcgtgtgttaagccttacgtttttctcatgcctccattatcagttgcaattgtgtatctaagacctccaagctctgtttttaaaacaaaacaaaaaaacctttctctattatctcagaaatataaatactgttattttaatattcaagaaattcaatataacttttaacacacactgtggaacatttaacaccgttataaacaatgtagcttataagctatttttaacttccaaggctgttgtcttgcctttttgtctttctaccagtactttctcttaactattttgtcacgaattacactacgatgcaataacataaactctaggtatttaaccgcacttatgacattcaaataattcctgatttaatgacaacgggataatactgactttccagctgttatactgctagtgtatctttgttaccagactaacatgtacttcttcaaacgggacaaaacaaaccggacatctgaaaggctatttcttactttgcattttctaaattgacctgagggcacattccgattgaacatgtacttgaagttacagctttctggtatacacaccttataacgctctactaatgctttgacaaatgtctaacctattcaaacacagacacattggcacaactgttaatgcatgggggtgtctcaagaacacaaccaacagtggttgcttatatcgacttctggagttgaacacacttccattgtgttacaattccctagttattaattcacaacattcttccaccaaaggccatccatgctgtgggcaacagcgcaacaagataaacacaacacgacagaaaaggagcaacacg

SEQ ID NO: 541321 - DNA, 112 bp, Homo sapiens
tcgacggtgttctgaggaaacaaatctttttacagagctccacacattaggaagttaaaacattttatttgtacttagtgaaaacagaacaccgtcgaaggggtaccgagct

SEQ ID NO: 541322 - DNA, 503 bp, Homo sapiens
  misc_feature (375)..(375): n is a, c, g, or t
  misc_feature (412)..(412): n is a, c, g, or t
cggccgcgcgacattttttctttttttgttttagagatagtcttgctctgtcacccaggatggagtgcagtggcatgatcatggcccactgcaacgttgaactcctaggctccagcaatcttcccaccctgcccaacctcttttatatgaaagcagcttgtagtttctgtagtgatgggggctgcattgtggcgggatgtttactgatggctgtgtttgcgactaagaaactctattttattttgtcaggactgacggttgctgtggactcttatttttggcggcagctcacttggccggaaggaaaggtgctttggtacaacactgtcctgaacaaaagctccaactggggggtatccttcagtgtccgtgcangagggcgatgggtgggacccgcagccacatctcctgngcctccatgggcagtggaagcagctgcttctcccttctctgcagcgtggctgcagggtcaggatggagcccctccctcccacttgctcctg

SEQ ID NO: 541323 - DNA, 454 bp, Homo sapiens
agcttagccaggtgtggtggcacatgcctatagtcccagcctctcaggaggctgaggtggaaggatcacttcagcctgggagctgaagttggagccgagactgcaccactgcactccagcctgggtgacagagtaagactctgactcccaaaaaaaaaaaagtgtcagccaagtgtgtggctcacacctgtaaccccagtgctttgggagaccaaggtggaagcgtcacttcagcccagtttgagaccacctgggcaacacagtgagacccctacctctacagaaaaataaagtattagccgggcatggtggtgcatacctgtaatattagctactcaagaggctgaggcaggatgttcgcttgagcccaggaggtcaagactgcagtgagctattaatattatcataccactgcactctaacctaggcaacagggcaagactctcgtcgacgc

SEQ ID NO: 541324 - DNA, 475 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggaggtcagtgcgcgctgccgcgaccggggccttcagcgaggcgccggcgagaccagggaggaggcgggcgagggcgcgacccgacgtggcgctggccgtggattcctgaggcctcaccgcgcatgtccacgcgtcacagccccgtgctccttacctggggctgcacccctcacttggggccgggctcctcacctggggctggacctgtcacctgggggccagacctctcacccgggggccggacctctcatc

SEQ ID NO: 541325 - DNA, 2392 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctca

SEQ ID NO: 541326 - DNA, 2425 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaataatgagaatgaaattttaa

SEQ ID NO: 541327 - DNA, 2504 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtaggatccacacacagcacggccctcccagaggccatgtgagggccccttgggggcgggggacagggcgatgtgggggccctgggcaggaccaccagctctcatcccacaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctca

SEQ ID NO: 541328 - DNA, 1103 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaaaaa

SEQ ID NO: 541329 - DNA, 177 bp, Homo sapiens
ggatcttagaggatccccccctcctttgctggggatgaccccatctcctcactgtctccctccagcatgactctcctggtcttgccaccactcatcatcagaggcattgatatagcagtggcagaatactcgtccatattgtaaaactaagtccttgagcttggtagcccatctgtc

SEQ ID NO: 541330 - DNA, 275 bp, Homo sapiens
gaactagtctcgagttttttctttttctttcttatccactaggcatttattctactctgggtaaacctggtgtctggatttctttttttttaaattaaatttaatttaaagtcccgggttacatgtgacaggatgtgacagatttgttacataggtaccaaacgtgtgccatggtggtttgctgcacctactaactcatcacctaggtattaagcttcgcatgcattagctatttaaaccgctctgtacttctggcacctgtacctcatccttta

SEQ ID NO: 541331 - DNA, 2365 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcacctgtctgccaggaggccacgtgtgtcctgcccaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctca

SEQ ID NO: 541332 - DNA, 543 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctac

SEQ ID NO: 541333 - DNA, 2329 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgacggccatgcagttccacctgatgttctactgcacgcggacactgcccaatgtgctggccctgcctgtagtcctgctggccctcgcggcctggctgcggcacgagtgggcccgcttcatctggctgtcagccttcgccatcatcgtgttcagggtggagctgtgcctgttcctgggcctcctgctgctgctggccttgggcaaccgaaaggtttctgtagtcagagcccttcgccacgccgtcccggcagggatcctctgtttaggactgacggttgctgtggactcttatttttggcggcagctcacttggccggaaggaaaggtgctttggtacaacactgtcctgaacaaaagctccaactgggggacctccccgctgctgtggtacttctactcagccctgccccgcggcctgggctgcagcctgctcttcatccccctgggcttggtagacagaaggacgcacgcgccgacggtgctggcactgggcttcatggcactctactccctcctgccacacaaggagctacgcttcatcatctatgccttccccatgctcaacatcacggctgccagaggctgctcctacctgctgaataactataaaaagtcttggctgtacaaagcggggtctctgcttgtgatcggacacctcgtggtgaatgccgcctactcagccacggccctgtatgtgtcccatttcaactacccaggtggcgtcgcaatgcagaggctgcaccagctggtgcccccccagacagacgtccttctgcacattgacgtggcagccgcccagacaggtgtgtctcggtttctccaagtcaacagcgcctggaggtacgacaagagggaggatgtgcagccggggacaggcatgctggcatacacacacatcctcatggaggcggcccctgggctcctggccctctacagggacacacaccgggtcctggccagcgtcgtggggaccacaggtgtgagtctgaacctgacccaactgccccccttcaacgtccacctgcagacaaagctggtgcttctggagaggctcccccggccgtcctgagggggaccaggcagccctcagcagccacaggccttccaggagctgttatcactaccagtttctggcacaattccagcacaattatgacaattcagagaagcaagtcaaaggactgggcacctgcctctgacagacaccagaccaggtccagggcctcctccacagcctcagctggggctctcagcaccaaagaacgaggggcccaggtcttgttggcaccccgggagccactgcccagggtgatggtggccagctcagggcttcctgcgggtgactgtcgcccagaccaggtgccattcatgactaatcaggagcagcgggctcacccaggcaccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctca

SEQ ID NO: 541334 - DNA, 417 bp, Homo sapiens
  misc_feature (22)..(22): n is a, c, g, or t
  misc_feature (24)..(24): n is a, c, g, or t
tatataactgatccagaggatncngaggcttcaacggaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttccgttgaagccgtcgggtaccgagcc

SEQ ID NO: 541335 - DNA, 395 bp, Homo sapiens
atactcaatgggatcgaaagggtcatgtactcacatatctagatagcatgatagcctgtccagcaaggatagtgttcagcaggtggtgtatctgtctcgcatgacgttataatcattcaccccacatagctggatcagtacgcgcgatagatagtctgctgctcagtacattgtctgtgcttcaggatgttagcaacagctgtagggcaataatcataggtagcttgatccctatgcaaaagttatagttgacacttggggcactttcatggtggaacatactaatagagcattctcgaatgtgtactctccaagttgctcagaaagctctcaatattgagtaattaaaatctgaggctattccacaacagatatagattcgtagtaaactgtag

SEQ ID NO: 541336 - DNA, 1084 bp, Homo sapiens
aggtccgaccccgcctcccgctccccgcccctcgcgcgcagcgcggggccagctttactcagggcacagagggtctctgcggccgtagcggccggggctgcggtagccactttagatttgggcaaggactttagattcgggctctgttctgtttccgccgtcctgcttcctgccgaggctggcccaggcagccgcgcttcgaaggacgccgccgggagctgcggagcatgcgtggagtggcagtgctaacggctggtgtctcgcactgttggcctgtgaaggtacgtgaagctgaaagcctggaatggctggaaaggggtcatcaggcaggcggcccctgctgctggggctgctggtggccgtagccactgtccacctggtcatctgtccctacaccaaagtggaggagagcttcaacctgcaggccacacatgacctgctctaccactggcaagacctggagcagtacgaccatcttgagttccccggagtcgtccccaggacgttcctcgggccagtggtgatcgcagtgttctccagccccgcggtttacgtgctttcgctgttagaaatgtccaagttttactctcagctaatagttagaggagtgcttggactcggcgtgatttttggactctggacgttacaaaaggaagtgagacggcacttcggggccatggtggccaccatgttctgctgggtgactgtcgcccagaccaggtgccattcatgactaatcaggagcagcgggctcacccaggcacctgtctgccaggaggccacgtgtgtcctgcccacccagggggagctgtattttggcagcaccccacgcttgctgcccgagggcctcttggggcacctaagacagcaccccctctcaggggagaccatggtggccccggccgcacccccccaccctggtgccaccactgcaacttttgtattcacaggcatcccatctccatcacagataaaatcttaggagataaacacattcaaaaaggaatgagataaaaagaataaggcaataaatgttgattggaacctctcaagattacagaaaataatgagaatgaaattttaa

SEQ ID NO: 541337 - DNA, 297 bp, Homo sapiens
actgccaaagcgtagtacccaaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaaaaa

SEQ ID NO: 541338 - DNA, 104 bp, Homo sapiens
gtcctgcaaaatcatcattcgggagcaagtgggtttaatatcctttgtcatgaaaggaaagattagctttcatgactacacacttagtccatctgacccatctt

SEQ ID NO: 541339 - DNA, 344 bp, Homo sapiens
  misc_feature (22)..(22): n is a, c, g, or t
  misc_feature (24)..(24): n is a, c, g, or t
tatataactgatccagaggatncngaggcttcaacggaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctac

SEQ ID NO: 541340 - DNA, 1298 bp, Homo sapiens
ggccaggatggcggcgtgcgacggcgacgactcgctgtaaccccatcgcggtggctcatacgacgagtctccgcagtgacggacgttcaggcttggcctcaatgagcgagtcaacagagagctgtccatcagtcgaccattgcgtctccttggggcgtagagacaggacccggacagtgatgctttcatgcactgtccgttacatgcatactcagtacgtcatggatcgaaacgatggtaggtcgctcgcgtggacgctaggcagaaacaagctaggatcaaccttcgacataccctaggtaggagagggcctcagtagtactgtgctacgtgccgtgattgccccaacggctgcgaaggtcggcttggtgccaccatgttcgtgagagtaggaccagatgcgttgccggagaagcatcgagtcacggtgtgaacttttcctctcacgtgcgaacgcactccttcaaaactgtacggccttttcgaaggggcatttgagatactggagaggcgggcagtcccttttctcttggtgagcgcgggtctgttgttgcatacgaccgcgacctagcggccgagggtctgccgtggggaaacgtggtatcattctatccgcttgcgcgcgcaaaactcattgcggggccttcctcggcggcggcgctttgccttgtgcctcctgcgttggcctggacgtcattccgcgcttctttggctttgttcgcgaaggttttaggcccctcgcgtcggtagacaggaagttctgttggcagaacccttatggcaagaacacccaccgggttacaacctttggtgctccagtggacagagcaccctctgggttggggcgtaaccaaaacgatatcgaaagcgaggccacgccaacgacaaagttcgggcctgggaccggttgtccgccggggagcgccgggccccatgagggggccgtcacagccaaaacatggcgcttccgacggggtgttgggaaacgattgtaatttgcgacccacaaaggaggttttgccctggagggcacgtgggccttagtttgcgacccgcgagagcgggtccctaagattgaaacacctaaaggtaggggacttttctactaacgggcttccggttatttggctcacggcattgacccaagacgtgcgttagttcctactcttcgcatttggcttaaagcaccgggcgaaggcgggagcgctcccttgaaactttatcctgcgggctctctgtgttacgagcgcagatgaagacggaagccgcacaatttggtgtgctattagagctacacc

SEQ ID NO: 541341 - DNA, 156 bp, Homo sapiens
gcggccgcctactactactactactgctcgaattcaagcttctaacgatgtacggggacatgtggggagaggaccagctgggtgcttgggcattgacagaatgatggttgttttgtatcatttgattaataaaaaaaaatgaaaaaagtgaaaaaa

SEQ ID NO: 541342 - DNA, 904 bp, Homo sapiens
  misc_feature (22)..(22): n is a, c, g, or t
  misc_feature (24)..(24): n is a, c, g, or t
tatataactgatccagaggatncngaggcttcaacggaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaaaaa

SEQ ID NO: 541343 - DNA, 827 bp, Homo sapiens
gggttcaagcgattctcctgcctcagccttcagagtagctgggactacaggcacgcgccaccacgcccggctaatttttgtaattttagtagagacggggtttcaccatattggtcaggctggtctggaactctatttcatttcatttcatttcatttcatttcatttcatttcatttttttattttattttattttattttattttattttattttattttattttattttattttattttatttttttgagacggagtctcactctttcgcccaggctggagtgcactggcgtgatcttggctcactgtgagctctgcctcccgtgttcacgtcattctcctgcctcagcctcccacgtagctgggactacaggcacctgccaccatgcccggctaattttgtaattttagtagagacagggtttcaccatgtagcccaggctggtttcgaactcctgacctcaggtgatccacccgctcggctcccaaagtgctgggattacaggcttgagcccccgcgcccaggccatcgaaaaatgcttttcaagcctcctgcactatgtctgcaaataaccttctttacaatgttaaaagaaatgcactctggtgtctggacgggccgcgactgccgatctcggaacattgacgaacggccaccaatgtgacaggcactccccactatacatcacggtgtcgggacgcgagaccggacccaattgccttacacccaagacttgatcccgtgcgacttacttttctagaaacgatggtcccaaagccattacccttgcgccccattcatatgacggccaacaacgcggcgga

SEQ ID NO: 541344 - DNA, 1266 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagaattccagagggagttctcagtgcccccggacaggcctctccagcttcacactcttggccgcttctccaatcagctcccagaaactcccgaactccagtttagagttattgcagctgcccaggttggcaattttctcttccaggccacagttgctcggcatgagatggggcagctgctgggtgaccaggtcccgtagctcagaaggggtcagcgtctccttcccaccctccacggagtactggtgaaagttcttgatgagggtctcaatggccctctccacatcactgaattcctgagcatcctctgcgttggctgaccgacactgtcccatggtgcccactgtgtctggtcctttggtgagagttctgttgtcctatagctgg

SEQ ID NO: 541345 - DNA, 765 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattgcagtaagggtaagctggtaccga

SEQ ID NO: 541346 - DNA, 357 bp, Homo sapiens
  misc_feature (243)..(243): n is a, c, g, or t
atgaatgtattcaaactggactaagctatgaagagccattgttggagtagatgtgaaccttgaggggcctcaaagcccaaggaagaggtaaggttctgaggcagttcagacttcttttagtccatcacggattgaagactcactctgcagaccatacagggggcccaaaagaggtatcagggataagaaacccaagaaacagtgattgcaataagatcttcccttggtacctaaacggaaaanagaaaaaaattagcaaacagacctatagaaatgtaatagattgttgttttggagtaacctttgtccatggtaccatcttatgttctaataataaaataataaaaataataaaaa

SEQ ID NO: 541347 - DNA, 616 bp, Homo sapiens
  misc_feature (45)..(45): n is a, c, g, or t
  misc_feature (50)..(50): n is a, c, g, or t
  misc_feature (52)..(53): n is a, c, g, or t
  misc_feature (56)..(56): n is a, c, g, or t
acacctcacaggctggacttctgtggcttcctcctgagccaagtnctctncnntcntgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggaaataaaacttgtctcctctaccaccaccctgtaccctagcctgcacctgtccacatctctgcaaagttccgttgaagccgtcgggtaccgagcc

SEQ ID NO: 541348 - DNA, 684 bp, Homo sapiens
  misc_feature (614)..(614): n is a, c, g, or t
atattgagagatagaatgacctagcatcattgactcacacctgtggtccataagcgtgggaggatgatgcatgaggatcagctcgggcctaaaggtctgatacactgctgacatgcacagtggtgatctgtacatacacacaagtttcatgattacgtttatatggaggactgagcctgatatgcctgctagctggaaggctgctgctgcagtgatcgcgtgtacaccatagggtgaatcctgccatattcataggttgtgtcactcgtcttaagtcttaggcactccgtgcatgaccctatcttttattctatggagaaatgagatatctaggcatgtgacgtaaaggcgccaattatctgtagaggcccaatcatggactcagaaaccgatcaagatgccctgtaaggactgttagtgagaggtgactgttgacctgtaggctgcctactggacaggcttactataggcagacaagtgtactgaggcctgtatgacagagctttgcaggccatagcctgcgaatgaactgggtcctgatgttgagactagtctgttaacacggtgcaccatttgtctactcatgcgatagagtcgtacccatgcccgctgtngcacacgtgatgtcgccttgtgggacggtctaggcgcgtagactatcagtggtatcggggttgagagcac

SEQ ID NO: 541349 - DNA, 823 bp, Homo sapiens
atgacgctcagcactcgtcgcttctcctaacagaccctgcccggcttggcgatggagtttccggacctcgttcgctcactgttcggagccgagctgtcagcgcttgggtgaggtggcggagcgcgcggtggggctggtggcccagcggagaggtgactttgaacctgcaggtttgggagggaagggtggtgctcccagtgctatggcaatgcctgtgggtgtgctggtgtgcttgaagcttgtgtgtgggtgtgtggtcatgcgtgcagattgtgtgtgctgtggccaatggagtgtaatggtgcttgtgggaagtgtggctggtgttgtcgaaaatagtggtggctgttttccttcccgagttggaagacttgagtgagagagaaggacatcgaggtcccgcgtggacctgcaagtccgaccaactcttttgcagattttcttgccgcttaaggtgtagatgcctgctcagggccatcttcgtgcgacagaccatgtggcctacgcccagcatcactgtggatctgcgttaccaaaaggtgagggggcggatcctcagggtgaaagcaggcagatggagaatgcgtgcagaatcccccaaatctgtgtctacacgtttccttctccgcttttgatccttctgagggctgtcaggtgcgtggggaaaagacgtgttaagataaggcgttgaatgttgggtgggtacagtagtacaaaggtactatatcagcgaaccaaggaggatataggacggagtggatgttgagccaggagagttgaggcgtttgctcccgtttgactagcagggatattcgagggtaca

SEQ ID NO: 541350 - DNA, 321 bp, Homo sapiens
catgttgaactctgcggagcaggtatgggaagcgctaaagaaacggaaatcgttgtcgtggtagacgaggaacgcttcgaactctggattagtgaatttgagaggcttttcactagctcgggtattcgctattggtcgacccctatttaccgttcgggagttctggtgtgatggaaaagttattacttctagtattactactgggtgccagtggagcggctcagcctcagtcttttgaaatgccattgccacctgctcaaattttaccagcaagcattgcgacaaagctatgggatgcagatccacgagtagagtcagccc

SEQ ID NO: 541351 - DNA, 446 bp, Homo sapiens
tacatactgccatgtaggccattcaagtgaacccgaccccttctgatgtgcacgataacatccgtcgtcacgactatacagaagtggacaagcaacagccgctactcacatttactcagcctgcgtgtccagaagaggtagaggatccagagaaaccgagctaatatgtcatgtgctggccactgctcggcagaaatcacagatacaagacatggggaaagccaatggttggctaaggaggcagcatctctggtaaagtaacatttaagcaaagaatcaaatgaaacaaaggggccagtcgggggaaattggtgttagactggtaaactcagagatggaaacaggtgttgtcctgcagcatcactgaggcagtgtggcaggagtggaacaggattggaaactcgagagacagaagaaatttgacaaaaaaaacacaacaaccacca

SEQ ID NO: 541352 - DNA, 828 bp, Homo sapiens
  misc_feature (260)..(260): n is a, c, g, or t
agttcggccgttcccgctcccgcccggccccatgtgctggtgattccccagaatcaggcctcgtttttgggccacccggggtcgcaccgcttcgggcttgcctctctacaccccacgggtttacaagtctcttggccccgggacgatcctgtattttctggccccagcttcccaaggacctgtttgcgacaccctagcgctggataattctcccgtggtgccgacccccatggcttggcaggcccggggtccccaccctnttccttccccgggtggtaatgacgacgcggttagaagtgtctcgcgcccccgtggttcttgcacgagttgccttttggctgccgccccccccaggggactgcaacgaggctggctctgggcccgcagtgcccgcggcacccacccctcctttgatgccagagtgccccacgagccttctcttggacgcctgttccgagggacttgtattgtcgccccccgaaccggttctggacccgagaagtttctttggacgccctccctaggccacgcactccccgggccggtacccctgggcacgcgggagatcttctgcgcgcctacatcattcccacgtcacaattgtcgccgggggagatgctgtattgatctcgcttgcgccccccctgctcgatgaaatggcactggccgccgcgattcgcgccctcccgtcatcgtcaatgctggtggcttggtcatgcctccagagtggggggtgtcgtctcactgtgtcatatatcaaaaatgatgttcaccccgtggtgatatcccgcacaatagaaggagggggcccacctcccccacataaca

SEQ ID NO: 541353 - DNA, 615 bp, Homo sapiens
gcgactacagtcggagacagggatctgtagaaatcacgtatcacaacagacatcacacgatctaccatgcgtgtgcatctgtaatgcacgaacctggtcgacaaaatcatgtcacttcaaccccatatcatataaattagagaaaaaaaccttctaaatcacgtggttacattcaaactttaacttccttcagtacatgctgcagattacagtactgttaaggtcattgcaagcatgcccaaaccctctggtgtctgatcatgtatctcagcaacattgcagtatgcaagaaacgagcatgccccggtctcagcccatggactagttaatacagtgaagcaggttcctgtcttttacccttcctgctcagaacataaaagattaaggcactcacaatcaaggaagactgggagttctcagcagctggcaacactgcagtctcaacagataacatcacggcaaaccaattactgagacacttggctgttgctcaacctggcaagtctcaaacagcctttctttaaccttgtaggcatcagatgcataaggttagctgcaacatgtgcatggtcaacaaactacgtagagctcttatgaacaactcttgtaccaaat

SEQ ID NO: 541354 - DNA, 171 bp, Homo sapiens
aaaaaaaatgcaggggccctggaaatatatttaatttaggggggagttacatgagtataaacaaatgtaaaatgtattaagctggccctttaaaatttgtagactattggatgtatgttttagttaaatgaaaaagattaaaaaatggaaaaatggctttttgcccctcca

SEQ ID NO: 541355 - DNA, 193 bp, Homo sapiens
tagtttgtggcctgtgatatgtgctttctcggtgttacatcgcgccagtcattggtatatgcgtttgtgtgttggttagtacgcctagtatgaggcgcgttctggcgtgtacgtgaaatcacatggctaggccggaggtcattaggagggctgagagggcccctgttagggctcatgggccatcgagacgaga

SEQ ID NO: 541356 - DNA, 331 bp, Homo sapiens
  misc_feature (132)..(132): n is a, c, g, or t
tctggccaggcccctcaggaagaaactgagagcaaagaatggaggtcagagtttagtccctggtgttcccccttatctgacgggtgtgtgaatccatttggtgggggtctgggtttctgaaaagtagctcangggcacgtgttaaggatgtctctaggtgactctaacttccctggctattgtttgaaactgttatgaccttcttgcttatcagcttgctggtttccttctcggggcgagctgggtgcctggagttttcggtgaaggaaactcaagattctcctttatttctgtgcttgtgagaatccccctgctcccaaagaggggtccc

SEQ ID NO: 541357 - DNA, 117 bp, Homo sapiens
ggtgaggttgtctagtccacgctcggagccatgccgtccaagggtccgctgcagtcggtgcaggtcttcggacgtaagaagacagcaacaacttttgcgcactgcaaacgcggcaat

SEQ ID NO: 541358 - DNA, 142 bp, Homo sapiens
ttttgggggcccccttgggttttttttttggggggggcgggtttaagggtttaggtttttaaaacggggcttttttagggggacccccgggcccaaaatttgggcccgagtttttgggcccctttaaaagggtttatgggga

SEQ ID NO: 541359 - DNA, 626 bp, Homo sapiens
  misc_feature (1)..(1): n is a, c, g, or t
ntcgccacaatgttgctttatcaacggtgcttcctactttgtgttatgtaacaaccggctggctgccggatcgttctctgtaacaaaacacggtgtggggtgcctctaattcgtgctatctcctcgaatgttagtgtatataatgaatggagcgctcccttgccttcagatcgctatttattaaagagtgtggcacaagggaaaccaggagtctagtaatatttgcctcggcgagctttcatcaacggttgataccccgtgttgatgattccccgccctcaacggggtgtattactaaaatgatacgcacgcgtggcctggcgtgttttataatagacgcacgacgtgtgtcgtaataaggtacaaagtgagtcaggtccactcggtgagaacgtagaagggcaatttgtccacgttccgcgatccgccgggtacaattctaacacagtgatggtctatatgtagtatgatggtagccctcaacctggatgcagcagagatggttcttaacttactctcaccaaaatatttgttttacacaccccacgcgggtgtatatatagaagtcacgagggctgccatatgttccctcgccaccaagaaaaaggtagcccagccaacatcga

SEQ ID NO: 541360 - DNA, 368 bp, Homo sapiens
agatcctttgagatggagtcttgctctatcgtccaggctgagtgcagtgtcacagatcttggctcactgcaacccccgcctcctgggttcaagctattctcctgcctcagcctcccgagatagctagggactacaggcgtctgcaaccacacctggctgatttttgtatttttagtagagatggggttttaccatattggtcaggctggtctcaaattcctgacgtcaggtgacccacctgccttggcctctcaaaatgttgggattacaggcgtgagccactgcatccgacctcattttgtttttttcaattctgttatcggcatttcttccttttttttttattaatgtataggtgtactgtcata

SEQ ID NO: 541361 - DNA, 302 bp, Homo sapiens
gtcgtgaagcgaaacccggcgactgaacatctcagtagctggaggaaagacatcaacgagaattcgttagtagtggcgagcgacgcggaaccaggccagtgccgaacaagtgatttagcagaacgattttggaaagatcggccatagcgggtgacagccccgtatgcgaaagtgaaattgtcggacttgagtaggggcgggaccaccgttgttatcctgtctgaacatggggggaccacccctctaaagccttaaatactcgtatgcaaccgatagtgaactggtaccgtggggtaggaggt

SEQ ID NO: 541362 - DNA, 340 bp, Homo sapiens
aagccgggcaaagttttttttttaaaaaaaaaatttccttttaccccaaacccaacaccttgggttttcccttaatcccgctttaacattaaggccgcatttttttaacccaaaagtgttttaaggccctgggaaatgttcggaacctggggggggaaaaaatcccaaaaaggcctttgcccccggagcccccctttgaaaaggggcccctaaaaaaacccttgaattttagtgggctaaaaaaaatattaacggggggactttcttacaaataaggggtatcttctcccatataagggcaaattggcctaaaattccccccttttttggaaacgaaagg

SEQ ID NO: 541363 - DNA, 213 bp, Homo sapiens
aatctggcggcgtcgaaccacgtcgagcgatcgcttccaccggcaggccttcggcctgcagcttcagcgcttcggccacggcggtgtcgcgcttgcgcccggccagcagcgtgtgcacgccggcctgggccagctggcggacggtttccaggccgatgccacgggtggcaccggtgaccagggcgatcttggaagtagcggtattcatgcgtg

SEQ ID NO: 541364 - DNA, 392 bp, Homo sapiens
aatttcctgataacattatgtggccctttggatccagccaagcctgaggtttacccccgggctttttggatattgggaccaggtggttcatccccttttctggaaattcgagtcaggggtaatttaaccccctttagacccttaaagaaccatcagcatcccccgggaacttttttaaaaaagcaaaatttctactgctttggatcctgggtcaaaaaaaagaaaaaaaaaaaaaatgcaaaactttaggccccgcccccgatttattaaatcaatttgcagtttaacaaaatccccaggggatttgtaggcccattgaactttaaaaaccagggttttagaacaggtttttaaaaaggaacaaataaactcatttccccaaagttaactga

SEQ ID NO: 541365 - DNA, 123 bp, Homo sapiens
tgaaaaccattcctttcttcagcttagtattgattttggctattgattacgtagggagccttcacggaattcaattcccagtcccagaaccctacggttttaggtagagttattgttcagcag

SEQ ID NO: 541366 - DNA, 1251 bp, Homo sapiens
  misc_feature (193)..(193): n is a, c, g, or t
cagcagcagaagcaggagccgctgggcagcgactccgaaggtgttaactgtctggcctatgatagaagccagacaatcacaacagaagcaggttcttcaagaatatgcaaacgaattcctctcgaatacagatgctactatagacactcttaatcaatagaaaaggagaatgctaaaatgagatggaattacnaagactatcaaaggaggagacaaggactctcctagataggagaagaacttcgtgcaatccgcaaggaccagagccaggacggcaatctgtattctattcggggcttttcgggatatctcccaggggagaaaaatagcacaatgatgattaacatgataataatgaaatagtgatatatcatgaactgatagacaaccaatgattcggaatgagataccaaatgatactctagaatcggatcaaatgaacatcattataagaaattgccactagcagcattcagagattcagataaaaacaaataattaaatattgaaacctactatacttgcataccctagctaaatctcacctaacggtatatcgagatgctaccgccatacatgcgctataatgaaggcgaacccaaacaaacgaattacacctacttaactaaccgagctaggcaccaaatgaaaccaagaggagtctaaactaagagcgcggaacatactggatgggagaaatgataaacaaaacgaaaatataaaaacataagcgatagcctaaatgaaaaatggaatcccccatgaaggagctataaaacataactgaaccgacaaaacgcgagcgaatctaaagaggcgctaaaaccccaaaaacccctaccaagctagtaatacccataccctataaaaattacaaatacattatataaacccatggaggcggaaaattcaaggctggcgcacccaacgcccggctgccattacaatccccgaaaagggggacttcctgggggccccaaagatatacggtccgcaaaccaactaatcccagggccaaaaaagcaccttaaacaaagaaaataccctaccaatgcgagagcaatataaagcgcaaaacaatcccaggggcgcccaatttagctggggcgcccgaggcggagggtccccccccaacctgaattcaaaaaagccatccagaaaacggggaagaactcatggagagagagaaaggcgatagggaattgaagaaaaacataagacacgggaaaaggccacacctccgcagagggc

SEQ ID NO: 541367 - DNA, 247 bp, Homo sapiens
gttctaggggttgaagggcaggcgcttttgctcggggttgtagccgaacgactgcggaccctggaagctggcgatggtcttggcctggcccagcagcagctgcttgaccgatggtgtcgcggtccaccgccatgatcagcgcgcggcgcacgtcgcggttctgggtgatgccattcttggtgttgtagcgcagcgcgaaggcccacccgggcccgccggtcggaaatgacgtcggcattgcccaagt

SEQ ID NO: 541368 - DNA, 394 bp, Homo sapiens
  misc_feature (1)..(1): n is a, c, g, or t
  misc_feature (172)..(172): n is a, c, g, or t
nccccttattatgaaacatccagcctattttataaatacccttaatatagaaaaccctcctcaggagctgtttaaagtataaagcccaagattttcccttaggctaatggcctgaccttctgtgctttcaaattaaagtacttaaagcactgaaggattggcccaggtgtgngtcgcacgcctgtaatcccagcactttgggaggccaaggtgggtggatcatctgaggtcaggagtttgagaccagcctggccaacatggtgaaacctcatctctactaaaaatataaaaattagccaggtgtggtgctcatgcctgtaatcccagctactcaggtggcagaggcacaagaatagactgaaagtaaaaaaataggcacaaatagactgaaagt

SEQ ID NO: 541369 - DNA, 945 bp, Homo sapiens
ggcgccacgcaagtctacccgaggcggctgtccatgacactgattccagatcttcacatgaggcatgggtcgatactcgcctgcgcagaagtgcttacgcctcgtacaaagttgcagcccaagagaacaggcccgtcacggaccatctggacgagcaggcagctgcagggacctgaagcagattcaccagcaggctctatgatcgtcagttatagcaggggtctgggaggacaagctcatgaagacaacgccagtgtgtgttttaatcggaaaagtggtcacttgccaagaaaggcccttgagaggtgacaccgtaattgatggttgggcaatggctgataaatgacactttgagacatctccatctcatctcaagtcactcccgccagcagatgaaggatgcagcagtctcggccctggctgctctatgcagtgaatattacatgaaggagccgggggaggcagatcccgcaattcaggaggagctgatcacgcagtacctggctgagcttcggaaccccgaggagatgactcgctgtggcttctcgttggcttgggcgccttccaggcttcttctgaaaggccggctccagcaggttctcacaggtttaagagcagttacccacacttccccccgaggacgtaagtttgctgagtcccaggagaagacggttgaaatgccattgcgaggatttgccagcactgtcggtgtgaaagcacgagcccagacgaaggctgtgtgcgggaggatggtccccagattactgtggctgctgggtgctgggacgtatacaccaggatagaaggggcgggggcctgggtcgcaggcggctgaacgtcggtggttgcaacttctggcggacccggatgcaagccaacttaggcttggttgtggccgcagaattcgtcgtacccgggctggcggtggggccccgcccaaaatac

SEQ ID NO: 541370 - DNA, 190 bp, Homo sapiens
catacacagacacgttccttacacacgacagagacattgccatacacatacagcagagcggccgttccatacacacacacattaccaccgcgagacacaacacataccatacacacaagagagaaatattccatcacatacacacacaacattcgcgtactcacacacattccaatacacactagacaca

SEQ ID NO: 541371 - DNA, 571 bp, Homo sapiens
cttacaggctgatgctgctggttgggtggattggactaagaaactctgcaacacagtaggtaccccaatgtgtttgggattggggactgtaccaatcttcctacgtcaaagaccgctgctgtagtagctgcccagtcaagaatcgttgataagacattttctgtaattattgagaatcatacaccaacaaagaagtatgatggctacacatcatgtccactggtgaccggctacaaccgtgtgattcttgctgagtttgactacaaagcagagccgctagaaaccttcccctttgatcaaagcaaagagcgcctttccatgtatctcatgaaagctgacctgatgcctttcctgtattggaatatgatgctaaggtaagtgcactgcctggttcctggatgaggaaagggatttgtagcacatctccacccaaaggggatgcagcctcttttcttcattattagcagtgaccaagtgttctgtcttccatgctctaggccctcttttgctgctggataaataataatagtaaatcactttcacataccaagtactctatcatctgctacct

SEQ ID NO: 541372 - DNA, 290 bp, Homo sapiens
  misc_feature (26)..(26): n is a, c, g, or t
  misc_feature (86)..(86): n is a, c, g, or t
  misc_feature (124)..(124): n is a, c, g, or t
  misc_feature (155)..(155): n is a, c, g, or t
  misc_feature (157)..(157): n is a, c, g, or t
  misc_feature (205)..(205): n is a, c, g, or t
  misc_feature (216)..(216): n is a, c, g, or t
  misc_feature (242)..(242): n is a, c, g, or t
  misc_feature (256)..(256): n is a, c, g, or t
aggcggcccgcggtggcccaagcgtnagggtctcccccacgccgggggcgcaacgcctgtgtcgcctctccgtgtggatctggcantcggtcatccacctgctgcaaatggggcaggtgtggangtatatccgcaccatgtacctggggattcananccagcggcggaaggaacaccaacgacgcttctactgggctatgatgtntgaatatgcanacgtcaacatgctgcgcctcctgganaccttcctggaaancgcgccccaactggtgctacagctctacatcatc

SEQ ID NO: 541373 - DNA, 883 bp, Homo sapiens
gggggggggggaatggggttgactgtagggcggaggccggaaacttgaaacccggaacccggaactcggaggggggaaaaaaaagctctcaagtttggaaaaaaaagatgcgctccagacaaaatttactttggcaaacaaatgtgtcgcacaaatgacaacgacaacagaaaacaacaacgttgtgggcggccgccaggccacccgcagaaaaagtttttttgacacactgtggttggggggccggggccgccgatgagtgtagtggaacaatgggccacgaggggttgcagagagaacccctgggtccgagcagagggtgtggggcttccccccaataaaaaaaccgcggggccacaggcgggggtgaaaaacccaaagggggggttcgaagacaacggggctccatacaacgggggccagcggaggactggataaaaataacgcccgcgcgggagagagagcgacacagacacgcaagacaccaggaaatagtacgataagagaacgcaagcagcagcacagcaacaggaagaaagaagaaacacagaacagaaagcagccacaagcaaaacagagcagtatcgggcaagaacaggagaagagagccagataaaacagaagagaacacagatgacaaaaacaagagaacagcacagcatcaaacagagcaaaagaaagagacaatgaaagacaagacaacagctcaaaaaaaacaacacaagacaaaaagagacaaaaaacagaaagaaaaaacacaaacgaacaggagaggaaaaaacataccaaaggaaccaacgcaacgcgcaaacggacaacaggagacatcagacgaacacaaactacgaacagagcgaaatacacgcgaaagacacaccggaca

SEQ ID NO: 541374 - DNA, 571 bp, Homo sapiens
ctgcacgagaggcgtggggccaacgaaggacaggatgatcagcttgcatctcctggtagccgtaggccaaggagctgcaggcagtcggtggtgataggccaggaacttggaggtggtatcttgtgcgagcaggggcaccatctttggcagaccgtcggccaggcgcgcggacatcttggcgccctcctggtacaggagcaggttgtgcagcgtggtgatggcatagaacaggaccgactccacaggggagctgagcatgcggaccagagcagggatgccacccgacttgaagatggcgagcagcccctcccggtggtgggagaggttgtgcaggatgctggtggtgcagcgggctgtgtccaggtcgctggtattctgcatggtacgcacgacagcggacaccagctggggcgagcccatcagggcccgccgcgacgcctccttcttcgacagctggttcacaatcatggccgccttggtcaccaccaccgggtcctcgtcgttgagcagtttggtgagctcgggcagcgcgcgagtggccagctcggcatcgtcctggtagttgagaaga

SEQ ID NO: 541375 - DNA, 331 bp, Homo sapiens
agtgagctggtccgcactagttggagtttcccatacccacggagcctgctcattgctagcacagcagtctgagatcgaactgcaaggcggcagcgaggctggggaaggggcgcccaccattgctgaggcttgagtaggtaacaaagcggccaggaagctcgaactgggtggagcccgctgcagctcaaggaggcctgcgtgcctctgcagacgccacctctgggggcagggcatagccaaacaaaaggcagcagaaacctctgcagacttaaatgtccctgtctgacagctttgaagagagtagtggttctcctagctcggagtttggggg

SEQ ID NO: 541376 - DNA, 468 bp, Homo sapiens
aaccctcccaagggaacctttggctaaaaccagaaagaaatggccaaaaatgtgttttaaaagcatggtccttcaaaaaaggcaataaacggccccactagtgcttctggcgatgacatttttaagctccagcgtcctcccggagaaaaaaagttttatcccttaaaaaaagaaaccccccaaaaaccccccgtcctgaatggtgtttcataaactgaaaaagttcctagtttccagtttttttcccttccctttccaaaaggggttggcccagcttgccaaaaaaaaaaaatgggtcccccgtttttacatcgccctttcagttcccccctttggaattcaaaaaagggaggggtcctgaaaaaatcatttgtttaacaacctttgcccccccctgggttataaaaaaaatccccaaatggcccttgagaatagtatatgttcccttaaaaaaaaagttgcgggcta

SEQ ID NO: 541377 - DNA, 459 bp, Homo sapiens
  misc_feature (414)..(414): n is a, c, g, or t
  misc_feature (419)..(419): n is a, c, g, or t
ggttcactctcatcctggccatacctgaggactatgctcctcttctagaagttcggtgcagtcatctgacttaattgattcagcgcatttatctgcaggctggagtacaatagcacgacatcagctcactgcaacatctgcctcccgggttcaagcaattctcctgcctcagcttcccgagttgctgggattacagcacctgccaccatgcccagcactttgggaggctgaggtgtgaggatcatctgaggccaggagtttgagaccagcctggccaacatgacgaaaccctgtccctactaaaaatacaaaaattagctagcgtggtggcacacgcctgtagtcccagctactcaggaggctgaggcaggagaatcacttgaacccagaaggcggaggttgcagtgagtcaanatcanaccactacactccagcctgggtgacagagagacccatttc

SEQ ID NO: 541378 - DNA, 248 bp, Homo sapiens
gactgctgctggtcgtctctgaggatccccttcattttcctcttatttttcatttctgttgcagcactgcgtctcactctgttgcccaggctgcagtgcactggctgatctcagctcactacaacctcaccctctactaaaaatacataattgctgggattaccggcgtgagccaccgtgcctggcccattgcaattttttaggaagcaatgagttccagcagggctgagtctctgacttcttttttt

SEQ ID NO: 541379 - DNA, 129 bp, Homo sapiens
ccaagaatcagcacctcccacagccgaccaggctcaacgcacacaacagcattccctgaacagcaccaccacgccaggcctcagtcggattctacaactatcccacagacagcccagagctcaacagga

SEQ ID NO: 541380 - DNA, 91 bp, Homo sapiens
ctggggccacgagcgccattgacaagcaatggggaagaaacagaataacaagagcgaagactgtaccaaggatgacattgatcttgatgcc

SEQ ID NO: 541381 - DNA, 82 bp, Homo sapiens
cacgtgcaacctccagcgtccttggttcaatgcagttctcctgtctcagcctcctgagtgacagagctgatgactctgtctc

SEQ ID NO: 541382 - DNA, 695 bp, Homo sapiens
  misc_feature (545)..(545): n is a, c, g, or t
caatggtactttgacctccagtgtagggctatactatacatatatacatatatatatatatatatataaaattgcgtactgtgtctctcataaaacagaatatacagtggctaccatgtatcgtggtgtgcactctctctcagagaccccgtatctctctctctctctggagggcgctgggacatacatctctcaatcccgcttccctccgcagctccctcccactctcgcccctctcttcgtcgccggctgtcatcgacgactctctctcgatgatcgtctcatccttatcatcgatgtcgatccactcgctagctgctactcctactgttgctcatcgatgtggacgagatgatgtggggcgtcgatcgtcctatcctacctcttctgatcgctccccggacgagggacgaggctgagagaacgagcggcacacaccacacagcatagtagccccagcagagagaactatgtgtagccgcagtagaatagccacaaaagacgagaaagtattatccccgaccaacgagttgcctctcacaatngtcgtagtctgtgggtggtcgtgcttctaggagactactgcgctggcgacagcaacaatgatgactggactaacagaattgagtaagacacaaaatgggtcgagacatcaatcagaagatagtgagattacacagaagagagaaaacaaa

SEQ ID NO: 541383 - DNA, 141 bp, Homo sapiens
tcattctgtggtgttcctgtgctcaggccgtcatgctcacagcaggattcacatcaaacattcaaggctgagaatattcaatactacatttcttagctggtcccatcacacctaagactcatgagcggaaaaaaaaacaaa

SEQ ID NO: 541384 - DNA, 569 bp, Homo sapiens
ggctgtcaggaactggagttagttcggggtccttcagataacactgaggtgtagcctcaaccagaaaccttcagttgtcccaggacctccttccaaccctatgtgatggctaggtcttccatgaatggaaactggattggaacacagctgacattcccagcacccaagggcgatgggggattgacaaaatactctccagcaagcctgtcctctgagtcttacagatctggtggctgcactaaccactcttaactggaccaacagaggcctggtattgttgatttcgagagaacaaaaaaaaaacttatgggataaggaaattggcagaaaggtaaaagtactgggggggctggtcctattcacccttctggaaatattcccagatgacctcttacagggtgaacgcagctctagggtcagcggtagcagtcctcttggtctggaggtgtaatccagaagttctgggtctcattaccaagaaatttacggagcttggcccccaagggtgcaggttggcagtgacaagttcacataccgtgaaagaggaaagctctcagcaagcagacgcg

SEQ ID NO: 541385 - DNA, 982 bp, Homo sapiens
gagattctccccagacgccgaggatggccgtcatgggccccgaacctcgtcctgctactctcgggggccctgggcttgacccagactgggcaggctccactccatgaggtattgctccacaatcggggtccggccgccgcgtgggagccccgtttcagtccgccagtgggcctagtgtgaccgacaccgcaagtccgtggcgggtctcgacagagcgagcagccggaagaccagaatggattggagccagcggggtcgccgtggattaggagcgggaagggggcccgacactctgggggacgcaggaagcccaggcaaacaggtgaagcggccacatttcacaagaatgtggaccgaggaaaacctgtggcgggatctcgcgcccgcccggattgttacaagcccaagaaagggaaggcgccggtatcttacacaaccactgccaagtatgattgatgggggatggcaacggtgaggcacccggcaaggggacgacagtacacccgcgggggagataccacccgagtaagcgccatacgacgggcagagggtataacgtgtgggccgtgaaaaggaaggacacctgcgctgtgggaccggccggcagcaacaatggcgggttcagatatacccatggcggacatgttgcgacgccgccccatgtggggggagcacagagagaggagctacctggacaggcatgtctgacgaaagggtcacggagaataccgtggcagcaacacgggaaggaagaccgcgaggagagggacccgccaaggaaattatgaccaacaccattgtgacgtggaggccattgaatgcgggcacgggtcaccggggaacaatcgcgcaaggccgggaggccaacagacacggcgttggagcagccgcggcagactcaagggcatgggacttggaagagggacaggatggaaggggacgaccccgagggaacacacagccagtagagcgcccgagacgg

SEQ ID NO: 541386 - DNA, 288 bp, Homo sapiens
gctatcggttcaatcatattccgataacatggatggacacattttgtttatccattcagccgctgataggcattgatggttgtttcaactttttggctctgataaataaagctgctgggatcatgcaagttcaagtttttatgtggacgcatgtttgcagttctcagccagcctaagtggtttctcaccttttttttttatattggggagagggagttctgctctgtcccccagggttgggggaaacaaaatgaacagacggaaagacaaagggtctgggtgctgcgg

SEQ ID NO: 541387 - DNA, 122 bp, Homo sapiens
ctctgccccctcccctggaggagctcagcgaagccttgaaaggccggggctctgggaggtgtgcccacctggaggggtgggggctctgggggtctgcccacccggaagggtgggccagaaac

SEQ ID NO: 541388 - DNA, 417 bp, Homo sapiens
ttctttacactgccggtttacactgtttctccaagacatcacagctgatatctcctggtgctatccccaaactgccactctaaactcttgaagtaaataaataatctttgctggcaggactctgctgaatctccttaggcactctctaatcagatatcctaggtcctcccaattcttagaccttttatacctgtttttctccttctgttattccatttagtttctcaattcatccaaaaccgtatccaggccatcaccaatcattctatatgacaaatgtttcttcttacatccccacaatatcaccctttaccacaagacctcccttcagcttaatctctcccactctaggttcccacgctgcccctaatcccacttgaagcagccctgagaaacatcgcccattctctctcccta

SEQ ID NO: 541389 - DNA, 565 bp, Homo sapiens
gtgatggagtattatttttaaaaagtgattttgaaccctggctatgtgttggaattccttacacattttaaaaatacatacatatgcttggtgtccaacatagaagattatgatttaatcattgattaaacaaatattcattgagtaccttatgtgtgcctggcactgtcccaagtgctaaatttagtatttttggaataagatctgaaattctggatgattgaaaaaattccagaagtgagagaattcgtgtgaacttacacaagcttattctcttaataaggatcaatttaacactttttaagttttatcattttttctttcttcaagcaactaattttagttgtctctcatttatattcttagaattaaaaataggcccggccaggtggctcacgcctgtaatcccagcactttgggaggccgaggcagtcaaatcacttgaggtcaggagttaagacaccagcctggccaatatgataaaaccctgtctctactaaaaatacaaaaattagccaggcatgatggcaggtgcctgtaatcccagttactcaagggaggctga

SEQ ID NO: 541390 - DNA, 284 bp, Homo sapiens
cactgtcgtgcacttggctgcgtggctggttctattggccctaggtgctgctattttgggtgggatgggagggggtagagggagccaggagcactgggttctccttgagaacactggccacaagagtactggcctcttctatcactggcactgtccttcgcacttgcttggtggccccaacgtgagtcgttgtaaaacacgccgccgttactattttctcacaactgcctttcctgtgaaccaccactcataaacacctcagcactacaactaaacttctatat

SEQ ID NO: 541391 - DNA, 996 bp, Homo sapiens
ttcgaagggttttctgcccaagaagaagttcgtgtgtcgaaggaaccacacaagaggtgtatgtctctgtccgaacccaaacaggggggactctgttcggtgtgtaaaaaagcgtggttgtggtacaaggggggaattgtgcgccccaccactttttggggtttgtggcacgacgcgatctctgcaatgttccttatctttggggcccaaaacctaagtgttcctgtagggtccccccaacgcaatgggggagcccccgtgcccaaaaagtaaggtgacgaagggtcctgcgcatatgccacgcgaggcgcagtctcagaatgggagacacacacctgggggtcacacactgggaaaagaggacctcttcggggtaaagcctagtggaggaggcgccctggacaaagccgtgtcctgtaaagcgggcgtgccatcccattatcccagttccgccgagatagccctgagtccagagaaccccacccctggattgagacccccttggcgtgccattcgaccgacaccgcgccacagattgggtactgatagccgcccggcgacaagactgggagaacaaacacagggtccccccaggccctggagctcgcgttctacatagggaattcccttcgggcaggacctccagacgccacagatggccagaagcaacaatagttgggaggaagagagccccttggggaacccactgcgccaccgatccgagtactcgtgacgaaacagccatgtgggttctctaacgcagaatgctcagggaaatggccttccccgccgcgaggcccagctatctgcctcgacaggctgtgacatctttcttattctaaccactggcgcattcttcccctctattttgacgctagttggtatgaaattttatttaaagctctaagatattgtcttttttctttgtcacagaccacattttttttgaatttttttttgcaccggttttcccaaaattgaaaccttcccagacca

SEQ ID NO: 541392 - DNA, 405 bp, Homo sapiens
tttataagtttagcactcagattctttccatcctgtataaattagagctcacataatagagcctcaatgattaaagagatataggtgttatacacagggtgttggctttgcaccatcgaaaaagaatgccctatgaatagcgctttcgatcttcagtatctttctcttattctcatggtaggttaagatgcttttaaatgtatgtgttataagcctaaggcagcttgacttccagctgcaagttttttaccctcctcggcaaagcaggtctcctaatcgtcagccttcacagcacttctctacaaaagttgtgaaatcatccatacacagctttcagccgctcttttgttgccatgggcgtgtgtttcgcgagctcaacaagcgcagtgtgtctcgtgatgtgcg

SEQ ID NO: 541393 - DNA, 638 bp, Homo sapiens
gcaggaccaggtcctgaggatgcagatggtgagtgcagggctagcatcagagtaagctgggctggggtgttgtcgctgaccaggtgcccttgacccactgtgtgctctcccaatgccctgctcctccctcacctcccttcccccaacagctggggaagatgaggggccacctggggccagcaggtgccttaagggagttgagagggttctatggctggtagggacagccagagcccacaggggtctgaggatgtgcgggatggaagcttcctgggggtagaggaagggcagcagcaacagaggctttcctgcagtgaggatggaggggacctttttttttttaagatggagtcttgggccggatgctgtggctcacacctgtgatcccagcactttgggaggccgaggcgggtggattacgaggtcaggagttcgagaccagcctggccaacatggtgaaaccccatctctactaaaaatacaaaaaattagccaggtgtggtggcgtgcacctgtagtcccagctacttgggagactgaggcaggagaatcatttgagcccgggaggtgtaggttgcagtgatccgagatcgatccattgcactccagcccaggagacagtgcaagactctgtttca

SEQ ID NO: 541394 - DNA, 173 bp, Homo sapiens
agcagcaaccagcgatgctactctatttctatgaattcaacttttttttttcccttagattccacatgtaagtgatatcatgcagtatttggtcttattcctttgggtatatttcacttagcataataccctccaggttcatctatgtggctatcgctggcctacagcacatg

SEQ ID NO: 541395 - DNA, 189 bp, Homo sapiens
cttttttccggttaaaaaaaaatttttttttaaaaacctttcccgggaaaaattttccaaacccttccgccggtttaaaaaaaggggggccttttttcaaggccctaaaaaatttttaaaacaatttttttgtgccaagttaaaaacctttaaaaaaaaacttttccttaaaaaggtttttggaatcca

SEQ ID NO: 541396 - DNA, 437 bp, Homo sapiens
ctagaggatccccccagttacacagctgctttatactaaaagatttcttgataaagctcttgaactacatatgtttgttcttgaaagggcataggtcttgtgggaggctatccgggtcctctctgtattatgctgtcacaattgaatacgtttagaagctgtccgccttcatgtaaataatttttggagatacattagctattaacacatcctaaccaggatatactctgttctcgtaacaatatataaagtttccagtaacttggggatggctaccaaaagttaacacagtatttcgtcctcaaatgcacatagtttattcgcacgaaatcttctttttttgaacgaacaacagcaaacgatccaacaactctatacaccctggtgggacctaatgtaacctttaattctgacttgaactgtaagcatttttatga

SEQ ID NO: 541397 - DNA, 1296 bp, Homo sapiens
  misc_feature (528)..(528): n is a, c, g, or t
gcccgagcgaccgcacgaggatgggcaagtgtcgtgggacttctgtactgctagggtaacgactccgctactctaccgatgagcactcagaagtggcatgatagacacagtataaagaagagtcgtcagtttgagtgcatcagcgcgcataataggcccaacacgcgttatcggaggtgcttctcgatgcagatccggcaatcgtgcgtgtacataaagtcatgatctcgcacagccaacacagggcacaaattcctgaccaattagggacacgtgtgataagagggggtccaagcatgagtcaccgcaatggcaagcaaagagtcacaaggccttaattgctatccccaaggtgacgggtatgctatatgcacctgtcttcaatctgatggaaagaattgcactgaaagattcatgcgatttgcactgcgacatattgcggttcaggcggatacggtggtcgaaatagctagtcgcaagggagtggaatagatgttccgttgggaatgttcctgcactttatacctngtgttcttgctcttaccatgctattgcacaaagttgtaaggccttctgatatatgtagcccttattactaaatcgggcgagattgataaggttgaccacggaactcgacaccgaatccaataccgaacttacttcaattggggttggaaaaaacaacttggtaacagtacaattaaagatcgtgtcttcagtaattgccccagagaaacaaaccatacaatctagatacgcagataacagagggggggcgcccgagccgcgtagacagattttttctcccctcaaaggtgaggaccgtgcataagtctaaaaggcgcgttagccctaaggagtgtttttctcgttgcaacaccaaaaacggtggttcccccttaaaaaagggtagttgcaggaagtaaaattaagctataaggggacattagcacaggaagagatagataaacaaccagatgcgagcaaattgttggggcacacactgtgcataccctttggggacataccatagagtgcacagggggaccacttaaacaacatacaagcaggatgtgtgggcaacataaaatggcggcccaaaaaaataacccatagagcaagcgattataagggctataaaaggtaaaattccacttgtaaatgcgcgaagactattctataggcggagataaagaccacctgagaaacaatggctagtaccccgatggtacaaaagtgcagcatagatgacattacaatgttgtgaccacatattatacccgtgcagatacaaaa

SEQ ID NO: 541398 - DNA, 1229 bp, Homo sapiens
ggatatcgtcgaaccacgcagtcgaggaagatgaaatgtataactgattacttttgtaagctaaatacatattaaagagagctttttattttagttaaagccatttgaaaaacagccaactccagataattcacaatgaaattgtagggccccatcggatgttttattagagtgttttaggccatcatcaatacatacttgatgagcatttcataattcagcagtctttttaatcattcactcagcattcagaaacaagttgaatcagtcggatattgtatatttattagatgatttatggaaacgtgatgtagagacatggaagagaccatgacagactgtagtccaaaatgaatcctgtggattatcagcatctacttatggtattcaattatttgataaagaaagattgtatctaaataactaagttcattgtaaaaccgatattatcagagattagttccggagatgtcccaaatagaaaatttcataaatactgacagtatcattaaattactgataaatacatcaaacagaattcccaaagatattagcagatggacttccaaaaatacataagtaaatgatgaaagtggacacaaagagaggcatagaacatctagagtcactcatatgccataagaaaccacaagaaaatcgacaagcaggacgaaaaagaaaagcacaacagacaagagacaaggcacatccagagcatacgcagcaaacaagaaccaatacacaggaaagaaaccagaccaccaaccaacataccacaaagacaatcgcaagaaccaagaaacagacaccaagaccgacaaaaaacgaaaaaaacacacaacaaccagacacacaaacagtgaacacacaagaagacaagcaccacaaaaaaaaaaacacagaagaaagagaaaaaacaacacagaagaagcggaacaaaagagaagacaacagcaaacacagaagaaaacgaaaacgaaagaaaaaaaaaaacgacagtgaaacgagcaagcagcacagacaagaacgtagtaacatagagaaagacagagcaggaaaacagaagtcaaggcaagaacgcgcaaacgagggcatgataagagacagaagaagagaacaaaaacaaatacaatcggaaaaaagccaaaaacaaccgagaacgaacccaacgaagcacacaaaaggaagagacaagagaggcaaaagaaaaaaaggagaacccaacaaaa

SEQ ID NO: 541399 - DNA, 133 bp, Homo sapiens
ggtcccacgcatactcgggaggctgaggtgggaggatcgcttgacgccaggagttctgggctgtacgtgcgctatgccggatctgggtgtccggcactatagttcgagcatcatatataggtgaccatcccgg

SEQ ID NO: 541400 - DNA, 207 bp, Homo sapiens
actagtaggtaccatagctaatgtaaggtacattttaagtaaggtaccttagcgtatacattacttaagaatatcacagaggtggctggcaaggatgacagcataggaacagctccagtctgcagctcccagtgagatcaacacagaaggtgggtgatttctgcatttccaactgagatacccagctcatctcattgggactggtta

SEQ ID NO: 541401 - DNA, 663 bp, Homo sapiens
  misc_feature (229)..(229): n is a, c, g, or t
  misc_feature (324)..(324): n is a, c, g, or t
  misc_feature (340)..(340): n is a, c, g, or t
ttacagttccaaatatgccccacaccttttcccggccgtcacattgttctcaggcccatttttttggattcctcagcttaatcacagtggttgacatgtaataggtcatcccgaagaattataccaaatggcttagagaatatctccaaccttctttcttcaaattaaatatgaatcaggattgaactaacttgggttttgcctaaaaataaccaataaatataatggnagagtgtgcaagtagattcaatcataactttattttacacatacaatattagcatagaatcttctaaaaccaccaaataattaaataattaatanaatagaggctttctcntaagtgatgctcaaacacattaggcgcaatccaggtggcctctgcagctgtgtctctctttcatcttctgttcctgtaagggcagggcctctttcaggaacagccaccaataagcttcctctttccttttggtcagttggatttgccactgtaatgagaaaatgggtgccttgagtaggtgctcaggaaagctgactgcacaacagtcttctcttgtcttgtttccccaggtttgagagttttatgaatgcagtttcccaagcttggcacccaagtgggtactgcttgtacaagttgtgttgtgtgcaaaggacctttaggtt

SEQ ID NO: 541402 - DNA, 585 bp, Homo sapiens
  misc_feature (451)..(451): n is a, c, g, or t
  misc_feature (526)..(526): n is a, c, g, or t
  misc_feature (548)..(548): n is a, c, g, or t
  misc_feature (564)..(564): n is a, c, g, or t
  misc_feature (574)..(574): n is a, c, g, or t
taacttttaagcttttttccttttcatggcatttgtctgacttccaaaggggaagctaaagcctttgtaaagaaacaatatatatgacaaatacctaaaaataaaaccaccgcactattaatatattaaatgtcactatggatacacagatacaatatatcttaacaataccactaaaccaaactcttacaaaacaaaaatggtaagatgaaaaaggagtcttagataactgcctgcttgtttcaagtaatactagattcgacaaataccaatgtaactagagaaaccagctaagctactgaaactggaataacagtatatgatcttcaaactgcccttcaaaagacatttccaaagtacagggaccactgttacgctagtagcaataattaccatgtaataatttcctagtatgtgctacatgctatgctacatgcttccacatagagtnggcctcctaacacttacccctaaggttatgtttgaaaataaataggcgggtacttggcataaaggcggggcatgnaggttacatctggagggcactnccacggttgttagggnccctggggtnctttataaaca

SEQ ID NO: 541403 - DNA, 346 bp, Homo sapiens
  misc_feature (141)..(141): n is a, c, g, or t
ccatccctgcaggccagggcacacggtgggccccccgccagctccttggaggccaaacccaggatggttgcaggccaggtttggggggcctcaaccctttcttggagcgcctgtaaaatggtcagcgtgaagcgcaagtgntggacaggtggcccgtgtgccccacagggatggctcaggggactgtccacctcacccctgcacctttaagcctttgccgcggggcacccccccccaggtttttggtgccaaataatgacgacctgggtggaaacctaccctgtgggcacccatgtccgagccccctggcatttttgcaatgcaaataaagagggttctttttttg

SEQ ID NO: 541404 - DNA, 194 bp, Homo sapiens
cggattatactagtatacgggttcttctgaatgtataggtagggtggcggggcatccatatagtcactccaggtttgtaggagggttctatctaactattagcgacttttcgacttcgaagcgcaatgcttctcacatcatcgaaaattatataatatatactgctagttagcagcaaatgaactgagacctac

SEQ ID NO: 541405 - DNA, 465 bp, Homo sapiens
  misc_feature (53)..(53): n is a, c, g, or t
  misc_feature (75)..(75): n is a, c, g, or t
  misc_feature (331)..(331): n is a, c, g, or t
gaggatccccagtagtcgatcaaacctggcatgaccgtgctctgcttggcgtnatcagcaggtctgcgtgtgaanaatccacatctgctgcctgacccacgtaggtatcattccatcaacactgacgagggtatctgctgtaatgagtggagacgcgagatcacccgtgaggaaagtgcctatattatgaataattgatgtatatggcttatggttcgacatttaatttatctctttatatcatcgagtaacgggttcgaatatccgcgcgccacacttgttgaatgaacggaagttccacaagttgttcgtgatgaacaaacgctggatncaacgatacgcatgcccctctggatcgaaactgggggtgaacttgtcacgcgaatggagcatgaaacgattgttgatgtacaccaacttgccaggttgaatgtccagcggccgcgctacgcttttaagcgcgtt

SEQ ID NO: 541406 - DNA, 169 bp, Homo sapiens
gtactatctctgaaagacctgaactgcccgagccttagccgttcctttgtagtgtgctcaaagacaaggttacggagaaggcttccgcttgatggcacagtacattgattaacacaaactcacattggttctaggtctcaacgttcaggcttactcagagatttgattg

SEQ ID NO: 541407 - DNA, 375 bp, Homo sapiens
gaggatcccccacttgatgccccttgatgctgtagtctgacagggatgcgccgctatctgtccagctgctttccggcggagagtcatcctctgtctggctcacggaggaatgccttccgttggtcctggatctttgctttgacgtcctccagttgtgtcactgggctccacctcaagggtgatggtcttgtccatgtgcgtgtcttcacgaagatttgcatctccacctctgagaacggcgcagcaggtgccgggtggcactctttctggatcttgtaatccgaccgggtgcgcccatcttccagtctcgttttccagcagaggatcagtctctgctggtcaggatggatgccttccttatcttggatctttgcc

SEQ ID NO: 541408 - DNA, 128 bp, Homo sapiens
tcgagcggagactaggcagaactgagcattttcaaagttcccgatggagagatggatgccgcgtccgcttcgcatgcgacgacgacttccctgccgtgtttgtgacccccttcctgcccagcaaccgt

SEQ ID NO: 541409 - DNA, 942 bp, Homo sapiens
  misc_feature (74)..(74): n is a, c, g, or t
  misc_feature (84)..(84): n is a, c, g, or t
  misc_feature (86)..(86): n is a, c, g, or t
  misc_feature (138)..(138): n is a, c, g, or t
  misc_feature (193)..(193): n is a, c, g, or t
  misc_feature (237)..(237): n is a, c, g, or t
  misc_feature (264)..(264): n is a, c, g, or t
  misc_feature (275)..(275): n is a, c, g, or t
  misc_feature (303)..(303): n is a, c, g, or t
  misc_feature (344)..(344): n is a, c, g, or t
  misc_feature (349)..(349): n is a, c, g, or t
  misc_feature (352)..(352): n is a, c, g, or t
  misc_feature (421)..(421): n is a, c, g, or t
  misc_feature (446)..(446): n is a, c, g, or t
  misc_feature (451)..(451): n is a, c, g, or t
  misc_feature (457)..(457): n is a, c, g, or t
  misc_feature (513)..(513): n is a, c, g, or t
  misc_feature (704)..(704): n is a, c, g, or t
  misc_feature (725)..(725): n is a, c, g, or t
  misc_feature (806)..(806): n is a, c, g, or t
  misc_feature (837)..(837): n is a, c, g, or t
  misc_feature (846)..(846): n is a, c, g, or t
  misc_feature (860)..(860): n is a, c, g, or t
  misc_feature (864)..(864): n is a, c, g, or t
  misc_feature (876)..(876): n is a, c, g, or t
  misc_feature (921)..(921): n is a, c, g, or t
tggtttcccgaatcacttggcaaataaccagcaggcgcggcagatgctcttcttttgcgcttcctacggacgcntacgcaagtncnatgcgccggacctgaacagccagggtcccatctctcagccggctcccgggcngtgctagcagggaagagggacgcgccggccgaatgaaacactactaccccggaancccgccctggaccttccacccgggcagcgagtctggcggccccncgccgcccccccctccgccccgaacanactgcgctgcnagccccgggcttccgccgcagcgcgcancaattcggagcgtgccagaggagaccagcagcagcacttgntttanctnggctgcgggaattccgacctgtacactttccagaagcctgatctctccaagtccgcccccagggactcnagccccggcttccaggttgaccccngcgcncccccntcctgctctcggccgcgttcaccgcgcgaggcctccgcggtcctgttaagcccgancagcacaggccgctgcctcagcatccaccccgcagcccacgtgtggcaagccggggaaggggtggagtgaacggccggagaccacgtggagaaaggggccgctttggcccttccatctgggtgccgggagccctaggccctccggccatggccgacagcggcgatgctggcagctcgggcccctgggtggnaatcgctcaccaacagcaganagaaaagcaaggaagccgcagtggggggtgccgcctcccgcccagcccggctcccgggggagcccacgccaacctgcgccngcccagccccggactggaccagcagctcccngggagaacnagcaccccaatctnctcngggggggccggngagcccccaaaccagacaagtgatacgggggcaaatccggcagcngccgccgcaatttgaagatct

SEQ ID NO: 541410 - DNA, 426 bp, Homo sapiens
  misc_feature (10)..(10): n is a, c, g, or t
  misc_feature (31)..(31): n is a, c, g, or t
ggctcattcnagttcatcatgatacctcagngtctatcagtattcaaatttattaagcaataacatgcagaatgtatgatataaagggctgtgtcatcacacattccccacgctattttttttttttttttgggcaaagccagtgaaaggtgccgcaggttaaaattcaaccaaaatttaaagggcccacacacaccaagagggaaaaaaaattcctcggggaaaagtcactatagaaggcaggagggcttaaaaaggggaaaaaccaacaatctctggactaatatgagggaagactccaaattggctctgggaaccaattctctacaaccgagattccccctcccttcaataactattctcccagaggtcccacagcacaaagagaaataaaaatctgagaacagtactactcctctgggctac

SEQ ID NO: 541411 - DNA, 362 bp, Homo sapiens
  misc_feature (14)..(14): n is a, c, g, or t
  misc_feature (46)..(46): n is a, c, g, or t
  misc_feature (74)..(74): n is a, c, g, or t
  misc_feature (78)..(78): n is a, c, g, or t
  misc_feature (190)..(190): n is a, c, g, or t
  misc_feature (206)..(206): n is a, c, g, or t
  misc_feature (233)..(233): n is a, c, g, or t
  misc_feature (263)..(263): n is a, c, g, or t
  misc_feature (311)..(311): n is a, c, g, or t
  misc_feature (362)..(362): n is a, c, g, or t
agcagcgggccatnacctgagcttttggaagacaaaagagaaatanggaagcacaatgctatacatgctatatnaacngaaggaaagaatttcagggaggaaagagtgagtattcaaaacttgtgggaatgtgcccaggctttgctgcatgctggctggctgaaattaagctcccatgatcatttagggntcattaagaaaacagnagccccctatatattctaggtgcaaanactttgtttccaactactcttgcttactgnttttagaatctacacgggaatatgtttaaggaatgcttaattggtatntatccccaagtaatttgaggtttagaagtgaccatggattgggtgtgcctn

SEQ ID NO: 541412 - DNA, 1417 bp, Homo sapiens
  misc_feature (8)..(8): n is a, c, g, or t
tcggctcnccccccgtgtctttgcgtgtgtgttctgtgtgtgctttcgtagtgtggtctcgtgtgtgtcgtccttgcgttctgtccgcgctgcgtgtcgtctgggtgggtgttgtatcgtgcgaccgggcagccgcgtctggtgttcttagtagagagccggctgctgctccctgtttttttcgcgggggggtgttactctcgcccggagggtgtgctccgccgcttgttttggcgcccatttagcggtgttttccctaataccgtggtgtttcctctctcgttttcccccggtttttgcgtccccccccgcccccctgtttgtctccttcccttttttttggtccctcctttctccccgtctccctccttctgagggggggggggaaataccgttcttcttataagtattctcttttggtgcgccccgcctctttccttagtgttagacgcccccttgtcattcgttcgtttggtgccccccccccccctgggttgcgcccccctcttcgtcttctgaaggggtggctctccccctctcggtggggtgttttcttggcggggttatttgtcccacctttgatacgtgtttttttttttttctcgggggtttctccccccccaccaccttgtgtgttgtgcgcccctggggtctttgtcttgtggtccccccccccctctgttttgttctgtgcacacacgatttggtgttgtatatatagttgtgtcctccccccctgtgttgtttggtaggttcccccacaagattggtagttcctctcttataatagataggttttttttcttctcctctcttttgttctcctctcgccgggtttgtgttataagtgttttcgccccccctcttgctcttgtggtggaggcacgcccctcttttataccccacgcttgtctcgcccccacctttttgttttcctctctctctcttgtcccctctctctccttctctgtcttctctctctcttttttctttttgttgttgtggcacgcacccctcctgttgtgtggccacacacagcggggcgtgttgttctctgtatctcttcttttgtgtaatatctgtctctgtttttttcttttttatatttttggcgcctctcttatttttttctttcttacacccccccccccccttgaggcctctgttttgtggggcggcgcgagagggggtgtgtatttttttctctcgcgcgcgcgcctctctctctttgtgtccgccccccccccccttttttttgtctgctccttgttgttgttgaccctgccgcatttgtgtgtgtgaggatgttcccaagcgagagagaagagagagggtttctccccccccccccctcttttgttgttgtgtataaaagagtgctctctgttataggtggtgtgtgtgtgtgtgtgtaata

SEQ ID NO: 541413 - DNA, 508 bp, Homo sapiens
  misc_feature (197)..(197): n is a, c, g, or t
  misc_feature (275)..(275): n is a, c, g, or t
  misc_feature (331)..(331): n is a, c, g, or t
  misc_feature (333)..(333): n is a, c, g, or t
  misc_feature (339)..(339): n is a, c, g, or t
  misc_feature (351)..(351): n is a, c, g, or t
  misc_feature (381)..(381): n is a, c, g, or t
  misc_feature (396)..(396): n is a, c, g, or t
  misc_feature (419)..(419): n is a, c, g, or t
  misc_feature (421)..(421): n is a, c, g, or t
  misc_feature (424)..(424): n is a, c, g, or t
  misc_feature (429)..(429): n is a, c, g, or t
  misc_feature (439)..(439): n is a, c, g, or t
  misc_feature (445)..(445): n is a, c, g, or t
  misc_feature (451)..(451): n is a, c, g, or t
  misc_feature (460)..(460): n is a, c, g, or t
  misc_feature (467)..(467): n is a, c, g, or t
  misc_feature (469)..(469): n is a, c, g, or t
  misc_feature (478)..(478): n is a, c, g, or t
  misc_feature (482)..(482): n is a, c, g, or t
  misc_feature (492)..(492): n is a, c, g, or t
ttctggctatgatccaactagttagagctaacaaatggctcacttccaccagaccaggggctgctgtagagtctgcccagctggccaatttaatggtttcacttctagaggatgcacggggccacgcagggtcctcctctcccttttggctgctctctctttagtaagtacaccttctgcttggagtggtgcctggnatcctacagggatgtggtgagagtaaagagagaaacaggaattcctatgaggtgctaaagcaggcatcccttgggatnacaccaaataaaggccattaacataatggtgcccacgttttataagttggatgagntntcaatngggacctggaantgggcgtgactgctgacttcttgaaactanaactttctcccctcngtactgggggtggtctttctgcnanaanactgnggtttaagtnaaatantgaaanagctgggtnaggtgananaaaatctgnttcnaagattgaanctttttcttggtgctg

SEQ ID NO: 541414 - DNA, 1294 bp, Homo sapiens
  misc_feature (244)..(244): n is a, c, g, or t
tgggttgaggggaccctattcggtttactcccaaggtgctctttatttcgtggttgaaaaaaacctttacttctccattaatttggggaaaggaatgtggaagaagtggacaccacgcgaacaccaccagaacacataggagtgggagtggagtgttttttggggggagtgggcttaagggcgaacaataaaggcttgtgcggtgtatggtctctctcctgtgggcgcgctctccctctccaanactattgtgtgcaagaaatctctgtgtgaaaaacctctctctctcctgtgaaagcccgggggatatgagctccaaaatttcactttaacactagtgtgtcaatataaatcccacctgtttattcggtggcgagagaggggggatgtactcccaagtgtgtgtgcgcctctcctcttctctctattctactctggactctgggagtatttatatttataacaaaaagcgccctatgtgtgtcgtggagaaacaccccaactttatattttccatataacagcagatgtcaatatgacgaaatattcccgagaaaacagcaaacaaagcaacaaagacacacagaacaacaaaagagagggtgcgggggcgcgcgtctcacgagagagaaatatacaccctcgcacgaggaggggggccccccacagcactctaaacacgcgcgcgttaacccccgagaagcgatatacgatgtagctcacaacaacaaacggtgagggcgccccccccatataatgtagggaggagagcgcgcggaataaatattattataaacgcacgacctacacgcgacgcaccaagtgagacgcacagcaggcagaattatccaaaacaacaccacgccgaggaagagactacgcgggggagcccaacaacgccctggccgcccaacacgctgtaggagcgaaacccctctttaggctgtcaaaagcagaacacccctaactacaccacacgcgggggggcggggtggcacaccaacatatggtgtagggcacacacaccacttcatcaccctgatcgacgagacactattttcaacaaagcgcccctactagagggggaccaccacccattatacaaaccactatttttgacaagcgggatgcttcctaaccggctggttgtgttcacaacaccgcaccagtcaggacgaactatatagtgcatacgtaagccaatccattggacaaccgaatttttcgggcacttcaccgggacgcctagtgactttcatgggcgaaaacttttcttatacacgcgcagaccgct

SEQ ID NO: 541415 - DNA, 152 bp, Homo sapiens
taccaggaggatacccacaaaatctaaatgatccgtagctcatttgccctacaatgtatgtgcaagccatatggtttatgccggagcacctgctattctactgggagtactggaatatgggtacatgccaggccgggggtgccttacataga

SEQ ID NO: 541416 - DNA, 1028 bp, Homo sapiens
tcgttcgtctcatctgggtcgctcctctcaattggttccattgcgcacaaggcaaagcccagcctgtgctgtgaagtgcccttacgggtgcccactctggattcatcacatcccactgggcgccacgcccgcttcggcgtacccccgattcggtgtgtccgtccctgttctgctccccttccgggccttttccgccagggttcgtgcttactcttgtagccagtagtcgttcctgagcgcctcgcttcaaggcttcccgttattcgcttgcggcgtaacgcttgccaacgtcgggcctcttacaggcacacgcactgaggccctggtcgcgggcttctagctagggcctgatgggtaaccgactcgttggaccatcccgattggtcatctctttattatagggtgtacacaccgtgtactgttcatggaggactgtggtagcctcaatccaggcttattggcgggactactgagtagtgcatgatgggttgtacaagtacgctgacgagattcctacaagggcgtttgccacctccctgtccattgtgcctgtgccactgttgcctccaattcgcctcctttggcttccacgtggacccattatttgcccttaggcgctggactcagtcacttggtagctgtctacctctacagccgttccccgaggtgcagccaagagccatagcctctgcctctggcctccgcctccgggccctgcgttcaccagcaagcctcccgggcagccaccaccaccgcaagctgtcattcccacccgtgtagaccatctatcacggagccctttctgcgcataagttgctcaccaaggtgaagggttccatatgcgctgctgtggattgaagacattggccaggcctcgttctctcttcttgcccttggcctagtctgggaccaaactctgatcagtatgaggggtagaagtgaggcttagacactgactacctgtccccaccacacctgccacacccagggccaaccatgactaagctctctcatgacccacctcagct

SEQ ID NO: 541417 - DNA, 141 bp, Homo sapiens
aggtatgcatggtaagctgtgggctggaccaatggcacagatggggttgaaaggtgagaagcggtaagctagaggagacagacggcgttgcacttaaaaacaattcaacttcattttaatgtatgctatgtaaagttcaca

SEQ ID NO: 541418 - DNA, 123 bp, Homo sapiens
atcatggttaggagacaggccatgcctttcaagtgcatgcagctcactgatttcatcctctagtttccgctactagtgcccaccatgaagtatgtcctgacaagcctggtcagaaggcagact

SEQ ID NO: 541419 - DNA, 149 bp, Homo sapiens
gtcgacggaaataagaaatcagttaagtctcggctgggcgcggtggcttatgcctgtaatcccagcattttgggatgccaaggtgggcagaccatttgaggccaggagttctaaaccagtttggccgacatggaaaaccccatctctac

SEQ ID NO: 541420 - DNA, 1358 bp, Homo sapiens
gcaggatgagatgatcgacgtcatcggggtgaccaagggcaaaggctacatacatggggtcaccagtcgttggtaacaccaagatagctgccccgtgaagacccaccgaggcctgcgcaaggtgtgcctgttattggggcatggcatcctgctcgtgtagccttcttctgctggcacgtcgcttgggcaaaaaggttacctatcacgcgctactgagatgtctaaccaagcaaagatgtatatagacttggccagggggcttacgcttatctagaaggacgagcaagcttgtatcaagaagctaggagtgtcctgcccaccgtggagcttaatgtagcccgtaattcctggatcacacggaggcagttcacatccgcgtccttgcgagttgtgactttacgttgcaccatcctaattgggatgcaaaggttggacccgatgttgcagcctttttggttgcacttgccttgcagataggcgcactggtgttggagtggcggaaacgcgaaaagcaacgtcggtgcttggctccagcacacttgcgcgacaacaaggtctcgtgtggccgtggtgtagtcaagggatccagtaatagcgtcgggcccgtgggcgtccttagcgcaggaaaaggaatttgggaacacccttgtttagacggttttccctatttcgtagccatcgctagcttctttcaccaatacgggtattttgtgacccaattggggtcccggaccgtttaccccattggagccactactaggggcacgagcgacggtacaaagtaaagaacggccaatattcttccaacttgggcgagaacctacaccttcgaaaatggagatcaacgcattccctggtaatacattgtcgctctaaaagggggaaaaggtgaaaaagcgagacgccctcataagagtcgccccctattgggttaccaccaagtccaatttgtctaggctaacggagattgggcgccattggggcggcgatcacactccattgagttcacatccacagggttatgaacttacatattgtcccaaagccatgggtcctttgtctattaaactgcaggagcatcacacagaacaagcataccacgcgaataacgtattcttggagacatcagatatacagatggggagacaatacatattatatatggaggagcggccgttagcaatcgtataggaagcctttacgcgactttgtgacagcttatgtgctaaactagatggcgacattcctatgttagcccattaaacaaagataaggcgccgatatctagcacacgggaacgtggacaccacagacgcagaactccacatcaagttgtatacgtactacgaggtctcacc

SEQ ID NO: 541421 - DNA, 131 bp, Homo sapiens
aggttgactcctagaggtatcccgggagtgagagaagggaggcctggattgtttctggggcatcaggaaaaggagttgcaagcagaaagaggaccctggattctgcatcacagcagtgtcccacatcttgg

SEQ ID NO: 541422 - DNA, 1041 bp, Homo sapiens
gcactaagcttgggccgttgtgtcttgtgtgcccggaggcgaacagcatgagcggagttacgtccgttgaccttcgatacaccatgtcgggtttcggaggaccaagcccttgggggaaccaatggatgtagaccccttccagagatccctctgtgacccagctgaccaaggccccggcaggttggcctgagtcggaatgtaaccgcctttctcagagtacaaagtgcaagcgaaggaggatgcttcgcgtggtcatgcgcacactcgcctgtggtccgtcgagcgatctcgaggcgggtatctccaagggcattcacgatgagaagccaaaccggagacgatgcccaccgaggtgcgatggatgctctgtgagcccccaggacacggggcatgcgtccggacgagacgagcgtagagaaaactggaaacagggcaaaagcgtgtcgagactggaaacgcagaggagcggtgaggctgacagaaagcgagctgtacgacgcgaaccttggcatggtgagacatgaaactaaacctggatccctctctggcacctcgatgggtgtccctgtgtaaaggccctgtcttttcgtagtcacggatgtcctcccatagagatccctgtcgaacctatccagcggatagtgtcgatgaatggctctactaatctgtgggatgttgaccttcagtgacctctgtttcttgaatctggttaacggactgggtgtggtttctcgggcgcaccatgtgtccaacgggaagttggtcatattgagcttctgcatggctgtggagactgatcttcactccgtgtggcttgcctttggttggtaccgaaccccctcatataaaagggctttaaggtcccacaaaatcttttagcgtcctttggggtctgtccttggctgttttttgcccccatatggactcgacctcttcccgtgggtggagaccccgggcgggggagaagcaggtggggttgacggcccgttgacggaaaaattctcggcgcaaagcacaaaaaagggggcggaccccaggtcg

SEQ ID NO: 541423 - DNA, 110 bp, Homo sapiens
cgaatccgcgtaacgtagacgcgccctccatatttgtggagcgccaaagctgctaagatgcgtcagttgtggagtggcgtagacgagttaagtcctgttctgcgtggagg

SEQ ID NO: 541424 - DNA, 323 bp, Homo sapiens
tctggtgaggcttggtggctcatgcctgtaatcccagcactttgggaggctgaggtggatggatctcttgaggacaggcattcaagaccagcctggccaacatggcagaaccccatttctactaaaaatacaaaaattagccgggtgtggtggcacacatgtgtaatccagctacttgggaagctctgtctcccaggttcacaccatcctcctgcctcagcctcctgagcagctgggacaacaggtattaaattttcacagtatatataaggcagcaatcccataggcctttcacggattcttctgtatcaacataaagaggc

SEQ ID NO: 541425 - DNA, 170 bp, Homo sapiens
  misc_feature (6)..(6): n is a, c, g, or t
  misc_feature (19)..(19): n is a, c, g, or t
  misc_feature (85)..(85): n is a, c, g, or t
  misc_feature (147)..(147): n is a, c, g, or t
  misc_feature (169)..(169): n is a, c, g, or t
gacttnagcttcatcatcntccgggcccgggtgggggtgcggtcgggtcgcaggagtcgaggggtggggagcccgctctggtacncgcgtggcgcgcgccccggctcggccaagggaagcagggagggggagcttctccgcgtcacngcttccgctgcccgccgcggtnc

SEQ ID NO: 541426 - DNA, 385 bp, Homo sapiens
ttctggggcaggcgccctctgcaagaatcttacttcccttcagcccaccgagatggctgcggcgtcccgggcgctgagatgggggagccctgagggcgtctcaccgggaggaggccgtgggcccagcgcgaagccgacccgacattcccccatgagcccgggaggcatcgccacatcactgggtggaagacgccccgccgccggcgcaggcccagaccccggggaacgcgagagccacgaacctgggccaggagccgccgagaccagccccggccgccccagcgctgctcccgcccgggcgcgatgcggtgagaatggccccgggcgggaacgtcccctgtcggggcggccatgggaggcactggggtccctgctctgcggccgc

SEQ ID NO: 541427 - DNA, 108 bp, Homo sapiens
  misc_feature (6)..(6): n is a, c, g, or t
  misc_feature (15)..(16): n is a, c, g, or t
  misc_feature (35)..(35): n is a, c, g, or t
  misc_feature (89)..(89): n is a, c, g, or t
tctggnggaggaggnnctcacaccaccccgcagangagcgtctccaccacgaagttgttctcgaagtggcggatggcattgcagatctnggccccacgcttgttgatc

SEQ ID NO: 541428 - DNA, 929 bp, Homo sapiens
  misc_feature (147)..(147): n is a, c, g, or t
tgtggctgcgcgcacaacacacacacacaaagagggggggagacacccgggggggggcccccccgggcccccccccgtatgatggtaggacgcgcccctcgattgaaagtcaacgagagcgcacccgtaggggagttgttgttctcnccccacccaccactcatcgggtgagtgaacacgctcttctacataacaacacaccactagcaatatcaacaccaaccaccacccacagacagacagtggtggaggagccacccactcttctattatagaacagagagaagcacacactactatgaacgaggggacacacaacacacacacaagaacgagagagaggagcgctcacaagaggaagagaaacaccaccactcacacacgcacagtctcactatactaagtagaggagcaaagaggcgagtaggggaggaaatagaaactcatacacactcacaacgagagaaacacaacaaatcaaacacactcaacgctacgcgacaaaagatcaacacggtgagaggacgcaaaaaacaagagatccaacaccacacaccaaaaacaaaagagtaagaaaaaacgcgacgaatgtacacccaaccaccacaacaagacagaacaaaaaccataccttctatgtagtgaaaagagaacaacaaaaaaaaaaaagcaagagaagaagggtgggagcacaaacaccacacacacaacacgaaatgacaaacaacacccacaactactatacaccaacacaataaaaaacacaacgatgaagatacgattacataagaacaaaaacaaaagggaagaagacaacaacaacatgaagaaataacaaacaaacacaaaacacaaaaacaaataccagcacccacacaattgtagtaacccaaaaaaaagacaaacacacacaaacggataacacaccc

SEQ ID NO: 541429 - DNA, 330 bp, Homo sapiens
gatgaccaaaggcaccaccaagggatcaaggcacataggaagagggacttaattcacacaggagcctggctcctgcatgccatggcatggctctcggggctgtcagcatggttcccaatagcataggcgtgctctgaggagggccctagggcacggtcctgaggacatagccagggccaggctcaagagctgtacaatgtggcgcaaaggactgcttacacatacacactggggctactcaacccgactgtgcagaattatggtgagccttttaccactccagcctagcctctaccacgcaattaggagggcactgccccccaacaggca

SEQ ID NO: 541430 - DNA, 103 bp, Homo sapiens
tttgtgcataagtgtaagtgtataagcatgtcaagtattaaaaagcaagcaagcagaattgggaatgcatccaatccaagatgcggcatcttcaaagcctcca

SEQ ID NO: 541431 - DNA, 1277 bp, Homo sapiens
  misc_feature (434)..(434): n is a, c, g, or t
  misc_feature (459)..(459): n is a, c, g, or t
gcaagcaccggaggtcgagacagcaggcgggtcaagtgggcagccgggatggcagagtcgtgcggcgctggaggagctggtgaaacttacagggagacgctgctggtgcgaggcctcaacgctagctagcaaggccagcgccgtagctgatcgagagtaggaggtgtgtgataactcctgatagactgaaggcactagctgggatcctgcatgaaaggcgagatactagtaaatttgtgctcaaagacgcccgcgaagggacaacaaggacgactactagttcactcgctgtgccatggatggtcatgcttccgctgaggaatgcgtgtatgagaacagttaggatcgattccagtttcgtccgtatcacatgacggcgcaacgggtgtcggagaaacgttcatgtgattacagcgctgtacttgtgcacactnacatatgcgagagatcacttgcatngcgcgtaacaggtactgggagagacgatctccaaagacttgattctagtgaaccttggatagtgagccttagggggcgcgtggaagcttcgctgtcctctatcgactattgaacctcacctgtatcacttattgctcgagtatttgcgcaactgaagtaagactgacgcaacattataacgctaccacgatagcaaatggtactatcggcgggataacccgagccatgaccgcgtggcccgataccgcggaattctaccagatgtgattttgacattgcttgggaactttgatcccatgatcctgatgcagagtgcctgagatcatgtgcgagatctgagttcacttcagataggcaaatcctggtcaagtaaacgaacgacgcattctacattggcattgttgccatactcgagcggcgttactgacaaggcaggtccgaaccgactggtccacagcataccacgctgacacgcgtcccggcacatgtcaaggacagatgcagagaacagagccccaccaaaggcgaccgcactgagcactatacccacgcgagcctccacggggacaaagctgcgggctcttgaatcccaccaccggcgtgcggctgagacaaggaagagatagacaaccccgaccgaggcgaaccaccgggcggacgcggcgcacagaggcggagggacagaacagcgaaagagagggaagaggcaacacgccgcgcggggcagcgagggccagtcgcgccgcccgcgcgccgcgagcgcacacggcacaccacccccgcccgcccctcgcaccccgcccccccacgcgcccgcg

SEQ ID NO: 541432 - DNA, 205 bp, Homo sapiens
atactatacatgattcctacaatatttcagagcaaaagatggctactttatgtaactttaaatagccaatggtttagtttacacaaatccttggacaaaagaactggaatattattgtctctgttcaccactttagttttggagatatagtgcgtcctggagaaagcatcatttttacctttgtagctctcaattcatcagtaag

SEQ ID NO: 541433 - DNA, 1083 bp, Homo sapiens
gcttcgtgctgctgtgttggcttacgttgctccgtgcttccccgagcggcgtcggcgacatcatgacggatctcgtgcacgtgtgcaggcgctgagcagtgcaggcaacctaaatcatgcgccacttgtaggtgagagtgatcatccagatgattcacggcaatctgatcgctcacgagggcactctaccaaaggtggacagtctgaactgcaagcatggaatcgcatcaacagtgtactactaattgaggccactctggatgcaagtacagtgccgccgatgaccgtgctcgtggcatctggagtccggacacctatgtgctttccagatttacgcgtcagggggctcctctctgggcaagattctttctcgagctctgggacaatcgttcagattaacagttgtcaggaagtggtgcttgggcgaacatactatgtgagtcaagtggagctacctaccaacacgaatgtgccgcgaacgcgatgggtaggaccttcaggctggcatgtaatattgctgtgtgcgtcagcaaaaaaggcgccgtggcatgtgtaaccatgtttgggatggcactttcgaaggcattgccacagatggacctatcacaaagatcggaggaaagaccccgaactcctgccatagggggaatagcggagagtttagcatgtgcgtctacgtagacacaaaagttcggaaaaggacccttacctaggttggggaaccaagtaggttaagtggaactcaaggcgcgtttttaataggcaaaggcacacagtagaaagcccaacataggttggattcattccttgtggcaaagaacgcaaagatcagacaagtacgatatcatcattctggaggacagttttagaattatggggtaggtattaacatacatgtgtggtgggaagccccacgtggaagaacacacattccaaaccatcggacgttataacccacattatagtccaaacaacagacgttgggaacaagggtccaggacaaggcgcatcttgggacaacgaccggggaagacacatttggacgtggacggacccattccttagaggcagcgcagaacgagg

SEQ ID NO: 541434 - DNA, 471 bp, Homo sapiens
  misc_feature (201)..(201): n is a, c, g, or t
  misc_feature (239)..(239): n is a, c, g, or t
  misc_feature (282)..(282): n is a, c, g, or t
  misc_feature (311)..(311): n is a, c, g, or t
aaaacaagttaagttttcgggaaactaatgggaataaaataatgtaatttgccttgtgagaaggacaggatacttaggcgttccaggggtagaatgcctatagtttggatatttgacccttcccaaatcctcatgttgaaatgtgattccccagttttggaggtgaggccctagtgtgtcatggtggttgattccttatgnaatggcttggagccactctctcagtagtaagtgacttncttcctctattacttctcatgagagctgactgttaaaaagagncctggaaatctccttgtatcctctcttgnctacgtgatctctgcacatgccagctcctttttgccttctaccatgagtggaagcagcctaaagccctcaccagaaatagatgttggtgccatgtttcttgtacagcctgtcagaaccatgagacaaataaacttttcatttttataaattaaaaaaaaa

SEQ ID NO: 541435 - DNA, 762 bp, Homo sapiens
cggccgcgtggcccaggtcgtgaggacagtcatcaatgcggacttccccttcccgctgggctggctcggcggctacctggccgtcctcgcgggcgccggcctgaccttcgcactgcagagcagcagcgtcttcacggcggccgtcgtgcccctcatgggggtcggggtgatcagtctggaccgggcgtaccccctcttactgggctccaacatcggcaccactaccacagccctgctggctgccctggccagccccgcagacaggatgctcagcgccctgcagcccgtctgcggcctgctgcccggaggcccaacaggttcagctcccgaaactccgggtcatgctgcaccgccgctgacaggaagagacaagtgcggcaccccctggaacccaccctcgttcttcttgcctctgccctgtctctatccacttagaccctcccagtgcagggtcctgctccaccccctgcaggaagccctccagactgcacctgtgtgtggactcctccaagtccggcagcccctggaggggcccgtgacactgttctcccctcctgtggccctgtgcctcctccccgcagggcctggactgtgcaggctcagcacactggggactgaggagacggggtctcttggcaggaggcacaggcagagccaggtcggaaggtgcttcccccgcaggtcccccttgagggcagcagtgatgcagtcagtgctcgggggtgctgggctggactgcagctcccaggagcgtgcgggaag

SEQ ID NO: 541436 - DNA, 526 bp, Homo sapiens
acaatagagatgacatcatctgaggacgtgggatcagattcgaagaccaatataattactcaactatttaaaaaagatagtgaagtggtcttgattgacatttagatttacactgccaagccaatcatgtgaaggacagaagcttttgccatgggcccctcacatcagggaaaatgaccttcactgctgttaacagtaatgtgtccctttcattttctggatcaagccttctcagcggtgggtctggatgtgggtaaactaaggtaaaggggatgatattccacaaactaattatgcacacagaaaatctgtggagcctatcagaccccaagtgtcttgaaatgtttgtagaaacccactaaaatgccccttctctgggtgtgggcccttattgcagctgtctcacagcctgagctgtggtacagagaaatgggggttctccttttatttacattatattttccccaatggcagctttactcccgttgtattaccttcctattacccaaacagttcctcttatctc

SEQ ID NO: 541437 - DNA, 951 bp, Homo sapiens
agcggaggacaacaatcgcaggcgggggaggcacccccaacgaggcaggactgagagccagcccctcttcccccctggctctcaggacccccatcgcagggcggggaggcaccccccacgaggcggcgactgagagccagccctcttccccctctggctcttacgaccaccatcgcaccggcgcgcgcgcgcgagcgcaccccccgctgaccgcaccgccctgccacccagcccctcttcccccctcctggcctctctacgcgcacccacccatcgcacggccgcgccacgcggcggccggccccccccccccgagcgcaccggcacctcacccggcccgccccttccttccgcccccccggccctccttcccgccccccccctcctcccgcccggcgacggcccaccccccctaccgacgcgcccgcgcaccccgaccaccgcccacccgccccactcctccccaaccccccttgagcctaccatacgccaccacccccactccgccacccggcgggaacagcgcacaccccccgtaacccccactacaccggactccgccccaggccacgccccgccccccccccctcccaccagggccctccacgccaaacaccccacgcccccccccgcgcccgcccacgacaacccccccaacccacgccccccggcacccccccacccccacgccccccccccgcccccccccggccccccccacaccgcccccctcaactcgcacgcgccccccaaccgaaccacccccccggcgaacgaccggccgccccagcccaccacacaacacaccccccgacccccccacaccccccccacccccacccaaccccaacgcgaccccctaaccgccgcccccccccccccccccaccaccacaccacccacccccccaccccaccacggccccaccaccacaccctcccaacaccgccg

SEQ ID NO: 541438 - DNA, 103 bp, Homo sapiens
acgtactgtcgcatatcacagctgtgtagtcctgaatatacctttcttctgttatcaacttatccagttctcaagttattctgttatatgcaacatgaaaagt

SEQ ID NO: 541439 - DNA, 529 bp, Homo sapiens
  misc_feature (18)..(18): n is a, c, g, or t
  misc_feature (36)..(36): n is a, c, g, or t
  misc_feature (40)..(40): n is a, c, g, or t
  misc_feature (45)..(45): n is a, c, g, or t
  misc_feature (48)..(48): n is a, c, g, or t
  misc_feature (67)..(67): n is a, c, g, or t
  misc_feature (75)..(75): n is a, c, g, or t
  misc_feature (92)..(92): n is a, c, g, or t
  misc_feature (266)..(266): n is a, c, g, or t
  misc_feature (272)..(272): n is a, c, g, or t
cagctgcggcatggctcncctactcacggcaactcngtcnaatgnggntttttagatcatttctgtnacggttcnaagcagaaaggatgagnggctgagtatgaactaccttggagccctatactgatatggcatttcttttgtatgttattcagtcaaaatactacccacttgagttttctaatctgatgtgagctcacgttacacgacttttagtagtaaccctgactagaaataaactggatgcttaggagagagtgtcagangtatanatgctaataaaacctgtttatattattgttagctgtaagtttttgggaaatactgaacaaattagtccacaatcaagtgtctacttttcccttcactgtagggcctctcctgcacagagcagtctgtttagctgtgaacaccacaatctgcagatgttcaagtcccttgcataaaatggcatagtatttatatgtaacctatgcatattctcctgtatattttaaatcatctctacattaaaatacctgataaaacg

SEQ ID NO: 541440 - DNA, 740 bp, Homo sapiens
  misc_feature (4)..(4): n is a, c, g, or t
  misc_feature (28)..(28): n is a, c, g, or t
  misc_feature (50)..(51): n is a, c, g, or t
  misc_feature (62)..(63): n is a, c, g, or t
  misc_feature (214)..(215): n is a, c, g, or t
  misc_feature (254)..(254): n is a, c, g, or t
  misc_feature (280)..(280): n is a, c, g, or t
  misc_feature (287)..(287): n is a, c, g, or t
  misc_feature (324)..(324): n is a, c, g, or t
  misc_feature (337)..(337): n is a, c, g, or t
  misc_feature (355)..(355): n is a, c, g, or t
  misc_feature (410)..(410): n is a, c, g, or t
  misc_feature (504)..(504): n is a, c, g, or t
  misc_feature (544)..(544): n is a, c, g, or t
  misc_feature (657)..(657): n is a, c, g, or t
  misc_feature (661)..(661): n is a, c, g, or t
gcanacagacgccgggctgcgcgctggngagctgcggtctccggccatcnnacccccccctnncccccccgcctccttctccccctccgaggtccagcggcgcctggcggccggcgcgtgctgggtccgccgcggggcccgcctctaccacctctccagcttcgtgcggcaccacccggggggcgagcagctgctgcgggccaaggcgggccannacaacaaccccgacctggacgggccgccgcacaagcacncggccaacgcgcgccgctggttggancaatacnacatgggaaaactccgcgaggaacaacaaggctccanggaaaacaaaccnataacccttgaaaaaacncaaaaaacaaaacctgctaaggaaccacggttcaaaatggtggattgggacaaanacctggtggactagcgaaaacatctcctgtggcaagtgggccacttgggaaaaaaatacaaaaaatgggttcaccaaccggtgaccaagcccanccgcctcttccactcacacctcattgagggcctctctaanactgtctggtacagtgtccccatcatctgggtgcccctggtgctgtatctcagctggtcctactaccgaacctttgcccagggcaacgtccgactcttcacgtcatttacaanagantacacggtggcagtgcccaagtccatgttccccgggctcttcatgctggggacattcctctggagcctcatcgagtacc

SEQ ID NO: 541441 - DNA, 826 bp, Homo sapiens
ggccgggcctgagagtggggcgggggtgcagggtcccaggaccgggccggggtctttcctggcccgggggaattcggcccagtgcctcccgggggggtgcaatcgcccaacaaaggattcttgggtgctgccacgacctcgagggacttcccatgcccctggatccaggcccccaccagcgcatccgtggcccggcatcccggggctctccatctgcgagggtaccaccagttcgctggtactgcacatctgggcagaccgggctgctactcaccgtccagacacgcgtccagtgttccaaggtccagtgccacggaggctgggcatgtccgcacgggaccccagagcagcaccgggagccgggccggcggcagccgagaggggcggaaaaaggcttcacgaggccagacaatggaggagcataacgatagatgactggtcaaagccaagaagccaggcggcgcaggtgttcccacgccgcgggagccggaacaaagggcggtccacacagagggaaggaagccggatgaaaggaaaacgcgggcagggacccaaaggggcaacgaaaggggaagaaagaatcgtgaaccgaatgggccccaaagggcaaccggacacgggggatacaagtgcaggacaaagcatggaagacgagcacgagcgcaagagcaagataccgggaacggcgccagaccggggaacgtgacccatgcacccggaagaatcaccaagaagtgcttgcgcggccagaaaagaaagaaaaaggaggaagccacaggggaaaagggcacacggaaaccggggaaagaaggccgagaagagcaga

SEQ ID NO: 541442 - DNA, 324 bp, Homo sapiens
ccgagtctgactacgcggctggcctcccaacactttgggaggctgagaggtggatcacgaggtcaagagtttgagaccagcctggccaagatggtgaaacctcatctctactaaaaatacaaaaattagccaggtgttgccaggcatggtggctcatgcctgtaatcccagcactttgggaggccgaggcgggcagatcatgaggtcgggagttcaagaccagcctgatcaacatgatgaaaccccgtctctactaaaaatacaaaaattagccgggtagtccgatcgagccgcgtagtcagatcgagccgcgtagtcagatcg

SEQ ID NO: 541443 - DNA, 485 bp, Homo sapiens
atcaccatggcgggctgggaccctgtacacgtatcctgaaaactggagggccgttcaaggctctcatcgctgctcagtacagcggggctcaggtccgcgtgctctccgcgagcaacccaacgttccattttggcctaaaccaaccgcacccctgcaatttctcctgcgaatttcctgccggccaaggtccctacgcatttgacgggtgatgatggattctgtgtgttctgagagcaacgtccatggcctactatgtgagcaatcgacggagctgtcggggaagtactccacgagtgcacgcagctcgcaggtgtgtgcagtcggtgtgaggcttcttgctgatttcccggaatctaagtggccctcgcaggctccagttatcctgggagtgttcccccagcctgtgagggctagtcatgtctaccaccagggagaacacggtcgcactgaggaactgtcgacgggaggaagtgaaggctgaattc

SEQ ID NO: 541444 - DNA, 136 bp, Homo sapiens
tatcagtcggtcccttacttcccacgatcaccttgcaaggttagggaagccaggaaagatacatagtattgtggtgtgttgaattcaattacaaccccacgatcacccatagtattgtggtgttgaattcaatacg

SEQ ID NO: 541445 - DNA, 766 bp, Homo sapiens
gccatgtgggctcgttcgagctctcggtgcaggatctcaacgactgctctcggacggagcggtgctacagcctcccgagccagccctgcaacgaggtcaccccgcggatctacgtgggcaacgcgtgtgtggtcaggacatccccaagctgcagaaactaggcatcacccatgtgctgaactgcggttgagggcaggtccttcatgcacgtcaacaccaatgccaacttctacaaggagctccggacgtcacatacctgggcatcaaggccagacgacacacaggagttcaaccctcagtgcttactttgaaagggctgcgacttcatttgaccaggcttgtggtcaaaagaatggccgggtgctcgttccactgccgggaacggttagtatgccgttccccaaagcgctagttaatcgccctacctcatgatgcggcagaacgatggacggtcaagtctgcccctgagcatcgttgagggcagaacctgtgagaatcggccccaaccgatggcttcctggcccagctctgggcagccttcgaattgaccagactagccaaaggaggggaacgtcggaaaccctagggcacccccaacgacgtcttgcgtcgagaggctcgtctgtgtcccttgccattctgaagttatcgagaaaccacagctacgaaatgagggggactcatcttagaaagacctctaaggtcccttttggctctgaggggtcctctaataatcccactggattcagcacgcaggaaattatgg

SEQ ID NO: 541446 - DNA, 157 bp, Homo sapiens
ggctcatttcagatgggctagctatagtgtgtacagatatgtaaagccactttcctagtctatatatgtgtcacctggagtttttcacaactcaggtgagtattagcttcattggggagggggtgatctaaaacactctttacgccggcttctatgg

SEQ ID NO: 541447 - DNA, 130 bp, Homo sapiens
aaaatttttggcgtgttgtggctaggtacgaacgaaccgatagaaggggatacttgaccgacgcgtgcaagatatcccagtcgacgtatttcggtggacgaagcatcactgcctaacgcgtgttggaaag

SEQ ID NO: 541448 - DNA, 383 bp, Homo sapiens
taagatggtcaggaaggaacacatgaggagggtgtgtgggaagaatggaggtactgaggcagggtgcagtggctcacacctgtaatcccagcactttgggaggccgaggggggaagattgcctgaggccagcagttcgagaccagtataggcaacatagcaagagcccatctctaaaaaaacaaaaccaaaccagattagccaggtgtggtggctggcacctgtgttccaactacttgggagactcatgtgacaggaagatcacttgagcccaggagttggaagctgcagtgagccgtgatcttgccactgcactccagtctgggcaacacagcaagatactgtgtcaaaaaatttttttttgataaaaaataaaagagttac

SEQ ID NO: 541449 - DNA, 725 bp, Homo sapiens
  misc_feature (149)..(149): n is a, c, g, or t
gagtaggtgcaagtcggaaaccggtgaacatcttcatgctggattgatgttccgcaatggattatgagacctcacgctggtcatgagaactagactgacgtcacaggttgcactaaatatattatgcgtgcaaggaacaaaagcgtggntttagaagtcaaatgtgatagcgataagtagatatgtgaccattatagtagtctttcagtagttatttatatcttatgtgcatatgcattcaaatcgttaagtgatagtgtagatgtatggatgcaatgtaatagtgcttaccattatagggcattttatggcgttggagaaagacgtaacgtggaatctacattacaagggattcttgttgatggtggtatacagttctaggggggtctatctggaatatggtcaatggatttagggatggggagaagaaggaaccccgatgaagacctgtagctgttgaccttgttatgagaaacagaataagttggcagcaggtttcatactgtttgctagatagagagtagtgcgtcgtgggagtcagacaactgggtagaaccctcagtgttatcgaacaggatgaagactacctgtattgtgaggtgtgactgaatcaagggtttgccggtgtttcatgtgtgggacttgaagtttgatggttggagggacgactgggcttccaatgaaccataaaatgtcaggtgttttcggaatctccagggggaatg

SEQ ID NO: 541450 - DNA, 196 bp, Homo sapiens
ccttcttacgcggatgacatattttccgagtatcttacattagtttagtggggcctgcaggtctgtcccaactcagagacagacctgcaggccatgggccaagacagagcccttccccaccaacttgacctgtggatgaaaagcatcatccctgtatgctggaagtgtgtagtaagatgacggatgtgttggcaga

SEQ ID NO: 541451 - DNA, 317 bp, Homo sapiens
ttaactatctagggtttgctataacaaatactatatactactacataccctatactacctatagtcctatcatatatctctgcctctattctatctatactagcagatttttctcacctatagtacaaagaaatagcgatatatattttcatgtaatttgattttggaattctgtcaccttatgtagtgagttcttccaaaatataatttttttccaataattgtcaagttgttggcttttattgtattgaatgaaggctaataaaactagagtgccagagaagtggttaaggaaaatctcaggttgattccttatg

SEQ ID NO: 541452 - DNA, 100 bp, Homo sapiens
gctgggaatgtagactattctggacggtagtcgaggcacgtgctgcaggatgaactggggtccgtagcgggcgctcaatcccatggtgcagcgttccaca

SEQ ID NO: 541453 - DNA, 174 bp, Homo sapiens
tatcatacaacgtgtagccattctctacgtcaagggccatcttaccattggagcaggtctgggaatcacaaaggtgaaagccattcctccttcatatcctggaatctcatcctgcaggcggccaatattgtcttcgtaaaaagtggcaccaggggttaccaacttcaattccga

SEQ ID NO: 541454 - DNA, 171 bp, Homo sapiens
cgttttgatgtgagagagacagagagacaaagtaggtggtgaggccaggcgttttgatgtgagagataagattgggcgtgtggccagaggcttttaggatacaggagttaactcaggatgagctgccattgcccactgcttcctgggttgcaagacagcctcttctcccaa

SEQ ID NO: 541455 - DNA, 261 bp, Homo sapiens
ctgggtactctaaggatccttcgcgcggattctcagagaagaacagcagaatggggagaagatgagacagaggctgatgccccatgccagcccatacttggggagcgctggagccaggaagatactctagaggataggtgccagggtgctgagagatgagcctgaactgggtacgtgggacagagagaagtcagcacagagtcgacgccaggagaaaggggggaggagaagccgttggatggacaggaatccggcgggcga

SEQ ID NO: 541456 - DNA, 793 bp, Homo sapiens
  misc_feature (109)..(109): n is a, c, g, or t
  misc_feature (526)..(526): n is a, c, g, or t
cgcaggcctcagccttccaaagttctgggattacaggcatgagccatgcgcccgggctattattattattcttatttttgagacagagtcttgtatgtctccctggctngagtgcagtgtgtgccaaccctggctcagtgaacctccacctcaccgggttcaagcgattctccctacctcagtctacagagtagctgggattacaggcacctgccacacgctggtgaattatgtatttcagtaaaaacaggtgtggggtctcgctctgtcgccaaggctgagtgcagtggcatgatcttggctcgcgtgaaacctcacacctcatgagttcaagagattctgccttggtttcctgagacagctcagggcacccaccacacatgccgggtagttaggtatcacacgaacgtgatggggttccaccagtgtggccagaaatgatctcgatctcttgaccctgtgtgatcccgccaatcttggctcccaaagtgctgggactaatagcgcgtgagcaatatgagcgtgncttaaatttttctaaaatagcaagagtaacaattaatttgtcgtttcttaaagagtgtcttcccaaggttattttctcaacaaaagtctttgttgggtaaggcaaatctagttagaaacttgtttgggaaggttaaactagccacggttaatgaaggggcatttctttgtgattcaggaataatattacgttttataggagggggatagttgaaaagaacgggatggagtaaggatttctgaagaaagcttggacgtgccgagaaca

SEQ ID NO: 541457 - DNA, 1523 bp, Homo sapiens
  misc_feature (227)..(227): n is a, c, g, or t
  misc_feature (391)..(391): n is a, c, g, or t
  misc_feature (601)..(601): n is a, c, g, or t
  misc_feature (959)..(959): n is a, c, g, or t
  misc_feature (1232)..(1232): n is a, c, g, or t
tctgtggtgttgctttgatgggttgtctcgctatgcgcttgcttgtgtaccgacctctgatcgttcggcgcgttgtgtgtcacagccgacggtgcgtctgtggggtgcacagagttgtttttgtcgatcggaccgtggtacacgccgggcgtcgttggtgttggcgttagtcttccccaaagatctccccgtgttcgtaaagaaggtggttcttcctcgacgaggcncgcccttttttctcacggggcggtgagttaacaatgtggccacaccacaggcattgttcccccccgggcaagccccacgtcgttttttcgccgggttttataaaatacgcaccggggtgtgttatctaccaggggttcgcttaagattggtggaaaaatgttgncgagatttttttaagaacaggcctgtgatgagtgtatgtccccccctgtggggttaaaccagtggaacaagagtgggtgtttttttggggaaagagcccgaccctttgtatgttttgccgttggccgcccagttggcccctggcccccacaaaggcacttctcggctggtgtgcgcccacaccgtggggatccgccttctcccccccccncaaggagccctttgaggggtcttttaaaaacgccctctttttatagcgcgcacgataactttatttttaggggggcccgaaagttcttctctctctctcgagaagggggagacacacaaaaatatttctggggtttaaagatgttttttctcggagagagagaggagataataacgcgcgccaaacccgctcccttgggcgttttaagctcgggggccccccacgctctgagagttaagtggcgcacacactaaactcgccacacgtggagccctctctctcactaaagtttctcacaggagaaaaaactctgtctctggctcgaggcacacacagagagggagaacacacacacagngcgccccctcagtgtgacgcctcctctgtgtggcctctcactcttataatgtgcgtaacccctggtgaacacatgcgtatatgcacatgcccctcttgtgagaatatatccttgtagaaaatgtctgtgagacacccacacagagcgcccacctgtatattctcgtatattgtctcacatctgtgcacacgcacagagatataacctttatataaatattccccacaaattgagatatagagagagaaaattgtggtgttcacactgggaganaactctggctctgtttgagagcccctctcccaattgggagagcttgagaggaggcctcgtggtgtctcctctgcacaggcacttggggagctctggccaccaagccaaggagtccagccagccatgaagccccggagctgtagcgtgtgccagccaggcggcccaatcccaaccagccatggggaccaaccagtgtctgccaatccattcctccagttatggccagaatgtgctatttttcactgttaggtgttgcttttgagaactaccaataaaactctcccacccaga

SEQ ID NO: 541458 - DNA, 255 bp, Homo sapiens
  misc_feature (11)..(11): n is a, c, g, or t
  misc_feature (49)..(50): n is a, c, g, or t
  misc_feature (245)..(245): n is a, c, g, or t
  misc_feature (250)..(250): n is a, c, g, or t
ggcatcaccangggacctcaagccccagaatatgcagcaaaaattatannctttttatcttccactttcccttccctcagaactaaaagtctttcagcacgggtaccagccctagaatttccagtacaccagcagcagcctggaaaccacatcctcatcaaaagacagaaagaaaaaaactcgagccagcctgagaaggaccctattttatgctgttaaccactgagactggcatcctcacaggntgagnaaggg

SEQ ID NO: 541459 - DNA, 215 bp, Homo sapiens
ataacgaggaataatgcagatgctatcagcactgagcccaataacttgagaggcccgctattccttccggtacaacggagtgattcaccgtaatattgtgggctttgagcgcggcagcctatggcaggggtgtcgtggtggtcattatgcgtatatagggtcaacggacgtttgccagctcatttgtggggaccaacatcaacaggatgtttctg

SEQ ID NO: 541460 - DNA, 400 bp, Homo sapiens
aacgatgtgtcctcagcttctgaggcggggtcataaagaaaggttacacgttttgttgttgttgtggttgatgacagatgtttcactcttgttgccgaagctggagttgcagtggcgcgatctcggctcactggaatgctccgcctccctgtgttcatgtgattcccctgcctcagcctcccgagcagctaggattacaggtgcccaccagcacacccgggctaattttttttttttcggtaatttgttacagtacagatggggtacgacctattgttggccaggttgggtctggagactcctgactccaggtgatccatgtggctcagcctccagtcgtttggggactcagaggcgtgagccaccatgcccgccccaaaggtcctgggttctaccttgg

SEQ ID NO: 541461 - DNA, 1292 bp, Homo sapiens
agctggagatgattagttataggacatccatatccactccagcctgggtgacagagcgagacctttgttcttaacaacaaaaaaaaaaaaaaaaaaaaaagagttagaacgaggtgtgcaaacttgtgcgttgtggccaaagagggtctgtggcaagtgtgaattaggaacacgagttcactttcaaattaagagagagaaacgagaaacaagtgtgcaagagcggtgttaaatttcacccacatttgttctaattcctgtggggccatgtggcttttccccagagggaagagtctcgacgtgtgtctctcaattgagagacactctcccttgtgatgatatttaataaaagacactatgaggtataagtcacttctgctgttgctccccaaacgctttgatatataaatttcaccctctcgccagaagagatatcacgagtgctcaaacacccacaaagagtgcctggtggtgccgatgagaggactcatcactttgctggggctatcagagaaaatcttactctcccccaagaagactgcggagccctttctgtgatgaagcagcacaagaacacgagtaggtgttctttccagagagaacgcagaggatatctcagaagaagaagaggagtgttataacaagttgagtacgtgtgtgtgtcttccccagaaggcctctcctctctgtggtttgtgaaggggacacccaaaggaggcagagggaaaaaagttttttcctcagggagagagaaaaaaaacctcgtctccgcaggagctttgtcctctcaggagagaaagacgttttttgaccacgcggttcttcaagacaagcgcttgatgaggtgaatgatgtttgcacacgatctgccgggtggggtgggcgaaaatatgatgtgaggcctctgatgacaaacatgttgtgttagtcgtctctgaacgaatgtcgcgtgtgagaaaatatcacctctaatgtgtggggagagatgtcgtacacgctgtgtttggggcgcaggtataaactctctgtgtgggccccatctacaagaactgtgtgggtttgttgttattagataaagagcctctctctcaagagtgtagaaacctaataatgggtattaaatcactcagggagtactctaaaaagggtgttgaacccccctgtgtggggtcggcttaacccctctacgccagtgtgacaccttaataagttaggtgtgtgccaccaacaaggagtgcttacaaacgaagaacgtgggggtacatcaacaagagcaagtttccatcgagtac

SEQ ID NO: 541462 - DNA, 166 bp, Homo sapiens
aagaatcgagctcggtaccgttttgggctgtcgtgcccggggtcagcgcatggtcttccggtggtctctggctcgcgcggctctccaacgagactcgtgcgcttccccactgatcatggtgactccggaccatgagcgctcactcgatgttcatgcaactggggcc

SEQ ID NO: 541463 - DNA, 203 bp, Homo sapiens
agtgatgcggggagtcacagttagaaggcggccggtgtgttgctggcacgaaagtgctgaggtccaccagcgtagtcctgatggctccgcaacctcagattaatagtggctcgaggcacggagccacacagggcgtggcgtgccaggccatgcggacgttagcggcgcgtccctcctggcaggctagcgggcgcccggcacca

SEQ ID NO: 541464 - DNA, 84 bp, Homo sapiens
ccccaaggggtggccgtcctgagggggaagtgagaagggctcagagaggacaaaataaagtgtgtgtgcagggaaaaaaaaaaa

SEQ ID NO: 541465 - DNA, 405 bp, Homo sapiens
  misc_feature (26)..(26): n is a, c, g, or t
  misc_feature (67)..(67): n is a, c, g, or t
  misc_feature (95)..(95): n is a, c, g, or t
taaattgaattcacatgagaaaatanagagcatcagtaaaggtaactataagggaaacataaagtancaatatgtgtgttttgtttgtaactctntaaagtctcctgtctagtttgaaggacaaattcataaagcaataattataaacttgtgttgatggatatatacataaatttatatgacagaaacacaaaggaacaggaaataaatggagacatatagaaccaaagtttttgtatattactgaagttaagttggtattaattcaaactagagggttattggttaaaatattaattgtaatcccagggaaaccacaaaaagctcaaaaaatgtataaaaaatgacaagataggttagaaaatatttaatataaaataaagcattagtggaggatagagaaac

SEQ ID NO: 541466 - DNA, 528 bp, Homo sapiens
  misc_feature (3)..(3): n is a, c, g, or t
  misc_feature (73)..(73): n is a, c, g, or t
  misc_feature (88)..(88): n is a, c, g, or t
  misc_feature (150)..(151): n is a, c, g, or t
  misc_feature (158)..(158): n is a, c, g, or t
  misc_feature (181)..(181): n is a, c, g, or t
  misc_feature (206)..(206): n is a, c, g, or t
  misc_feature (240)..(240): n is a, c, g, or t
  misc_feature (258)..(258): n is a, c, g, or t
ggntagtacggcggctacggctctaccatgtaaaaggtaggacctggtgaagtaaaaatggtgttactgtggngaactaaaatgtgtncaacgaccgaagaaaccctggggataagagtgaggggattggatccccaaaggtaactctcnnctgcttnaaaactgaattcccgttctagtncctaacattctcttactacttgccngttacaaatactatttttaaatgaatctatatantgactttcttatcaatcntcttacgtgcatcaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgtt

SEQ ID NO: 541467 - DNA, 669 bp, Homo sapiens
  misc_feature (3)..(3): n is a, c, g, or t
  misc_feature (73)..(73): n is a, c, g, or t
  misc_feature (88)..(88): n is a, c, g, or t
  misc_feature (150)..(151): n is a, c, g, or t
  misc_feature (158)..(158): n is a, c, g, or t
  misc_feature (181)..(181): n is a, c, g, or t
  misc_feature (206)..(206): n is a, c, g, or t
  misc_feature (240)..(240): n is a, c, g, or t
  misc_feature (258)..(258): n is a, c, g, or t
  misc_feature (539)..(539): n is a, c, g, or t
  misc_feature (553)..(553): n is a, c, g, or t
  misc_feature (561)..(561): n is a, c, g, or t
  misc_feature (573)..(573): n is a, c, g, or t
  misc_feature (576)..(576): n is a, c, g, or t
  misc_feature (582)..(582): n is a, c, g, or t
  misc_feature (586)..(586): n is a, c, g, or t
  misc_feature (612)..(612): n is a, c, g, or t
  misc_feature (643)..(643): n is a, c, g, or t
  misc_feature (664)..(664): n is a, c, g, or t
ggntagtacggcggctacggctctaccatgtaaaaggtaggacctggtgaagtaaaaatggtgttactgtggngaactaaaatgtgtncaacgaccgaagaaaccctggggataagagtgaggggattggatccccaaaggtaactctcnnctgcttnaaaactgaattcccgttctagtncctaacattctcttactacttgccngttacaaatactatttttaaatgaatctatatantgactttcttatcaatcntcttacgtgcatcaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacnaaaaaatttgcagnactcctgnttattcttttantgnttttgnctgntccctgtttttttctgtgactgctgnaacttaaagtttttgaaactgaattgcttcnaataaattgaagatttgttanaatta

SEQ ID NO: 541468 - DNA, 111 bp, Homo sapiens
ttgagttgttcagtctcttcccagagcacatctgaacattttcatcttccagttgcagctggcgtagggctctcgcctgtaatcccagtacttaagaggctagatggggag

SEQ ID NO: 541469 - DNA, 241 bp, Homo sapiens
gggggggctttttttttttaaaaaaaaaaaaagacccaaaattttttttcccccccccccccccgcccaatttggggggtgtttttttttttggaaaggggttttaaaaaggggtatttgtttcccccaaatttgttttttttttttccccctgggggggcccggttttttaaggcccccccccctaatccccgggggggtttttccccggggggcggggaaaagggggttttttttttca

SEQ ID NO: 541470 - DNA, 159 bp, Homo sapiens
agtatcccctcccatatgagacatctagtatcacacgtctgataatcttgcccggtccttttccttatctttactcttcttcttcttgcttgttgatcgttctctttcatccctgacttctttctttggtctttagtctttgactgtctacataggcga

SEQ ID NO: 541471 - DNA, 847 bp, Homo sapiens
  misc_feature (13)..(13): n is a, c, g, or t
aatctaaaataanagttaaaattatatctagggaagagagtgggaggagggagaggatcaggaacaataactatcaggtactgtgcttagtacctgggtgaagaaatggtctgtacacgagacctccgtgacatgagtttgcctttgttaacctgcacatgagccccagacctaaaataaaaaaaaaaattaagaattttaactcaattagatcatagacttaaatgtaaaatgtaaagtagtaagacttttaggagaaaaaggaggggaaaattttcagggggatatgaagagaggttgattaatgggtccagatatacagtttgatagaaaaaaataagatctgtctgatagatcagtaaggtgactatagtttacaatcatcaatcgtgtatttcagaatagctagaagagaataattggaatgtttctacaataaaagaaatatttaaggtgatggatataccaattacactgattttttacaaattatatgaatattacattactgaatgtaccctgaaaattttaaaaaaatgtatgattaacaattttgagcaaaaaagaaaatatagatgaatgaaaacaaaaacacaatgtaccaaaatttatgggacccagcaaattcagtgaagcaatgctaagggggaaatttatagctataaacacatttaaaaaccaagaaagatctcaaatcaacaatctaactgtacaccttatgggattagagaaaaaagaataaactaaaccaaaactagtagaaggagggaaataataaagattagagcagataaccaaagtagatattagataaacaaatggggaatagaacaagggtagagaaaac

SEQ ID NO: 541472 - DNA, 151 bp, Homo sapiens
gttctcccaagcccctccaccatgtggagacccagtgagaagctgtctgtgaaccaggaagggatcctcactagagagcgagctggcaccttcatcttgggcttccagcctccagaactgtgagaaataagtatctgttgatgaaccaaaa

SEQ ID NO: 541473 - DNA, 110 bp, Homo sapiens
ttctatatgaaggcggctggctcaacacgctccgtagaccaagaacatgacatcggagcggctctggacaccacccagtattcaaagcatcccccgcagctggttgtggc

SEQ ID NO: 541474 - DNA, 174 bp, Homo sapiens
tctagaggttccccacggtctcgaagaggtgcacggtgataaactgtttgcagatttcttttatacagatatacatgggttcatgaatattacacgtcacttctaaagcaaccagaatgagggacacgtaaagcaatcctgtacattcactagagaactttgcagctcagtttc

SEQ ID NO: 541475 - DNA, 226 bp, Homo sapiens
gggtgatctaaggatccgtctacctcgcagtgggtgggatacaggcgccaccaccacacccgcctaatttttgtatttattagagacaggtttcaccatattggccaggctggtctggaactcccgacttgtgatccacccactcagcctcccaagtagctggaactacaagagacaagggcttgctctgttgcccaagctaaagtgcagtggtgtgagtgtagcc

SEQ ID NO: 541476 - DNA, 961 bp, Homo sapiens
caccgaccctcggatggtccgctcctccccctacccccactggacgtggcccgagtggtgagtgctcccatttcccacgtgaactcagatgagcccgaggctgtcctgtacgtgtgccagtggcggccgagtggatgagcaccttctcagcaaggacgtggttgtcgatgaggtgtgttccggcgcaacggcacaacgacatggatgagccctgttctcgcgccgctcatgtacaatgcagatccgccagcatgtaatcctgtgttacagaaagtacgcttgagctgctggtgtcagacagtgatgtggtcgaccagtcctgagtatgaggaggaaatgtccaagatatgtatgacgtatctgttgaggacagctttcgccagatctaaagatgagaagatcttgcaacattaaggccactgagcatgtgatctctcccatggggtctggtcttcttcactcctggacgggcagcgccataggagcatgttcctgcccctccacggggtctgacggaacgatctcctgacgacacatcgagaactgtggctagttctgatgcctgctggagagaactttactattcatggacggctgcagccggatctcgaagtactcgcgtgggcaaactggtgaagaaccggactgtggactgggctctaacggcagtacatcgccgtatggagtccgctccttgaacagaggggcattccacctccggtcctgagcggcgcaccgaacgttgagtccgggccacattcagccaccgtcaccatgttcctccacgactcagaccgtgggccaaacaaacccgtttccatagaaccaatctctgggccagacaagggcccctatcacgggtcaagccgccccgcactagaaacccgcgcccggcctcagatcggctcccagccactaaccccgtctccccacaccccttctgccccacaccgcccccacc

SEQ ID NO: 541477 - DNA, 677 bp, Homo sapiens
cggacgcgtgggttttcttttgtttgtttaacataaacatagaaactaactttatttctctggaggaagcaggtactggaatgccggagcagcgaacttcgccaacaggcgggggggaaaagcagtggaaccgcgcgtgggggaatgggggggaacgaggaagcagcaggatgtccgctccagggcggctgcgccctgggtctccttccagcccgtggggccttgggccccggggtccccggccaagaagaactgggtgctgggcgacccttgtctccggcttgcctggaggccacctcagggctattgtccagaggcgacaaagatcctggaagggcgcaggccaagtgtcccattcaaagtccattgggtataagtgcgcacaattgtctacatttctgggcgccgaagaccccatgctggctgccaggggccccctgtggaaagaatgggcgccaagtcctaaggaggtcccaccggggtgcctggtccgcgctcttccctgggtggccaaacacattcccggcgctggcccagggtccaagcgctgggtgttcactccacaggtgctgggtgcacccatggggcaagggcctgggggggtaccataatcacaacgcaaagggccccgcgccaggaccacgggccagaggcaggtcatacccagagcctgcgtg

SEQ ID NO: 541478 - DNA, 103 bp, Homo sapiens
ctcagtgactctggcttctatctctgtgcctggagtggtcagctagcgggagtagatgagcagttcttcgggccaggggaggacctgaaaaacgtgttcccac

SEQ ID NO: 541479 - DNA, 265 bp, Homo sapiens
  misc_feature (88)..(88): n is a, c, g, or t
  misc_feature (97)..(97): n is a, c, g, or t
  misc_feature (103)..(103): n is a, c, g, or t
  misc_feature (108)..(108): n is a, c, g, or t
  misc_feature (114)..(114): n is a, c, g, or t
  misc_feature (118)..(118): n is a, c, g, or t
  misc_feature (137)..(137): n is a, c, g, or t
  misc_feature (143)..(143): n is a, c, g, or t
  misc_feature (175)..(175): n is a, c, g, or t
  misc_feature (194)..(194): n is a, c, g, or t
  misc_feature (241)..(241): n is a, c, g, or t
  misc_feature (259)..(260): n is a, c, g, or t
gttcaccaaatctgtgacttagaaaaacatgtggagggttctgccatcttctgaattctgatcctcactgagtcctcattgaaatgtntatttgggngaagtnatgtnttaccngggncctccttcccagtgaactntttttntcagtatgtaatttctagttcagagtctaagnacttgcctttggtaaatgncctggtataaatctggtatgtctaaatgtacttgtagtgtacacctnaataaaagtgtaatgggnntcact

SEQ ID NO: 541480 - DNA, 185 bp, Homo sapiens
gggtcggtaccgtagttacgggattcagtccgcttggaggggactgagcaagctggtcacaatttcgccccagatcataacaagcagccatctatccggcacaagcgatgaatgtttctgaatgcaatgttctggcaatacccatccttcatgatctaggatcttccaacaaaatcccctaacgg

SEQ ID NO: 541481 - DNA, 130 bp, Homo sapiens
ggtagatctagaggatcctgagagactgtgttgatggagctgcccatcacattgggagcagaaaagggataatgtgagcagagaagggggagttgagaacaagaggggagagagggatgcgggaagtggc

SEQ ID NO: 541482 - DNA, 583 bp, Homo sapiens
  misc_feature (63)..(63): n is a, c, g, or t
  misc_feature (143)..(143): n is a, c, g, or t
  misc_feature (179)..(179): n is a, c, g, or t
  misc_feature (356)..(356): n is a, c, g, or t
  misc_feature (367)..(367): n is a, c, g, or t
  misc_feature (451)..(451): n is a, c, g, or t
  misc_feature (456)..(456): n is a, c, g, or t
  misc_feature (469)..(469): n is a, c, g, or t
  misc_feature (486)..(486): n is a, c, g, or t
  misc_feature (542)..(542): n is a, c, g, or t
  misc_feature (566)..(566): n is a, c, g, or t
gtccatatcaccctaaatgattatcaaactaatcatttagaaatacctaagggaacagtgacnttttataccactattaaaaatgtagttcaggtaaaataattatatgtctgcatagttgggaaaggacaaagaaattgacngtattccttcccaaacagagcaccaatgtggccctntctttctctcttatttattggcttacctttttccccactagaatatatgctggcttgtgtgtagccagcattggctctatgactaatttccattaacacagcttggttaaaaccatataatagccacaatactctgcatcactatattaatagcaaattgaaaatttttttagtganagaaccagccnatagtttggaaaaattagtttggaaaaatttcaaaactaattatactttttggccagttttaaaatattggggaaatgaactangtatnggttaatttcacngagaatggagtttaacntatcctggatatattagtgatgagtcttaatgccagtgtttcatgagactgtttanttcagcttaactcccaactggtgncatttgatcattactcg

SEQ ID NO: 541483 - DNA, 806 bp, Homo sapiens
  misc_feature (353)..(353): n is a, c, g, or t
ggcctacaaggctgccgctatgggtcatgtcgtgcaactgggcatcgcactgccgagtgagctaggcaatccggggtgcgacggcgccacgattcctataattggccggatgaatacctttgatggggggttcagctatgttggcctgtgcaggaatctcatatttcctagaactctggtaacccattggtcctacgtgattgaccaaaatgcttggagacttcaacctgatgtgaccgacccaatgaagcgtccgatgtcgagtaatgcctccatgcatcattcttaggctgtgtctgctctagctctccattggactaaggtgacagtctcctcgaatgtgaatgtccatnctcagatgacttgtctcggccctttgatcaggggttagagtctctggatagtttcctatcagaaggcgttatcattatacgttccctacgcagtgtcccatgcatcactcagaacaaattattcaacctatgttatactgtgatgggtggctgcttcgtattcactcgcaatagagactcctgtattgttcctcccataggatttagctcgttaccccggaaatgctatctggtcacggctgaaacagtaagtggctcgagatatcgccggaagtgactgcacgacgtagtagtcgacatgcttgttttcgtcattcgcgctagactttgtgtatgcctttttgggtggatacatgctctgtgtcatctgattgctgaagtggggcggatgacacttacaatttgatgtccaagggataacctgatggttccaagttagaaagaggccagtac

SEQ ID NO: 541484 - DNA, 852 bp, Homo sapiens
atgaatggtgaggagcagtactacgcggccacacagctctacaaggacccgtgcgcattccagaggggtccggcgccagagttcagtgctagtccccctgcgtgcctgtacatgggccgccagcccccacctccgccgccacacccgtttccaggcgcgctgggatcgctggaacagggatctcccccggacatctccccatacgaagtgcccccgctcgccgatgacccggctgttgcgcacctccaccaccacctcccagctcagctcgcgctcccccatccaccggccggacctttcccggaaggagccgagcctggggtcctggaagagcccaacagggttcatctccctttcccgtggatgaaatccaccaaagctcacgcgtggaaaggccagtgggcaggaggtgcatacgcagcagaaccggaggagaataagaggacccgtacagcttatactcgggcccagctgctggagctggagaaggagttcttatttaacaagtacatctcccggccccggcgggtggagctggcagtgatgctcaacttgacggagagacacatcaagatctggtttcagaacaggcgcatgaagtggaagaaagaggaagataagaaacgtagtagcgggacagcagtcgggggcggtggggtcgcagagccggagcaggattgtgccgtaacctcgggcgaggagctgctggcattgccacccccgccacctcccggaggtgctgtgcccccagccgcccctgtcgctgctcgggagggccgactgcctcccggccttagtgcgtccccacagccctccagcgtcgcgccacgtcgaccgcaggaaccccggtga

SEQ ID NO: 541485 - DNA, 807 bp, Homo sapiens
gggcgggcgtgatctagtctgattgacggaggacgctcagtgctgtgtactgaggatgagcgagtggtgagacgtctgcgagcagcggtgagagagagcccagagatgagcgctcgttgggacgtggatgatcgattatgtgtgaatggatgacatttgccatgaatagagataacctggcagggaagagagaaagatatggcataggtacctgctcttctgcatgttgcggggcaggaatgcactgccgcagcggcgtaccaggataacgtgctactgtcccaattgggttggatgcgcctcgatgtaacctccaatgaaatgatgactacggtcaggtacacaaactggccaaagaagctgcatgacctgatttagccatcagatatatgtgtgcctatcgatactcaatacacgcgatgatcaacagagcagatcggaacctctcatgtaatggatcccgtgggtgaatgcgctcgataatctaaacacggtggtcccctgggagttacatccacaaggtgctagttgggccgctgcctggcgagtgctgtagatgacaagggctgtctgtactggtgctacagcccatgtcgctcgtgttgaaaacatgggcctatgtcttggactagccatgatggctatcatggacgctagttgaagagcgtgttctttccgggaaacattaaagaaacattgctgaggtgccctggcagatgaggctcatcaaatgcgtgccaaggggcttcctcgaaagtccctaatgccatttaacgaaagaaaggacgagctggaagcgtgtgggca

SEQ ID NO: 541486 - DNA, 375 bp, Homo sapiens
cggcacgagcaggaaagtacctgtgcagatgctggcacttaaggcctatggagaaaacatcaggtgttatagagagtctgttgtagggaattaacggaccactgagttaagtcaaagaatggtctatttgagtttaggtggtctggtttatggggaccctggctaaggagcatactccaaattcttggtgttaaccctctcagtagtcataagaatagtctccctggtgcactgtattctctcaaaggttttaaatgtttgcatgaagccatctttagaacgtcagatggtctctcttcaactggaatgacaagagctgaaagaaatgtgtgaccacgaggacaccgaccgatgagtgacatgctgagctggtcc

SEQ ID NO: 541487 - DNA, 156 bp, Homo sapiens
aggggggcgtccctgagccgaatcttcacttccattcaggtaagcggagatctccgtgagggctgggagctttgtggtctcctctctctgcaatggtctcatcgccgcccagctgctcttgtactggaatgcaaagccaccccacaaagagagcgt

SEQ ID NO: 541488 - DNA, 118 bp, Homo sapiens
ctgcgaagcgcttcttatagctgatggattccagcagcctgaggcaatagaatttagcagatgctgggagaaatggagagctaaggaaaatgaaggaactgagacagagtgaagggga

SEQ ID NO: 541489 - DNA, 321 bp, Homo sapiens
atcttcgctatatggagatatccttcgttatgtatccgtgtgtgttttctttgtcgctcgtgtccactgggctgtggcctgtcgtttcacttgcaggtcagggtttagtccgccctgtcatctgtagcagtatctctctcaccaaccacgggcatggatggctcagtagcaagccatctagacatcgtgcaaaactgatttgggcgccaactacattacgtaccgccttattagcagatgtggtcctccatcactgcttccgtgagaattgatgagcatgaatgtgacctgacagatttcggccaactggtgcccttcccc

SEQ ID NO: 541490 - DNA, 101 bp, Homo sapiens
ggcagtggttggtgccgacgcagcagataaatggagggtgtcgaggagatcagatgtgagccccgagtagcaagatgtgggccaaaaatagacactgggca

SEQ ID NO: 541491 - DNA, 190 bp, Homo sapiens
acgctcggtctaccacttacggttcgctgtttgtggcacactcctgggtcctgttctgcagacttatgaagcctagacggaagaactgtctcacttgccagcaccatcttctctggaatcccgagttgctatcatctgataggattatccctctgtacactgcagactggagaacacaattatgtttaaa

SEQ ID NO: 541492 - DNA, 686 bp, Homo sapiens
tgagacgcggccccggcggcggcggcagcagctgcagcatcatctccaccctccagccatggaagacgaggaggaagaagaggaggaggaagaggaggacgaggacgaagacctggaggagctggatggtgcttggagatggaatgccctgccgcctgtggcttgtcctgctggccccatgtgcccacctgccccatgcctgcctggcgcgccctctgatggacttctggaaatgacttctgtgcctgcctggctgccccgtgtggacccgctgcctggcctgctccccgccgtcgcccctggaggctggcagccgtcttgtggaccctgagccctggtgtctgtctgaccgtgccctgcgccatccccgctgtcgtgctgccgcagtctccgccctcacctcgtatcactcgacggacgactgatgcctccggccctgggctcccacacaaacaacacaacgaagacaagaagaaacaacagaaacaaaaaagagaaggaacaaaagaaaacaagaaacaaattaattacaatcacacccgccacacactaactacaccaccacacaccaaacaactcacataacctcccatccacactcaccacccaccaacacaacacactaccacaccgacacaataacaacaacaaacacacacaaaaaaactaatccacactaaccaaaa

SEQ ID NO: 541493 - DNA, 436 bp, Homo sapiens
  misc_feature (65)..(65): n is a, c, g, or t
tttttggggggggtttcccttttccccccccgtggggagggatgggcctttaaaaactggggttntttaagggcttgggcccggggttttccccccaaggagttttggtttttttggttcagggggtcccaagaattcccccccaaaagtttttttttttgggtttccgggggggggccccccggggggccccccccttttttttttcccccattttgggggggggcccccgggggtgggaaaaggggggccccttttttttgttgggggggccccggggcccccccctgggtttttcccaaaagacccttggccggttggggggggtacccccccctttttttttttttttttttttggggggggggggggggccctttttttttggcggcccccttttccccccccctttttttttccctttttccccccccca

SEQ ID NO: 541494 - DNA, 376 bp, Homo sapiens
  misc_feature (207)..(207): n is a, c, g, or t
ttatggaaatctttagcttttaatcatttttaccaatttgaacagtttaataaactggttctgctctcttctgaatctcatgcctttggcaccttggtaggtgcaggaggagctcagtgcaaaaatcactttggggcctcattaaccctttagagacaagctttgccccaggctgcggacaggacagatgcttagataaggttgaanccagttcagtctctactggattagcccactctccccttccccacattatttagtaataaaaagtaagttaaaacacccttattatttagctgttaagactataatgaaactgcgcaaatctctctggaaccatgtgcccaggatatccagctatttttataatctaagc

SEQ ID NO: 541495 - DNA, 996 bp, Homo sapiens
ttgggctgctgttaaataacttaaaggggttgatgtggggatgtcacaatggtgaggtattgtttgtgctccaaggtgttcttcagttgccatcctcaaagctggttagtgcatgtggatgtgtaggtgcagatgtggtgttccatgttttcttccagtgacaggtgtttatgtgtgaggtgtcccaggagatgccccaggaattgagtccctcggtaccatgggacaacacaacaattataaagaggggtgcttcgtgcccaccccctgtggagcacatatcccacatgtgtccagacatagaatggacaacatgtggatgcgccaggatgtgtgggccaattcttggctaataaagaacagtgcggccagttattccaagagaagccacatatttggcgcgcttggggtgacactttattcttctattctggggcgcaagatcccctaattttgcgcatagacaccccttttcacttccttctcacacacatctggggtgagatctgtgggaacgcccacatagtggcggaagggtgtggcgctctatatgtgcgtgaggcaagagagggccctcctggggtgcccaggggagggtgaattcgtgctttcgacgtgcttgggggaagtgtggggtgtgcgccaacacccatgacgtccctagaatgccccccttaaggtgggggaatgctgcgtggtctattgcgggagtgagaacaaagcaatctcacaagcggggggacaaacaccgtgtatccaggggggggtccaatcaccccacacaatgtgggggccactgggggtgtgtttttgtgctccccactgttctgtgggagtgcctttgtgtgtgcccactctttgtaggtcgccaagggcctcgactagcacgggggtcatctaacgccgcaaggggtgccctgggcattgtggtcctttgtaaaccactttttttgccccatgacacaagtgtggcttgggtgggggtgtgatctccca

SEQ ID NO: 541496 - DNA, 368 bp, Homo sapiens
acctggtatctctttagaaacttctccatttcatccaggttctccagttttgttgagtatagccttttgtagaaggatctgatggtgttttggatttctttgggatctgttgttatgtctcccttttcatttctgattttgttaattagaatgctttccctgtgccctctagtgagtctggctaagggtttatctatcttgttgattttctcaaagaaccagctcctcgattggtgattttctgaatagttcttcttgtttccacttggttcatttcgcccctgagtttgattatttcctgccgtctactcctcttgggtgaatttgcttccttttcttctagaccttttaggtgtgttgtcaagctg

SEQ ID NO: 541497 - DNA, 168 bp, Homo sapiens
  misc_feature (9)..(9): n is a, c, g, or t
gccgccttngctgcgcccctttcccgctgctgcccccgccagctcccgagcgcctttcatgcgatcaaagttacggcgagacggcgaagccaacctgatgctgaaagtgatcaccttggcaccactgtcttcttgtggatctatctcatcaaacaacacaatgaagat

SEQ ID NO: 541498 - DNA, 239 bp, Homo sapiens
tgggcgcgggccgacgaatctcgagtgtcgctgactggagcccgagatgatgggctcttctcttggggatcccaactggttccctatgcaatccatgtagaatcctcagaatttgtcgtataaccagctgtacgagggcgcgaacgtgatcggattacagatggtgaccatgcgcgggaggctctgcaggcaggcattgccatggttacgtgatgctatgctagcattctctgagccca

SEQ ID NO: 541499 - DNA, 425 bp, Homo sapiens
  misc_feature (159)..(159): n is a, c, g, or t
ccccttggcagagctccccttggcagagctccccttggcagagccccccttggcagagctccccttggcagagctccccttggcagagctccccttcgagagctccccttgtcgagctccccttgcgagctccccttggcctcccaaagtgctgggatnacaggcatgagccaccacgcccagtccttttaaaaaatcatttgctttctaagtgtttcattattttttctgcctctgtctctggacagactaggacgacagatatttgccaccacatctggctaattttaaatttttttgaagagaaaaaaattttgctcaggctggcctctaactcctggccttaagcaatcctcccaccttggcctcccaaagtactggaatgacaggcatagggacactgcatccagcctgagtttacaaat

SEQ ID NO: 541500 - DNA, 149 bp, Homo sapiens
gagagatgtacctgccggttcaggacgcccgagagcagcgcttcgagtactaacaaaagaatatccagttcgcacatgccaataagcccaaaggccgcaaggcaaagatggcctttgtcaactctgtgggcaagcaacttgtgacgtcc

SEQ ID NO: 541501 - DNA, 161 bp, Homo sapiens
ccccttggcagagctccccttggcagagctccccttggcagagccccccttggcagagctccccttggcagagctccccttggcagagctctaaataaggcaaatgattactgctacaaataagttaactattagtagcagtaatcatttgccttattaat

SEQ ID NO: 541502 - DNA, 873 bp, Homo sapiens
  misc_feature (154)..(154): n is a, c, g, or t
  misc_feature (176)..(176): n is a, c, g, or t
  misc_feature (187)..(187): n is a, c, g, or t
  misc_feature (190)..(190): n is a, c, g, or t
  misc_feature (219)..(219): n is a, c, g, or t
  misc_feature (230)..(230): n is a, c, g, or t
  misc_feature (236)..(236): n is a, c, g, or t
ggagtcagtcagagagccttgggccagagttccaggggctctgggagtggctgtcagttctacagggcctggagctgatacgaaaaacctcccttctttcccaaatggtccccagcttccccgttcactgaaggccctgcagtcgggaacagtnaggactttgcacccagttgttntgggtgtttgnccnacccttcctcttgtgtgattcatggaccngcagcattgcntcaccngtgagcttttggaattgaagactctcagggctcacccgggaggacctgctgggccagaatctgcattttaacaagatgcccaggtgatttgcatacacgttcagatctgagaagtgctggtaggagaggctttaaggtggtaattagatcttttctccacctgcaagaatcttagtttcttcatgttaaatctattaactgtggcaatggcatggggggttataaaacaaaacaaaatccttacatcaggaatgcaccctggcgtgttatggatgtgggtgaaatgaaatgtctggaatttgctttaaaatatcctaaaatagcaagaaggaaaagaaaagtgggtactggaatgagattggcgaaatgttgacaagttcttgcagtgggatgatgggtgcatgggggttcatggtataattctttccctgctttttgtgtatatgggaaatttccataatgaaaagttagaggtcgggcacggtggctcatgcctgtaatctcagcattttgggaggctgaggtgggtagactgcccgaacccaggagttcaagaccatcctggacaacacggtgaaaacccatctctactaaaaatgcaaaaattaggcatgttgacaacatgcctgtagtcatg

SEQ ID NO: 541503 - DNA, 102 bp, Homo sapiens
cttgctatcaccttgaacaatttcggccagttgctgcttggaacatcgggagagggtttccctcttatgagcgggtgggaaggcaatgccacacatccggga

SEQ ID NO: 541504 - DNA, 1568 bp, Homo sapiens
  misc_feature (100)..(100): n is a, c, g, or t
  misc_feature (819)..(819): n is a, c, g, or t
  misc_feature (1143)..(1143): n is a, c, g, or t
ctgtttattatggcggcatcccttctcctcggagagatgggagacctccccgcacccgtccagaggtgtgtcgtgccaccagccgagagaatacgtgccngctcacgggccgtttgtgtggttaatatacctcctcggtcgcctgcggctccccccagccggtgtactccgtatatttgcaccccccgggggtcccctccttattaaaatggggtttctccgccagaggcgggcccccctgggggtgttcgcggcgacaaaaaattattctcgcggcgcccaccccttcgaggggggaatatattaggcgtgttgtcctttaaaggggggattagccccaccccccgccgtgccgaccccccccccttctctttaaggggacaatatttgggggggagatgttttcacaactagtgttgccctcctcactacaaataggagtctccacctggtaaacccacaaaggttttgtcttgtccccacccgtaatatatttgtgctccctcggcacaaagatgtgttctctcttttccccatcgtgcttgtgcacaccactggtctcttcgtgggaagagcgcttataaaaacttatcccgctcgcgtatggatgatcatcttataggtgcgcccctcttctagtaaaagggcccccacaacaaagcctccttggggtttttgttttataacatcgcgcagcactcatatcagcgagatggccgctcttcccaccgcccgagcattttttatagcgcgaccagggggaaaacaccctctctcctacacacaaagaggcgggactccacgcacacacagcttgtngtctcccgcccgcgttttggtcgtctccctgttcacacccttcccccacatctttgctacacaacccacgcgagagtgttatacaatagagattttgtttcacattcgcccacacacttctctctatatcacgtctctttcggctatatgtatatagcgctcttggcgcttcgcacagcacacacatcgagatgtaacctctctctctcgctctttatccgcagatgtttctctcgtttgtgtgactcggcatatattcaccactctctcggtggatctgccctccactcgagatatctctatagagagtatatatatagaatntgttcccactgggccatctatagagatcttatagagcgagaaaccccctctataaggagacgctgttcccacgcgcgccaagattggtgcccgcagcatatatggagaccacgcgctccctcgttctccccacgcctctcccacgctgagagagcccacaatgccacgaaaggccacagcgtgaattttctgcacattttccacacctgaagattcccacgcttcacttctcacttgggaattggttaagacacacgctgggtccacgcccccgggaagggccgaaccacgaagccacggaccgcgggccctgcctcaccctggaaagccccacccacctccacggaaactccctcccctagcccagggaacccctgagggaccccgcctgtgagggatggtgctatctggccccagatactatg

SEQ ID NO: 541505 - DNA, 903 bp, Homo sapiens
  misc_feature (898)..(898): n is a, c, g, or t
cctgcatgtgtatatatgtgaaagggtcagcatgataaatgtgactgatgttatctgtgtattagaaaaacacaatcggtagtatataaagtatctatcactttgtgcggatcactttttacactcacataggtcggtatcttaatagttgtagactaatgtgaatgtcaggctgttcagccgagaagcagaatgagtggaccagtgcaagtcacttcacgtgatggaaacactgaaggaacagttaccctgctttgcctcgaaagtgtcatcaatttgtaattttagtattaactctgtaaaagtgtctgtaggtacgttttatattatataaggacagaccaaaaatcaactatcaaagcttcaaaaactttgggaaaagggtgggattaagtacaagcacatttggttacagtaaatgaactgatttttattaactgttttgcccatataaaatgctgatatttactggaaactagccagcttcacgattatgactaaagtaccagattataatgccaggaatataatgtgcaggcatcgtggatgtctctgaccaaagtgtgtctcaaaatattattctttaccttaaaggaaattaatgtttctctggggtgggggcccggggttcaaaggtggctgaaccaggtgatctagatgatcacattatgggccctcctgatggaattcatttgcctcacttctggcgtatccgtttaactcgacttccactggtggtttcccaggcccttggtgccccggtgggaattcttctcctcaccaacatatacacatctgtgccgcgtccacggcttgtcaccaggggagcaaaagacacagcgtcctttgcaaactgtaaaaagccgctcgccgttcgcgcacatcacacaccagtagngtggt

SEQ ID NO: 541506 - DNA, 759 bp, Homo sapiens
  misc_feature (1)..(1): n is a, c, g, or t
  misc_feature (28)..(28): n is a, c, g, or t
ncctgcatcgctgcgtccttcgtgtcancggggtccctctctcttcctcgtcgtcgcagaagaagctttccgctctgcttcgtccacttcctctgctgcgtgtgtggcacgtcttttctttcctctcccgcaccctggctgttctttcctcgtcgtctctttttcgcgccactgcaacatcctcttccgctgctcatgtgcgtcgcgcggtgcataaaggacgcccccgtgctgatgtgtgcggcagccaccacactgcgcgtggcgggcgttccccccccccctcgtctttctgtgaagatcaaatgccatagcgctctcttggtgcccggctccccctctgcattgtttggtttaggggtgtgtcccccctctcccacatttctgtgggctcgctgtcccccctccccgcgctcgtgctcccactctctttcgcgcctctcaccgcactggctgtcgaacccgtctactcctctccgcggtcccctcttgttccgcagcgggcgccgctccggtgcttcacccacacgtcggagtggtccggcgcgcaccagcgcccgacttgtgctccactgggctgccccctccccgctgcgggacgaggttctggtcccccggcgaacctgcggcagcgagtggttgcgcctggggcgacgcgcaccaccgccccgggcggtacgacccttcggcggggagcaagccgcccgcgcctgccagcgtagcaagacaacaacaggacacaacaattagtcagaacaa

SEQ ID NO: 541507 - DNA, 175 bp, Homo sapiens
attcgagctcgtacccctcctagcagacgcaggtcggaccccacattgccgtggctgtggtgtaggccggcagctatagctctgattggacccctagcctcagaacttccatatgccatacctgcaaccctgaaaaagaaaagaaaaaaaaggttcctttgggtttgcgtctggt

SEQ ID NO: 541508 - DNA, 181 bp, Homo sapiens
ctttcttttcttttccttcccttccccttttcccttcttttccatcctttttttgtttctctctctctctccctttcccttccttccttccgtccttccgtcctttgtcctttgtcctgtccttcgtcctcccctccctttttgtataatttaataaaaaaatggtcgcgcttttgtttta

SEQ ID NO: 541509 - DNA, 971 bp, Homo sapiens
  misc_feature (971)..(971): n is a, c, g, or t
ttcaacccagcaatcccattactgggtataaacccaaagagatataaatcattctattataaggatacatacacacatatgttcactgcagcactattcacagtagcaaagacatggaatcaacctaaatgcccatcagtgatacactggataaagaaaatgtggtacagatacaccatgggatactatgcagccataaaaaggaatgagatcatgtcctttgcagggacatgaatggagtttgaagccattatcctcagcaaactaacacaggagcagaaaaccaaacaccacatattcgcacttataagtgagagctgaaagatgagaacacatggacacaaggtggggaaaaacacacactaggggtctatcaggagttggggggagaaagagcatcaggaagaatagctcgtggatgctaggcttaatacctaggtgatgggatgatctgtacagcaaaccaccatggtacacatttacctatgtaacaaaccctggacatctggcacatgtacccctgaatttaaaataaaagttggagaaaaaaaaaaaacgacaccgttaattgtaccaaacaaaattgtaaggcacctacaaatcaatccaacaaaaggtagatcccatttaattaagaaactattagcagatgcagtggtccacacctgtattccagcactgggacgtgggactggtgattcactggagccaggagttcgaacaagctgggaactgggagactcctctctgtttaaggtacaacaagccggtcgggtggcgccgggtcccagtatcagaagcgagcggaaacggtggcccgggaagtgacgattgaacgcttgctccccggcggcagctctcttctctacaaaaagcggagagtgtatactgtcttcgaccagcggtcacaaaacaaacggcggtcggcgacctagaaagatagggactgacgaaatgtttatcaaggattn

SEQ ID NO: 541510 - DNA, 247 bp, Homo sapiens
gaggctgcggtgtctgctgctattctccgagcttcgaaatgccgcctaaggacggcaggaagaagaaggacgctggaaagtcggccaagaaagacaaagaccagttaaccaacatccgggggcaaggccaaaaagaggaggtggtccaaggcaaagttcgggacaagctcaataacttagctttgtttacaaggctaccattataaccttttaaggaggtccaacctttaacttttaccccactttg

SEQ ID NO: 541511 - DNA, 751 bp, Homo sapiens
tcccaaaaagccaaagccagttttatttcaacaatcatctttattacagtaggatgatggtccggggccaccagcctaaacctgtgcagccttagaaaaaacctgtgtcaacagggctgtgccttcccttctcataaacagggggctccagccaccttccaggggcattccctttgctgcattttccccgtgcgtggagagatggggcaaaagggcacaacggggacgagagagggcattgaccccacccacaaggcatatagcagcctccttggccacaaaggactcctttggccagttagcaaaaggggaggaaaacagcaaccaccgagggtttaccaccactttggtggcaagtggccaggaccccattaagcgtcctctaaaagtgggtgcctcaagagcaattaactaaatttaaaagtgagccttcagcagcaaacgctgtcaattcaccacaggaaaacgctgacgcaaaaagcaaacgcaaagaggaattaaatagcatcactcgggcatgagcgcctaggccccttccctcataggagcagcttgtcagccagggactacaataggggccctccaaagatcctgaggaggagccaccttagatatatcccccctcatagtggtgtcataatcatgcattaaaattaagagggacccaaattccaaatgtgcaaataacccttagaagggacaacccccctttagaaggccatgaagcattggggcagtggaaacatgagac

SEQ ID NO: 541512 - DNA, 475 bp, Homo sapiens
  misc_feature (328)..(328): n is a, c, g, or t
agttcaggacccgggttgggtgctggtgctggaggtggatatggttttggagtgtggtgccgttagtgaatttggtttctggggtggagctggtggtggtttgggctcggtggtggagctgtgtttggagtgtggcttcggtgaccctgggtttcttgtctgccctcttggaggtatccaagaggtcactgtcaagccagagtctcttgactcccctcaagctgaaaatctgagcccagcatccagagggtgaggaccgaggagggcgagcagatcaagaccctcaataataagttgggctccttcatcgacaaggtgcgtgtcctgnagcagcagaacagggttctggacaccaagtggaccctgctgcaggagcagggcaccaagattgtgaggcagaacctggagcctgttgttcgagcagtacatcaacaacctcaggaggcagctggacagcatcgggggggaacggggc

SEQ ID NO: 541513 - DNA, 232 bp, Homo sapiens
gcaccgaggcggaagagccggcgcaacagaaacttaagggcgacctggttgcttccttctcgtggtcatcgtgaacgctgctgcaatgaacatggtgggtacaaatatctcttaagagcccgggggttcaatgctttgagatacatacccacacatgggattactggataataggcctgccattcccatatcctgggcccataaaaggaccagctgacagagcaatatgaat

SEQ ID NO: 541514 - DNA, 172 bp, Homo sapiens
tgtctcacgtttgactcacgaacaggtcggtcgatggaccttgccctcaagttaggagacaggccatgcctttcaagtgcatgcgctcactgatttcatcctcaagtttccgctacagtggcccaccagcacgtatgtccgcaccagcctggccgtaaggcagacatcaata

SEQ ID NO: 541515 - DNA, 127 bp, Homo sapiens
ttagggacaggatttctaggatagtcagtagaattagaatggtgaagatgataagtgtagagggaaggttaagtggtgtctacggcaaaaggtacaacagtatttatggctaaagtgaactgcacca

SEQ ID NO: 541516 - DNA, 473 bp, Homo sapiens
cactgtatttgttgccaggcgcctaatccaggctgcaaattaatacctagtagacaagaacatctccattttgaggctgaataaaggtcatggccctcatcccagacagtagttcacaaacagactcgactgggaccgtgtctttgctggctatcgagctggacaaaccaacagcacagaaccttcagcctggccagtgagtggctgtgcctttgtacccatggcaagcacgacacccatcgtgcgaggaaacaagtgatggagcttagcacgggcactgtgtcttctcaggacgcctcagcagctctctcccatgtcagcccttcagcagggaagacccaaacctgtcaggaggagactgtcccagacctgggctcccacgcgatgtccacaattactcaaagatgcaggacgcagcctccttgaacctgccatttccacaggggccagaggaggggggtatacacaaaagc

SEQ ID NO: 541517 - DNA, 1836 bp, Homo sapiens
ggatggcggagctggacgggtggaggttcgcggctctaacggggcttcctacaagggattgatcgaacaggatgttacatgaagactcccattacagttggtgcttgtgaagaataagtgtggtaacgtagaacggccaggtgtcgcgatgttgagagtgcaagtcagcatgaccgaccgaccacctggatataaaaaacagaaattgaggtggaatggacgaactgaacgctggacagcgatactaccaccaaggaacgccaagatgcacccaaagcagacacaaggatgcggatgagcggacatccggccactacaacgtcccgagagctgacccgacacgcggagcaacctccccagccgaacacacgcacaccacgtcacggcccatagacggaacgagctctagcactcacaccaaagcagcatcgcgccacggtcgcgccacgctgaccgcgactgaccgaccgaaacggagagctccaccgcatccaaaccgcgcacagcggaaccacaaccactgcgctcgacacgacaaactagagaggcaccacgactccggactaccggaccagctcgacgagcaaaaggcgaggcgaattgagcggcaccggccgggtcacggcgcaactccgggtgcaaagtacgcacgggggcagtcggcaccgacctgaacatccgcaacacgacacacgcaacaggattcacactcggcacagagcccacagcacctcgcgaacccgcacgcgacccacttacgcaaccaacgtacaacttagccgcaggcaagcacgactcgcacacccacacacccccgcccccatccacgccgaacacaccccaccaacacacagcaccaggccaccaccacaacagcgcacccaacgccaacgcccgaaccactggccgcccatcgcgtaggcacacacgcccaccaaacaccccgagagtgcaccggacgcgaggacaacggaccgcacagacaacacccacgacagagcacccgagcaacccaacataggcgcacacacaatagcgcccacaacgccacatccacaccacagcaccacacacggacacacgcgctacgccacccggcacctctcacacgcagccccatcctatacaccaaccaccacgccctcggccacaacaccccagacgcgccagccacaccacgaagaccggccaacagcaaccaacacaacacagcagaccacccaaccccgcactaaccaaacacagaacaaacacaacactgccgcaccggcccaaacgcccgcaccacgccaacaccaacacaaccacgccgcaacacgcggcaccacacaccgcaccgtcaccgcacaaccgcgccgccaccaccacgccgagcacacgcccgcgacccagcccaacaacagcacacaccaacgccgccactagtcacacgccacgccacaccagcaaccaccccgccgacagacgagacgacacaggcaaaacgcaacagggacgcacaagaccgacgcagcagagcacaagccacacacaacacgacagtcaacctacgcgtgtcgtacccacgccacgctcgcgtcccacgcagtgccgccggacgacgatcagcaggcacgagcagtcggccaggagaaacagagcgcatgaacctgcgacggaacataccttactgcgcgacaccccaccgccgacgcaccacaccggcgcgacccaccaacacaagcccacccgtcgcgaccccgcgcgccgccgcccacaccaccccagcgacacagcagaacacaaccatccacactcgcgccacccccacaccccgccgtaccacaccaccaccta

SEQ ID NO: 541518 - DNA, 1105 bp, Homo sapiens
ggccatttgtgaagagacgaagactgagcggttgtggccgcgtagttcgacctccagcagcagtgcggctatctctgacgcaggaacccgggagtaagggagactacagatatgctgagatacttactagtctaccctactccctaactaagtagagatagtggtttgatactaacagctaacatatacgagctttgtgtgagacaaccttaaccatttcaaattacgaatgggccaggcaatgttaccagacaatgatagatacctacgttccataggaactaccctgtgtaatttcccttgggaatacttcatatcagcttctttgagtggtcatcggaaatactggatgtgtgaggcaattctatttgcgaagtgaatgggcaaacatttgtggtgctaggctcttggtatcataaaggagggctacttggccataccgtaacagtactagcatatcctgtacgacgacaattggtcgccgaggctatggctggtaaggcgagggtacgcacgggactgggggcatgacagtgactttggctagggccacggtctcttataatacttacaccttgggctgcgagagccaaatagtggaacccggagggaaaaatgccacggtgttgacaacgattctggcagcgcgagatgtacgggcgtcctcttttgacttgtgactatagacttttcaacgggactattcatgatcagggatgttacagttacccagcacgtgtacctcctcctcctccctaattgctccggggctggtaagttgccccctcgaaacacggtccagcggtgttactcacgggaaaacactttcacgaacagtgggcacaacagtgagctttcaatttccttaggagtggggacacccgggggactctttcccaagtccgggcaacagctgacaagggcagatggaccgttcagggccatcaacacagggacgatgacaccagaataaaccacaaaggtgggctttctctcccggacaaccgggcaacaacgttcgcaaagggaccgagcaaccaagcagttcaggcttcaccacttgatccgtcccgaacacggcacaggagaatccgtgacaacgctg

SEQ ID NO: 541519 - DNA, 167 bp, Homo sapiens
  misc_feature (154)..(154): n is a, c, g, or t
  misc_feature (161)..(161): n is a, c, g, or t
cggctcactgcaacctccgcctcccgggttcaagtgattctcctgcctcagcctcccaagtaggtgggattacaggctgccctgcctacccactgcccccagtctttaactttttttggctacttctcttaagttagacgatgcgggtttcacntatgtcntggcca

SEQ ID NO: 541520 - DNA, 1198 bp, Homo sapiens
  misc_feature (315)..(315): n is a, c, g, or t
gctggatgcttccctgctctttgcttctgggaaacacaatcaatggcatgaagctgcgctgtctccgggcttgtcgtgatccggatctctgtaccatatgtatgagccaattgtgcgtgcatcgacaatcatcgcgagagtaatccgagccataccagaaagacattcccgcagccacatttaaagagttcacacatgcttacattggctggtgccgcaagagacttgcttgggagacaggacaggaaggcaagtgatgggaatgcgagacttcaagttcacaagatatacgatgtcccgcatatgcgttagaangaggcaacgtgtacagggagggattgctatgcctcctcggtcccacgatacggacagatgttctattaccaatatcctcagaccatcggacgtgcgtgcactagcgtgcagggtcacacgagacctctacattttcaattcttgtctcacttccgaatctgtccatcggtgagattgcatagttctcacgtgctagtgatgactcatcgaaactagttgaagcactgggacgaattgccggcaatcgattcgagaagttgagacctggggatggtatcccaagcgagtttcgcccctagattcgcatttggtcgggtcagtgtaaaactttgccaggcgagggtgtacaaccaagtggttgttagcgagacgatcaatcgccatgggacgcacaggttggctacgaagggggtccagtgcgtcttattgcacgtggtttggactgatcccgtcaaagtcacccgcattcgtcccctgaagcagtcagcttaaaaatttagcctggccctttacccccaaatccccattttggagagaggagcccaggcccattccgaaggtttggttacgatacccaggtatacggatagaattccatgaactttcgcaaggtggattgggagatccatgggggagtgggttggggcaatttcggtacttacttcattccgctttaatgtttaaactcgttagcgcattggcgtcccttacaaggggttcccctgaggaaggccttcacatgtggttgacgaggagcacggggagcaacaaagtggattcgggaaagtacacaaaagaaagggcggaaaacaaacgcagagatttatttgaatggaatttctaatcataggccagtaattttttcaaattggaaaacctagag

SEQ ID NO: 541521 - DNA, 226 bp, Homo sapiens
ggctatgcttagcctgggattggtaaatacattactagagttaattagcatccctcggtctttaactgttcatggaaaaagccttaggcgtagcataaggtcacagattgcccagttaatgtgaagttaccaaagttaccaactacttgtttatatcagagccttgtgaacataaattttacagtttgaaactgttatcttcggttgtcccttctgtcgtcttctc

SEQ ID NO: 541522 - DNA, 314 bp, Homo sapiens
  misc_feature (1)..(1): n is a, c, g, or t
  misc_feature (10)..(10): n is a, c, g, or t
  misc_feature (45)..(45): n is a, c, g, or t
  misc_feature (51)..(51): n is a, c, g, or t
  misc_feature (65)..(65): n is a, c, g, or t
  misc_feature (88)..(88): n is a, c, g, or t
  misc_feature (110)..(110): n is a, c, g, or t
  misc_feature (153)..(153): n is a, c, g, or t
  misc_feature (162)..(162): n is a, c, g, or t
  misc_feature (164)..(164): n is a, c, g, or t
  misc_feature (180)..(180): n is a, c, g, or t
  misc_feature (183)..(183): n is a, c, g, or t
  misc_feature (193)..(193): n is a, c, g, or t
  misc_feature (214)..(214): n is a, c, g, or t
  misc_feature (229)..(229): n is a, c, g, or t
  misc_feature (257)..(257): n is a, c, g, or t
  misc_feature (278)..(278): n is a, c, g, or t
  misc_feature (291)..(291): n is a, c, g, or t
nctttaaatncttctcttaaggttgaaggcacaacagttaatggnctgtantgttgctattccgntggctgacatgtttttgataaanctttaacaatcctgctactaantttggcggagagtgtttgccaggtttcaatgtgggctgcagcntgtttgtgncntccttctctggtttgncantgtaatgagntcataagctaaattttccagnaaagaattttgtttnagattatgcctcttatctacttgagagncaacatgtcttttcaatcatnggattgacacatnaaaaataaagttatttcttaatc

SEQ ID NO: 541523 - DNA, 818 bp, Homo sapiens
  misc_feature (237)..(237): n is a, c, g, or t
ggggctttctcccaccgctttccgagcccgcttgcacctcgggatccccgatcccttctttatggcgtcgctctgtgctgtgggccgaagctggccgcctgggatcgtcctcagcgcctggggagtgatcatgtgataatgctcggaatatttttcaatgtccattccgctgtgtgatgtgaggacgtcccttcacggagaaccgatttgtgagaatgccccccagaatatatacanactttacgagcaagtcagctacaactgtttcatcgctgcaggctttacctcctcctcggagggcttctctttctgccaagttcggctcaataagcgcaaggaatacatgctgcgctagggcccgggcgtttccccgtccagcccctcctctatttaaagactccctgcacgtgtcacccaggtcgcgtcccacccttgcgggccctctgtgggactggtttcccgggcgagagactgaatccctttcccatctctggatccggccccgtgagagggctgaggctggggggctgtccgtctctccaccttcgtgtgtccgatctcataaagagaatcgggtctctcaaaaaaaaaaagaaacaaaaaagtgttgcggggccggccggaaagttccaaaccactcgggggcgggcccagaggtatgactggccagggacaggactcgggcgccaggctggttcccaaaaccggcgccggttgcccccgggccggctcgcaacgccggccccccccgcgcgcgggaccgacacgagaaccatcacgccaaacacgacagccgccaacaggcaccgccacgccac

SEQ ID NO: 541524 - DNA, 177 bp, Homo sapiens
tctttagagttatcccgctagagtctgaagtccttcagagaggattattatgcgactgtgagtgcgtcgtagttcgagtttgctatgcagaatagtaatgaggatgtaagcccgctggcgcgattatgattaatgatctgccccgggaaagttccagggctaccgcagctcgatatt

SEQ ID NO: 541525 - DNA, 528 bp, Homo sapiens
  misc_feature (35)..(35): n is a, c, g, or t
  misc_feature (70)..(70): n is a, c, g, or t
  misc_feature (99)..(99): n is a, c, g, or t
  misc_feature (104)..(104): n is a, c, g, or t
  misc_feature (115)..(115): n is a, c, g, or t
  misc_feature (126)..(126): n is a, c, g, or t
  misc_feature (312)..(312): n is a, c, g, or t
  misc_feature (314)..(314): n is a, c, g, or t
  misc_feature (337)..(337): n is a, c, g, or t
  misc_feature (339)..(339): n is a, c, g, or t
  misc_feature (342)..(342): n is a, c, g, or t
  misc_feature (463)..(463): n is a, c, g, or t
  misc_feature (480)..(480): n is a, c, g, or t
  misc_feature (502)..(502): n is a, c, g, or t
gaattcggccaaagaagtttaagggaggaagcttntttcccttttttaggattaacaaaacgcaagcggnagaagttggcctctgattacggaggaggntgacnggaccagttcntaagaagacanaaaacgcaggagatcagcaggcccaaattcgccatcttgaaggtgaggggagagagttcagacagtcgcagcgtcaacggatgagggtagcagtgaccccaaagacatcgaccaggacaatcgcagcacgtccccgagcatccccagcccccaggacaatgagagtgactcggactcgtcagcccnanagcagatgctgcagcccagcccncncantttgcaggctcccaactgggtcaccccagctccctcctcagctcctccagggacccctcagctgcccacgccaggcccacgccctctgccactgcagttccccacagggctcccccaacgnctcccaggcccctaacncagcgcaggctcccacagcgcntgttccccacacccacatccaacagc

SEQ ID NO: 541526 - DNA, 306 bp, Homo sapiens
gttggcgtgatggcaacctggtctgcgcacctgccctattacgttgtcgatctcttgttggacacggcctggacagacatgcgtccccacaatgggtcatgcacccacggggtgtccgtgcccttgacactcacttctatgcctcctaatgtttggacggaggtcacggcttacatggatcgctggtcacagcctgtgcttgtgagcccctgggttgtccctagcaaagttcattgggccccctgccttgtacccattcctccctctggcgccctgcacttgtttccccagttggtgggggtaccg

SEQ ID NO: 541527 - DNA, 1069 bp, Homo sapiens
gccaacatggtgtacaggcgctacgctggaggttgtgtagggtggtctatgtctcctttggacctcatgcacgtaaaatcggtcgcgatgttgatgtatatatgatcagaaacatgggtcattggtcgatggaccttgatctcaagtgaggagagaggccatgcctttcaagtgcgtgcagctcactgatttcatcctcacacgtttccgcgaaagatgcccaccaggaaagctagtgtccgagcagacggcctggcgatgcaaagtgctagaccatcattatacggagaatggtgccagttccagctacgagtgggggccaagaatgatggaacgccgagagataaggaggagccacacgatgacagattcctgatcgtattaaagttttggcggccaggaccctgatggaatccgcattgatcaatgaatgaaggttagatgcacagcttcggaagggcatctctcgctgaaagctactcccaaaagatagcaccctcggtaactaaagggttactgctgccttggttgcttggctcgcttgcgtggttgcatgcatgttgctagcatggttacaaagtttccagcacaacaatgatctacacgcccgtgcagtaatatatgctctcggactagtaaggttcctggccgaggacagtctaataggaccatatagcagcagtctgtggcagtaggctctgaatggttcaaaaatgctccagcgcataaagctgctgttccataggcatcttggcatgaaaggtttacggggcatcattaccagcaaccagggcttttgctgtcacctgccacccaggggggcgtctaaaagaaccgtggggccaaattgacgcgcccagttttctgcaggggcgcaaagggcgtggttaaacgagagagggcggtgcaaggctgtgagggacccgcgccggcggtggggaccccctgcgggggacggggacaccccacggtgccctgacccacactgtgtggggacgcggcatcgggccttctgtttcgaccacacacgaggcccctcgcctccgtctcgccgcgcgcggctccgaag

SEQ ID NO: 541528 - DNA, 238 bp, Homo sapiens
cgaggagggatctgtggtgggctcttacctccccttggttgtgtccgcaggagctgaacccatgccaccgtgctgaaggctcagttcccgagtgtggctgtggaagcaagtgggggtcatcaccctggacaacctcccccagttctgcgggccggaacatagacggtcatctccatggggattgctgacccaaggcggcccccaagccgcttgattatctcccatcaaggctgtttgc

SEQ ID NO: 541529 - DNA, 104 bp, Homo sapiens
tattatccacagggggggtgattgatttgagacagttacattaacaaaacaaaaaaacgtggccaaacggaaacaacggtgtcaagttctggatacttaactcc

SEQ ID NO: 541530 - DNA, 115 bp, Homo sapiens
ttttaaaatactttgtagaaaatcgcaatatggcaaatgtgcgtacaaaacggaatgtgcaaatacgctgcccgaatcaagtgttatcgctccttttcgtaaaaaataaggccat

SEQ ID NO: 541531 - DNA, 88 bp, Homo sapiens
atcggcgccgtgttgcagagcgacaacgaccaagtcaaggtcgtgcgcctggtgccggcaggccctgccgacaagaccaagcaagtag

SEQ ID NO: 541532 - DNA, 1073 bp, Homo sapiens
  misc_feature (250)..(250): n is a, c, g, or t
  misc_feature (302)..(302): n is a, c, g, or t
  misc_feature (423)..(424): n is a, c, g, or t
  misc_feature (496)..(496): n is a, c, g, or t
  misc_feature (529)..(529): n is a, c, g, or t
  misc_feature (659)..(659): n is a, c, g, or t
ggctcgtgccacaggtaagctggcatcaagtattgtcctcagagcgccgagcatgacgggatcatcggacgcctcgcgagatcctgtcctgctcgtgtgctgactgctggtggggacagatggtgccttgaccagagagcctgggaccggtgtcaccactcgcatgtaggtagttttctagcatccgaccgaatgtccacggcaccggcgcgacgggcgaggcccacggctgtcactgcgacagcagggncataacgtctggaacgaccatcgcacaggttgcgctgaggggttcgagcagncgagcgaccggcgatggtccgacgggaacggtagccgccggggacggccatgggaatagcaggcagcgagtgggcgcggtagctgatttggatgacccggagactacgactagaatacttnncaagcactccaaagagacaggacttaatccgtagcagtacgcctaggcgtgcaacctaggcgcgggcatacntacaaacccaagaagccgaagagccggggatcntacacaatcgatcgcacgaagggatggtagtgagcttgcagaaccttggaggcccggaacggcgctgccatccttcacgacggggcactggaccagtcgcgacctgacgagcaggccaggcatgtacatntcgccacatggaacgcaggatcctgaagctaccatggaacgcgggcgggacgaccggcggctccagcaatcatcgccagacggcgaagtggggcagtgcgggctcgtggtgagcggcatgcagcttgagaagcctaaccttggtacgggctctgttgtcgtgggacgtgtgctccagactacgaatagtccgtgggaagcaaccggggcaacagggacgactggcttgcgaacgcgggcgggaaccctcgacacttggaaggacaacaaggttgtaaccccaattcaattcccaggttatgtcttgactgcatttgtgatgggcaaactcccttgcagcgtgtggctagggggccccttggtggccttactaaacccatgtcctcacagaattctacaacctgggagactttgg

SEQ ID NO: 541533 - DNA, 365 bp, Homo sapiens
ttccggtgttccctttgtcttaaactgagaataatgtggaagggtgtggtggactcacgcctgtaatcccagcactttgggaggcagaggggaacggatcacttgaggccaggtgttcgagactagcctggacaacacggtgaaaccccgtctctacttaaaaagtgcaaaaaaggagccaggtgtgatgcacgtgcctgtagtcccagctactcgggaggctgaggcaggagaatcacttgaacccaggaggtggaggttgcagtgagccgagatggcaccactgtactccagcctgggcaacagagtgagactctgtttcaaaaaatatacatataggggctcggccgtggtggctcacgcct

SEQ ID NO: 541534 - DNA, 161 bp, Homo sapiens
atctgtctgtggctcccagtcgtgctgggattataggcttgacgcgaacgcacccagcagtattttttatttaattggagtagtagattagttgagtatagttttatattagtcgtctcgatgtacatggcagacgtttccatcctgctgtgctaggactc

SEQ ID NO: 541535 - DNA, 1673 bp, Homo sapiens
  misc_feature (1213)..(1213): n is a, c, g, or t
  misc_feature (1577)..(1577): n is a, c, g, or t
  misc_feature (1628)..(1628): n is a, c, g, or t
tagggaaacaaaattcatgttttatttccccagaaaaaactcaaaagtaggaagctcctccttccgggaaaactgtgtgtcaacagtgtgaactttcaggttccaccaaagggaagggaggttacagaaaagaatgcgtgggtgttattgttgacgaaggcgtgggtggcccacgtgaaagccacccacaggtgcagtgtgggaaaaaaacaagggagaagaacaacacctgtgggtctccccacagccttagagaaacacacagagaggtgtgtgtgtgcaacgcgcggggccacagggggctgtggccacccaggctgtggggcgcccaaagggaggagagagaacgctctcctctgtgagacgacaccccagtgtggcttttcatcggaggccctctcgcgtgtggtgtggtgtgtgccgcaagaaaactgtgtcgcctctcacccacaaacacttctctcacccccacactgtgtgctgcagacagcaggccccccagtgtgtgtgcccacacgcgggtgacaaagacctgatagggaaatacacaccacgtggtagagagatctctccccccccctttgtgtgacacagtgggggtctctctgtgaaagcagttgaggatctatctttctcgcacaacaccgactatatgcgacacaagtgtgcgagaatataacccgcccatgttgtctgctgggtgtgtgtagtacacaattgtggagtgaagaagttctcctgtggacatctcctggggagctctcccgttgtgccgcggttgggcgcacgcggtgatatctgcggtgggagacacagcaggtggtaatgttagtacgcgggcgcgttttttctgcggcgaaaagccccccctcttctacaatataaaaagtatggggtgcctatttctcccaccagatgttgttgtaagaggaaaaagacgggggggaagagtagtcatcccaccggtggtaatagtagttgcaaacaaaatcttctgcctcttccacccacgaaagaaaatgtagctgccgggaggtcagttgatcaccaaagtcatctcatacacagcaggcgaagagggggcccccctaccgcaggaggatgtttgacccactgtggaagcgctagagaggcacgcggggggagacacaccccctgtggtgggatgtactcacgctagtgggtgcgtatacatatcaaaaggatgggggcnggacaatcactcctcccccccaaaggatattggtggactaatggttgagccagcaatacaaccgccgcccaaaggcagaatcttggtggggagcatcattttttttacgacacaacacatagttctgacgctatattctcatcttcccctcgtactagttaggtcgccacccccaccagaagggagcagttgcagccactcgccgtaagaagacagcacacgcacacgcaaagataagaagcagggtcccccgcggagcgcagcatattcgctacggaggcgcgcccgcgaggagtgtatcagcgcgggcgcccgccagtatagaggcggcgacgcgaggagaggaggaggaagtggtgtaggncgcctcaccacaatcggggctgtgagctctccctcctgcgtcgttgatcgnagtaaacaacgccacgccggcagcgacagcagatctagtttagcg

SEQ ID NO: 541536 - DNA, 336 bp, Homo sapiens
atttatttattttttaattttattattattatttttagatgaagttttgctcttgtcacccaggctagagtgcaatggcatgatctcggctcgctgcaacctccgcctcctgggttcaagcgattctcctgcctcagcctcccgagtagctgggattacaggtgcatgccactgcacctgctcatttttatatttttagtagagacagggtttcaccatgttggccaggctggtgacctcctgacctcaaatgatctgcccaccgcagccttccaaagtgctggattacaggcgtgagccaccttgcctgggcaactgagtgagactacatctcaa

SEQ ID NO: 541537 - DNA, 429 bp, Homo sapiens
ccacgccagtgctctcatcacttggcctttcaggagtcaactggatatattagcacaggcagtgtcctggaggggaggctcatgggctctgaagtaaaaaccacctgggtttaaatcctagcagtaaccacttcctaactccaggatctagaaaaagctgtctaacctctctgggcctcagtttcctcatctgcaaagcagactcaataaaagctacctttgaggctcaggaaacacagttccaagtagcatagcttggatgtgcatcctggactgtcctgacttgaaaaacacagggagaacctacaatatgcctcctggaacgaagacctctccatctcctaaatgaatgacgtgtatgatgagatgtgaatggtgacaggaatgtgtcccctgagcatgcagggggaaaggtaacatgggaatcta

SEQ ID NO: 541538 - DNA, 354 bp, Homo sapiens
actgggctacagacgtgagactccgatctcaatgaaacaaacgtatatatatcttcacacataagctagggcatggaggcaatgcttctgtcatcccagactactcaggaggccgagataaaagattcacttaaatgtgggagtcggcggtagtagtgcagctgcagatcaaccatagccctgcagcctgggtccaccaaacgcagcactccatactcaaaaacacaaccagtggggtgtaggtggctcaggcctgtattcccagcattttggagcagagtgaagaggaggtggatcccctaagggtccggaattcaaacatccacgggggacccctcataagaccgacctgca

SEQ ID NO: 541539 - DNA, 123 bp, Homo sapiens
gcgattcttgagtatcccaatctgcggaatcggagttacctggtgctagatagatcagcaacagtggcttgtggctaggccatgtgacatggaccatgagtcagggcaatgggcagagcagtg

SEQ ID NO: 541540 - DNA, 1303 bp, Homo sapiens
gtggggctgacctactatacctcgccgctgtttcgtgcgcgtttacagccctcgtcgctgctggtcatgcggggctcgtatggaagcatcattattgcgctccgcgtccgttcaccaaaatcgggctccgccactgattgtgttatggtccataaatgttcgacttcgaccaacgggcgtgttgactcgccagggggtctgtgtcggaaggccgctcctctcactgctatgggtgttggcgcttgccgctagtggtgaccgcaccgttttgacacgttagggggcgctttgtcctgcgctttccgcggggttgtttgttactcctatgtgctcgtaaataggggggagtgagttgtgccgcacagtttcgctttcgccatagaggctcaatagctgcgtcgccatattcccgtcttcgcggtgttgtggtggttccttctgggcctgactttagccccgtcggtagtatgaatccctcactgtcaattgcgtgaaagcagtgtgttgtccgtgggcagagtaagccgaagttggaatgttccgttgcgtgctccaaggacgcttgtcatgtctgctcataacctcaggtaggtcgttccgggaaggtcccgtccggcctggccacgttcgccgcctgctctcggccagagggaaggatcattttccgtgcctgcgatgtgttcattgaagataactctgccgctccttgtcgatggaattctcttcgtagaccacttgtgtctgcgaatcagtacacggcgctaactctgtgctatgcgcgccctttggtccaaggctcttctctcgcgacgaacgctatgtgccctccgtgctggagacgggacgggacgcacggactctggatcactgcgtcagcttcatgtagccgccatgcatgtgttcgtccagtgagctgaagtcatgagctacttgcatgtgtacttggcgtaaatcggagacacttgcacggattccgtgtgcagcgctgtgcccgcacaagtgccatggacagatggagtcctggatggactgcgcagccctagaggtccgcaggcacaaggcctagggccatgtgccacctttcccgtcaagcaagggctctctctctcctgtcgtgggcgtcattgtgacgcaactggcctcatctacaagcacaggcctgtggcctgttcaaggcagaaccacgaccctttgactgcccgggtggggatggtggctcaaggatgctggagctgaatcagacgctgacagttcttcaggcatttctatttcacaaacgcatgacacatgccaataagtactt

SEQ ID NO: 541541 - DNA, 794 bp, Homo sapiens
gagtgcgatcattcgggctgtcagagttggtctgttactcgtgtgtgtggcggagtctacggaagccgttttctgcttcacttttcctggctgtagagcgctttccccctgtgcgggtgcagcagtgcagagcagcaaggtgcgcagatgagcactatgttctgcggacactctcctcaatcgttccctcatctctgttgtgcacggctctgctcgcagagggcataacctgggtccctggtttcccagggagagaccaagtcacaagcagactgccaggcccagcaagtggcaaaccaccagagtacaacaaatgggacacaagcaagcacggcaaccacataaccagagctccaggctggcgtcgcaaaaaccagcacaaccgccaacaacagcagcagacacagcacgcagacacctgcaagcaatagccaacagcagcatctcattccaagtggtctcgcaattggaacattcccaaggttcgcatcatctggcctccttgggtatcccactgccccttaaatgcggcactggtaccactttccccatatttcgcatgggtcacagttgactcggcaacgccttcctttctcaccccctcctaccttcgaactcccacagggaacgtggccctcaaatccgcaacagtcttgcctgtgcggagccatggcaaccccaccaggaaaactggttccctcatcgagcccttggactacttctctggctcactaatttcgaagtcccccacgcacacattcaggcacgcaattctaggacttggcccctttcag

SEQ ID NO: 541542 - DNA, 214 bp, Homo sapiens
cgggccccggggtggagcaggaggggcggagtattgggaccgggagacacagaagtacaagcgccagtgacagactgaccgagtgagcctgcgtaacctgcgcggctactacaaccagagcgaggccgggtctcacaccctccagtggatgtatggctgcgacctttgtctcgtaagggtgcctccttcgcgggtattaccaagtccgcctacg

SEQ ID NO: 541543 - DNA, 862 bp, Homo sapiens
tgcccctcatgtacataaattgttatgcgtagcatatacacagtgctcacttctaggaatactagtatatcgctcacacgtcgtgtcctccctactatgccgtagaaaggagataagactatcgctgttcattataggtactctcataaccctcaacagccacgtcgcgtcttagcgcagtaatagtgcctattgccattactagtcattatgcacgtctggggagggagatgggggcctagcgctactagtctcagtctccaaccacagatggcctagactagcgtagcagtgaacgctaaagctactccatgtgctaaagactacttcgtcccaactaattgtattactagcactgtactatgactttcctgaaattaatgcgtaaatttgaagtcaagcaacagagcacaccacagtcctaattacttaggcatcagtcccctctactattattcttaggcagatcaagaacaacctagtttagctgtaaccacatccttttgcctccgaccccacgtaaaaacgcgccctccataaatactaacatagctgactcctaaccctcaggaaggcatgggcgatgcagaccgccgtcttatgccgtgagggcccttatcaccgaaataaaaatgctacctctcgaatagtaatcgtgctacaaaatctccttcactgataaaatcccgagtgcagctgaacgactgaatatacggttatcctgcttcgaacccggatttatccgagcttgggctataacacccgatgaggggacacaggcggaacgctgaagcagggcatactgctagatttatagcccagaaggtcacgttcctgatctacgcacaaattaactcgaacc

SEQ ID NO: 541544 - DNA, 118 bp, Homo sapiens
gagatcccgtacaccgcaaggtatcacgaccacttgtgttgagatcacttcggctgcttgagtaactgtctcgattccaccatagtggtcacgtgagctgctgtaatcatcatagcga

SEQ ID NO: 541545 - DNA, 456 bp, Homo sapiens
gtcacagtcgcttcagaaaagagtgggacaggtacaagcatatatagaggctgacacataatccacagactagaaacccgatgagggctatgtatccaggcacattctacttccaatttaaaaacctatgggaagccgacgcatcggaacgaaacttggctgtgcttcaccgtggaaggtatcaatgcgccgctcagttgtctcctggtaagacgggcgtcttccgtaaaccaggtggattcgtgagacccattgtcatgcagaaaggtgcttcctctcttggttactgcaacgacaatactgtctccttaacacaaagaaccaggtcaactggtaacacatctaggaagcccttagcccatactgtgcagggaaatagtaggccgcagttccttggccaggcacaggcaacgtgaaatctcaccattcttcaccgccctcattccgcttgtccaa

SEQ ID NO: 541546 - DNA, 425 bp, Homo sapiens
gcacgaggctgttttaaacgcgcagctgttttaaatgaaagacactttatgactactcaagccattataaaagtcacttatcaaagctcattatcacatatatcttaccaaatcctagctcattgaactctactgcagctctcgggttcctgaggctttctactttatcggagccagggctacatgccagcaaccatgtccaagggacctgcagatggcattgatcttagcaccacctactcttacgtgattgttgtccagcacggacaagtagagataattgccactgatcagggaaactgaaccactccaagctatgacgcctatatggacactaaacagtagactggtgatgccgcatagcatcaagttgcaatgaaccccacccacagtttcagatgcccgtctgattggacgcagacttg

SEQ ID NO: 541547 - DNA, 212 bp, Homo sapiens
gcagaaccacgaggacgatgaaggaagttgagatttgtatctgcagaatgcatcttcattattggctagcagattgaaataagtgatggggttcagtcagagagagaaagtcaaactttaccagtgcaaaaaacagggccacaattgcctacgttttagagcgcaagagttttcttcttataacggcaacatgaagcgtttgcgttgggtca

SEQ ID NO: 541548 - DNA, 135 bp, Homo sapiens
atttcttaattttaatttcctaatcattagtgattgtggacgtcttttcaaggggctactagcccatttacagttctgtagattgcctgttatagacatttctaaggctcttgacaagtacaaccatattttttc

SEQ ID NO: 541549 - DNA, 136 bp, Homo sapiens
tgacctaaaggatcccaagctccaacaagatttttcctagtgtccaaagagctgtcctctttggactaacagttaattacaaggggattagagggtctgtgggcaaatttaaaaggttgaactaagggaaattttt

SEQ ID NO: 541550 - DNA, 729 bp, Homo sapiens
  misc_feature (2)..(2): n is a, c, g, or t
  misc_feature (93)..(93): n is a, c, g, or t
  misc_feature (106)..(108): n is a, c, g, or t
  misc_feature (112)..(112): n is a, c, g, or t
  misc_feature (122)..(122): n is a, c, g, or t
  misc_feature (129)..(129): n is a, c, g, or t
  misc_feature (170)..(171): n is a, c, g, or t
  misc_feature (179)..(179): n is a, c, g, or t
  misc_feature (187)..(187): n is a, c, g, or t
  misc_feature (199)..(199): n is a, c, g, or t
  misc_feature (205)..(205): n is a, c, g, or t
  misc_feature (225)..(225): n is a, c, g, or t
  misc_feature (252)..(252): n is a, c, g, or t
  misc_feature (262)..(262): n is a, c, g, or t
  misc_feature (355)..(355): n is a, c, g, or t
  misc_feature (357)..(357): n is a, c, g, or t
  misc_feature (497)..(497): n is a, c, g, or t
  misc_feature (505)..(505): n is a, c, g, or t
  misc_feature (585)..(585): n is a, c, g, or t
  misc_feature (717)..(717): n is a, c, g, or t
tnccctcttcccctccctgttaaatacacaaatatattatattcaatatgaatcgagtctgtttccagcagaaaaaaaacatacaaaaaaatntgggagggggggnnngtgngggggggggngggaggngtgggcgcagggtaggaggtccggagtccagtgtggtttgnngcgccccnagagtccnagggtgggtgcncaacgnctgctacctggaccccagtnggaagtgtgtgcccaaccgtccaaacnagggggtgtncgtaaaggggcaggggacgttcagaaggtgtgtcccttgaccccaagcagcagctgacagccgttgctgacgtgggtcatgaccttctgtttnanctgggccacctgctcccggaggaggccggcggtactcgacagccccgcgttctcggccttgagcgtcttcaccttgtcctccaggcgcgcgatgcgctccaacttccgcttccggcacttggtggccgccagccggttcngcagccgnttgcgctccactttgatgcgctcttggtcttccatgttgatgggggacaccggcggcgtggcgtcccggctgcgcgcctncggcacggtctgcggttcctccttgaaggtggaggcgccgcggcccaagcccagctgcgccgggtggccaccgcgaagggcggcgcgtgtgggaggtagctgatggtggtcgtcgggtacagctcccggtcncgacggcagccc

SEQ ID NO: 541551 - DNA, 296 bp, Homo sapiens
  misc_feature (79)..(79): n is a, c, g, or t
  misc_feature (111)..(111): n is a, c, g, or t
  misc_feature (115)..(115): n is a, c, g, or t
  misc_feature (129)..(129): n is a, c, g, or t
  misc_feature (134)..(134): n is a, c, g, or t
  misc_feature (161)..(161): n is a, c, g, or t
gagagaatggccagcaggaaggcgggccccggggcaagtggcagccaccaagcaggcccaccgtggttcttccaccgtnttttccatgtttgaccaggcccagatacaggngttnaaggaggccttagntgttntcgcccagatcgtgatggcatcatctncagagacctctgagggacatcttctacatcgggagatgagtgtctaccagagagctgctcgcgtcatcagagcaaagccactacttccacttctacgatgtttggggaagagctagagacccccgagaatcatcg

SEQ ID NO: 541552 - DNA, 645 bp, Homo sapiens
agctttccttaggggctgcaacctggacgccgaggccggtttcggagtggggagtgcccattttctctccttcccacgttcctggcccccagacagccatttgcaggcgggtgtgcttgtggtcagcctccgccgcccccaccgcgactcccgtcactgggagagctgcacacctgctgcccctgagaaccaagtcagcagccgcgttagtgtaaccatgtcttgagtcttggacacagtcagcctggactctatgggatatgagctggctggcgactgtgtgtgaaaggagcctggctctggtggcccccagaatctctctggggcctggtggtcgggagagggactacattgcaccatgggaaacgagagagaatgggatgccacgcgaatgagacacagcacttcacctcatgcatgaaaacccccatcatcctctcaaaacctccagcagagcggtcaaaacagccaccacctccaacagcccctgctgcccctgcctgctccagcccctctgtgagaagcccatctgttctcatgaagccactgggaggacggggaaggggcctgtggccgtgacatggtgcctctacccctgagggcaccgcccacactcacccctgaagacccattgaagccatccaa

SEQ ID NO: 541553 - DNA, 869 bp, Homo sapiens
aggatagacgatatcagattgatgctgctatcgtcagatatacatgaagatgagaaagactcttggtctataatcgttctagtccctgatatttactataatcagcatgcaagactttccaggtaacagcctggagatttgacaaagagaattcgaatctctgatagacagagactatatggagagagcacaaagactaatccgagtcagtacctacttacgtgggctgacgactatcttgctagcatcggtcgcccctttcatgcaacaccaccgtagtaatgtaccctcagaagacaggaaagccacagccctgctgtcactttctgggtggactctgaattgatccagcatgtgggacattggaaaggcgaatggaagggacggatggctccatggggtcatctattcaccaaggctcaagaccttcaatcctgcagatgtatctgttgttcccgtccagtctcttgcctctagttcttctgaggcattttacactggttgctgttcactctgtgcataaataatctttgtagattgggaccgtagaggatgtctagtagcagagaagttccttttagaataggtctggtgctgtgtgtcaacagagagctgcaagtcaggtctcgttctcggtgtgtgatcatgaggtgcccaatgaaggaacgaccctagatgctgcctttggtgtaggctctgaagattccctgtaggtatccctgaaaaaaaggttcgctcagatgattccggctttagaggggaaaacaggggccttaaaggggggaaacttcccaaagagcggggttcaaagactgggaatggataagccccttagcggggcccccgggttcggttttccccacgtggtg

SEQ ID NO: 541554 - DNA, 660 bp, Homo sapiens
  misc_feature (320)..(320): n is a, c, g, or t
agtctgaagatggcggctcagagcgcgaggtgctgggcgtgggtagaagtatcaatcagccggttgtttgtgagaagaattccttggactgggcgtgagtcagtgaaagaacattgtgcacagttcggccatgtcagaaggtgcattttacctttgtgacaaggagactgttttcacagaggttgggtggggtcagttttcttcagacgaaggattcggaatgcatacaaaggaaaatcatatatagatggagtaaggtccaggttcacactagaaggccaaaattccgaaacatctgatgatgaaccgaaaggactttnggagaactggcagccctatttaaataaagagcttaaacattaaggcaagaaagaaaaaaagaataacaatccaccacacaaccctttggtggtggggcgcccctccggccccctgggaagaaagtcttctaccaccacctcgccggtgggcggcccgcggcccacatagcgtatcgcgccaccccgtgcccaaggcggtaccacagagaaccccgggcatcccaccggggccgtggcccccccaataaaaacgcccgcggcgccccgcgactgtccacacacccccagggcccgggcgcccaccgcgctctccacagcgccaccggcctgataaatgcgg

SEQ ID NO: 541555 - DNA, 215 bp, Homo sapiens
  misc_feature (79)..(79): n is a, c, g, or t
  misc_feature (111)..(111): n is a, c, g, or t
  misc_feature (115)..(115): n is a, c, g, or t
  misc_feature (129)..(129): n is a, c, g, or t
  misc_feature (134)..(134): n is a, c, g, or t
  misc_feature (161)..(161): n is a, c, g, or t
gagagaatggccagcaggaaggcgggccccggggcaagtggcagccaccaagcaggcccaccgtggttcttccaccgtnttttccatgtttgaccaggcccagatacaggngttnaaggaggccttagntgttntcgcccagatcgtgatggcatcatctncaggcagacccttaggaggacctcctccagctgggaaggtagttcacagagagc

SEQ ID NO: 541556 - DNA, 170 bp, Homo sapiens
tggctgcagtgtagatttgccttagaggaggctgcccaagacttggcctcctcttgccccctcctgacctctgcccttctctggtcctggaatccttggagaaggtaggggtcttgaccctaagtttagatttgatctcatgtgcaggaggttttcctcgggtctgaaag

SEQ ID NO: 541557 - DNA, 216 bp, Homo sapiens
cgtcccctgcagctgaatgctccacattttaccctttcgcggcgcatgcctcttgctctagcacctccatgctgctgccggcagctcttcccttggccttctgcagcagctctcgctctttgctgagagagtccacctctcccttggaggtccacatgtctgcccttgccagatgtgtccctgctcccgcagtgatgcttctgcagcctgttgtct

SEQ ID NO: 541558 - DNA, 366 bp, Homo sapiens
  misc_feature (14)..(14): n is a, c, g, or t
  misc_feature (18)..(18): n is a, c, g, or t
  misc_feature (22)..(22): n is a, c, g, or t
  misc_feature (128)..(128): n is a, c, g, or t
  misc_feature (349)..(349): n is a, c, g, or t
  misc_feature (356)..(356): n is a, c, g, or t
gggcttgtaccgtntggntgcnggcctggtgtcggcttgcaagttctttctgtgtttgttctctgccctgccaaggccgtagagctggtgcgtgcgggtagggggctctccgaggagccgcacgccgngcacccaatggtccacctcactactctcctctgcaaggcccaccgtggggcaacctttaaccatccgccttgccctggggtggctgcaccaatcggccgttctaccgcattgtggctgctcacaacaagtgtcccaggggatgggccgtttcgtagaagcagcttggggttcctattgatccatttgcccaacagttcatgggagaaaaattcgtttgccntcaaacntagaacagga

SEQ ID NO: 541559 - DNA, 177 bp, Homo sapiens
cgcgcacacatactggagaagtacgcactgttcatggtcttcatggaccaccatgcatccatattcgtgctgttgtaactctttgtacagaccagggatcagtggagctgagtgcaacctcctccccatgccatctgcagagcctgtttggctaagtgggtgccaggcggtatcctg

SEQ ID NO: 541560 - DNA, 165 bp, Homo sapiens
atgtgcggtgctctagaggtcccaacgccgagacaccagaccgggccggaacggaccaggactggagacttgactagctctttctcgattccgtgggtggtgggcaacaacttcgtccattccgatctctcggactcgcggcggtatggtgattcggcgtgtgca

SEQ ID NO: 541561 - DNA, 313 bp, Homo sapiens
ctaaaattcaccatgtacgcatgcacgctagtcactgttcgttcgtaaacctgactgtgctgctagcgagtaaaatccttctaattcttaaagtttaaggataatttatcttaagatttcatgtcaaaaataaaagagccagaggctgggtgcggtggctcacgcctgtcatccctgcactttgggaggacacggtgggaggatcttttgtagcccaggagtttcacgaccagcctgagcaacatattgagaccctatctctacgaaaatatcataagaacaaaatagaatcactctggcgattccactatcc

SEQ ID NO: 541562 - DNA, 577 bp, Homo sapiens
actacttaatgatattaggagaagttgactgcagtggcatgcacctatattcccagctactcaggaggctgaggaaggaggattacttgagcccaggagttcaaggccagcctgggaaaatttgtgaaaccacatctcctcaccattttccagtttaggaaaaaaaaaaaaatagtgcaactcacagccagcactcatctaattttacattaatacactctttgaggctgaaacaaatctgactcattttcagtgtgaacatacattataaaaactcttcttggagttatttctaaacagagctaacatcagatccatctgaatcatctattttagaaaaactgaatttatcaaattaatcttcagccaacaacttctcgagaacaacgttaacatcctgctatattttccaggatttgacatcttcaacgatcgaaaatgtctatattttgtaaatggaaatagcactcatacaatagaatgctaaatattgaatgtgttttttctgtttccaaagttggtatgctaaatcaatgaaaaaataataataaaagctagatattttgtgacaaaaaaa

SEQ ID NO: 541563 - DNA, 101 bp, Homo sapiens
ccactccaccttactaccagacaccttagctataaccatttaccgatattatagtataggcgataggagatttgagaccctcgcgcaatagatatagtacc

SEQ ID NO: 541564 - DNA, 921 bp, Homo sapiens
cttggtgtcttacattgaggtcttcgacactggcacacatgcctcaaatggtccgcgtgcgacaagtatctcggagttatgtaaatttcccggagacaagtgcgttgtgtaagaccgccaaatgttgcgccttgggacattgtgccaggaagcccttgtcccgttgaaggcacaccccccacttgggagaaactggacacacaaggtgcggggcgtacatttgctggagcaaccccggcggttcttcctgtgaccaaagagcaacagggggtggttgtggacacacaagaaagccaagtcgtgggggccgcaacaaacaagtgagccacggtgttgccccggaaatacttgggtacccgcctggtacacgtgctgtgtaagaacgcaaaaaacgatcgcgggtttccccccgcagcaacactgtaggagtgtttgcccccccccaaccccggtacattctcgtcccccctgtggttggtggagtcgccctccctgtggaccaacctggtaataagaaaaacccatgcctgtcgtgcgaaaggcacgccctacatgtctctcatgcgaaggagcccccaaccagccgttgtgttgatctttgtccggatctaccaaattcatcttcttacagcaccatcaaaccatcatccaatcttctatctttcccacaaatgagaatccttcctaacgtaatttcttccatctcttcttgtaaagaatccatttgtccccgaacaaacattctcccacctgtcttctcaagaagcatatctggggactatattactattgcgccagcacaaaacttctgaaggtacacagaagaatactttcttgcgacgcctttataatatagtcaaccattgaacaccttcacccccccttttacacaaaaaaaaaaaaccctctttttacaaaaca

SEQ ID NO: 541565 - DNA, 372 bp, Homo sapiens
cgtgggatcactggatgtgccactggtttatttacccgcttatctactgagtgaacgtctcagctgcttccgacttttggtaattatgaaattatgaataaggtttggtaattatgaataaggctgccgtaaatatctgtgtgcaggattttgtgtggacataaattttcaattcatttgggtaaatacaaagggacaaaactgctggatcacatggtaaaggtatgtttagtatcgtaagactgtcgaactgtcttccagagtgaccaccgttttgcatccccacctgcaatgaatcagagttcctgttccacatcttggccagcactgggggttatcagtggtgtggattttggccattctaataggtgt

SEQ ID NO: 541566 - DNA, 326 bp, Homo sapiens
  misc_feature (263)..(263): n is a, c, g, or t
  misc_feature (308)..(308): n is a, c, g, or t
tttttcaataccttttaggctttaactataagaaatggagagtcggctgggcatggtggctcatgcctgtaatcccagcactttggaaggccaaggccagtggatcacctgaggtcaggagttcaagaccaacctggccaacatggtgaaaccctgtctctactaaaaatacaaaaaaactagccgggtgtggtggtgggtgcctgtaatcccagctacttgggaggctgaggcaggagaatcgcttgaacccaggaggcggngcttgcagtgagctgacattgcaccattgcactccagtctgggcnacaagagtgaaactcctc

SEQ ID NO: 541567 - DNA, 191 bp, Homo sapiens
ctttttgttttttttttgggagagtctcactcactctgttgcccaagctatagctagagtacagtggcatgatctcagctcactggaacctctgcctcctgggttcaagcatttctcctgcctcagcctcccaagaagctgggattctgggagtggtggcacatgcatgtaatcccagctactcatgagaa

SEQ ID NO: 541568 - DNA, 1512 bp, Homo sapiens
gagctagatggccagtcacgagaacccagtggacatcctcatcatggatgatgaggacgtctcgccatgtctagggctcccaccataagcttgtcgctccggtccccagagctgctgcctccggcagcacggcccgggcgagatagcgctatagctagcacggacaggaacaaggagaatcagtcctattggacatggtcatgtgataggatgagacaagagacggcgagccactacgccctcatcacgtacgcgaacgcgtgagtcgcagatcgaaccgcatccccatcgcgtcatccagaaaccgggatcgcgagtgagaacacgagcacattaggggcatatcaagtaagcaccacctggacatcgccgcggttaccacagacactgcgctggccactgaacctcgccgaagggcgcatacggaagacagagaggacgatcgagcaaagaacacagatgcgaaaccaagtaggggcggtcgcgtagacactgggaccgccagacgccatagcaaggcccccaggggaggaaacaacacggcaacgaccacccatcacccggacacaaagccgcaccaggaaaaggcactagatgaggccaccagaacacagcagccccacggaacaacaccaaacaggcccccacaaagaaagaaagagacccacagagacggacaacagacccgccaaccacacggcacccccaacgcaagagtgccaccaaaccccaaccacacacgcaaaaaagcacgaaacacaaagaagagaaacacggcacaaacacagagtgacaagaaagagaagaacaagaggacaagggaaggaagaggacgcccacgaaacgcggagagcatacagaggcacgcccacagaccacgcataacgactgcctgcggcgaccccagatccacgctgtgcgagcacgagaatgcacaccaagcgaacacatcagacgcgacgcgtggcgcaccaccacgcacccacaagtccggcgacaagcaaccccgcacgcaacaaaacaacacccaaaagagaggacgcacgtagaagaagcaccaccacacccaaacacgaaagccagagcaaaaacaaaccaaagaaacaggtacaacgacgaccaccggagccacccaccaagacaagaacaacaaagccacacaaaccacacaccaccgacacacccaaagcacaaagcgatagacaaacacaaaaaaaagcaacaaccacaagaagaagaaaggacacacgcggacacacaacaactagacgcaagcaaagatggccacccaggccgcaatagcaaacagcacaacccagaaggaagaagtagacaacgaggatggagacactagaaggactgaagagtagaggatagcagaccagtagcaaccgagaacgcgtaggcgtagagagaatagtcgtagctccgtgagcaaagtaaagaaccagacgaagtcagacaaggagaacacgagagcgagacaaataagcaggcagtatagcatatata

SEQ ID NO: 541569 - DNA, 114 bp, Homo sapiens
atatctgcaggcgtgtctaaaagtgtgtcattttgcagggggtttaggtgcatagttctaccacactagagatctaggacattggtcttgactttggtgagttctcttgaggaa

SEQ ID NO: 541570 - DNA, 175 bp, Homo sapiens
gccatctgggaatctttgcttgaatgatgtttgaagcaacaagtgtgaccaatagagtgaaaggtcaaggagtttaaatggaatggattcttgccataggcagtggcaggaaccctatgaaggtctggaatgaactgaaagtgcaagtgttttcagagtagtatgggtgggactt

SEQ ID NO: 541571 - DNA, 1030 bp, Homo sapiens
ggggcgtcgcgcgaaggctaagggagtgtggcgggcggctccctgggagccaagatgcctcggtatgcgcatgcatggtcatgggcccccgggggcagtcggtggaagagcaccatactgtggcacacatgtgtccatacactgtgaagcgcactcaaccggtctgtccaaggttgtaaaatcctggatccatactagtcagaatcactttcagactagctccggtgatggctgacgatccgggaaactgaatcggaggtgggactgactgtcctcggcaggatgattctcttgcgacttcggtcccaagcggagcgatctggtctttcgcatggagttacttttgccaatacacttttgacttggctggacgaacttgtcttgggcatgtagaggacgactatatcctttctgattggtccagggtccagatttgaggttgtaacactcaacctgcctggtggatggaaaaccaggctggtccaagccagctcgagcagtgggaggtcccgagatctgtgagaagtttttctgggtgaattcttcagttcatggttggaggtccatttccagtttatttcttgggcatcttgggcaagccccttgaggttgccatggaatctctctagcaaaattcccgcaagtcaaccattcattgaccacacattggatgctgcctgagttaaaaaaaagcaaaacaacgggacattgacgacctttttagaatccaggaacattgttattccttcactttagcaaggaattcttaacaaagttgcacttaaagggaaagcccaacgacaatttccaaggaaacacgtggaacctaacagggctcattattgttgtcacctggcatgtgacatgaacctaccagccagtgaggttccgaatatttcataaacccgttaacggatccagtccagacttcaaagaaaaggcctggaacacttgggtaacggcccggcatacctgggaatctcggcccttcaaatattggcagaagcacgctacaaatctaaagaaacca

SEQ ID NO: 541572 - DNA, 152 bp, Homo sapiens
ccagatcacgaagggagatctgctactaaacagagttcaaaaactttccagagtaattaggtatgtaaagctcatgtaaactagacaaaggatttgctattagagataatatatattggaatttttataagcttacttcagagggatcctct

SEQ ID NO: 541573 - DNA, 262 bp, Homo sapiens
gccagatcaaacagtggcctcgccaagtgcattgataaaggtctctgtgatttcacagtacccctcggacagggggcccctccctgtttggcagcccaggtggagagagagaggagacagcttatgccattatttctgcatttcagagacttttagtacttttactgattttgctactgctatctagagggcggagccaggtgtacagagtggaacaggaaagtgaaataggagcgtgaccgctgaagcacagcatcacagg

SEQ ID NO: 541574 - DNA, 957 bp, Homo sapiens
  misc_feature (14)..(14): n is a, c, g, or t
  misc_feature (148)..(148): n is a, c, g, or t
  misc_feature (211)..(211): n is a, c, g, or t
  misc_feature (222)..(222): n is a, c, g, or t
  misc_feature (253)..(253): n is a, c, g, or t
  misc_feature (257)..(257): n is a, c, g, or t
  misc_feature (268)..(268): n is a, c, g, or t
  misc_feature (274)..(274): n is a, c, g, or t
  misc_feature (277)..(277): n is a, c, g, or t
  misc_feature (286)..(288): n is a, c, g, or t
  misc_feature (300)..(300): n is a, c, g, or t
  misc_feature (310)..(311): n is a, c, g, or t
  misc_feature (315)..(315): n is a, c, g, or t
  misc_feature (317)..(317): n is a, c, g, or t
  misc_feature (331)..(331): n is a, c, g, or t
  misc_feature (343)..(343): n is a, c, g, or t
  misc_feature (346)..(346): n is a, c, g, or t
  misc_feature (348)..(349): n is a, c, g, or t
  misc_feature (373)..(373): n is a, c, g, or t
  misc_feature (376)..(377): n is a, c, g, or t
  misc_feature (385)..(385): n is a, c, g, or t
  misc_feature (398)..(398): n is a, c, g, or t
  misc_feature (400)..(402): n is a, c, g, or t
  misc_feature (407)..(407): n is a, c, g, or t
  misc_feature (412)..(412): n is a, c, g, or t
  misc_feature (419)..(419): n is a, c, g, or t
  misc_feature (424)..(424): n is a, c, g, or t
  misc_feature (436)..(438): n is a, c, g, or t
  misc_feature (475)..(475): n is a, c, g, or t
  misc_feature (481)..(481): n is a, c, g, or t
  misc_feature (493)..(494): n is a, c, g, or t
  misc_feature (522)..(522): n is a, c, g, or t
  misc_feature (651)..(651): n is a, c, g, or t
  misc_feature (869)..(869): n is a, c, g, or t
  misc_feature (878)..(878): n is a, c, g, or t
  misc_feature (917)..(917): n is a, c, g, or t
ggaaggcccgggancgcggggggcggggggcgaacggcggggggacgggggagggaccggcggcccgcgggcgcgccccggggcgggggagcgagggtgcggggggcgcggcggcggcggaacgaacgcggggcgggcggggcgcccncgcagggcccagggccgccggcgcgacatcgacatcgaggacgccacgcagcaccggcggganaaccgcaagcnggaccggcccgcgggcggccccagggcaganagcncacggccagcnagggcnganaaaggggannncaagggacggcngggcccaganncgcncngcgcaggggaaagnaccgcagcaaanaananngggcggcggaccaggccacccaanaannggcaaganaagcaggtcatcngnnnctcangagangaaagcnccacnggcagggggagnnnggccaaggagggggagaggggggcgagcagggacgcnagcagngcaagcaaggcnnggggaagcaacaaggggaaaaaacagcntggcgccaagaatgacggggaacagaaggacgacgagggcaaccggagggcgggggcgaacgccggcggggccgaggccaggcgggcggccaacaagggcgcggcaggggggcgggggagcagcggcanaccggcggagcggaccgggcgcaagggcggcacaggcaggggggcggagcgggcgggcgcgcaccgcaacgcgccacagcgggccggccgggaggaggcaggcaaccggggcggggggcgcggggcgcgggggaagggcaaaaggcaagaagagagcgggggccagaggcggcagccagagggcacgccacggaaccacgggcgcaggagcagcgggngcccggcancccggaggagaccaaaacggcggggaggagagagccaanaggggccggcggcaggagacgggcggagggggggacggga

SEQ ID NO: 541575 - DNA, 126 bp, Homo sapiens
  misc_feature (63)..(63): n is a, c, g, or t
  misc_feature (83)..(83): n is a, c, g, or t
gatattgcgccactgcactccagcctgtgtgacagagcaagactctatctcaaaacaaaacanaaacctgactttgtactggnttccttatccttttaggggagaagaggcattgattttactcat

SEQ ID NO: 541576 - DNA, 801 bp, Homo sapiens
tgctggagaaaaactgataaagccacagtgagaaatggacaagtctgccagcatctttggagatttcaccagtacctctgcttaccatcaagtaagttacacagaatgccaatatgtagatttgaataacgagatgaatggacgatggtgtaatggagaaatataggcctttgtacccaaatagttagatatgtctatattcttctcaaagcaatatgtggcactgtgggagaaatattaattatatattaattcgtaaagcaagtcagaagatttaagaacaaggggtacgatccacaccatataatttataagtttaacatatgaaagcaattaaggttagaaggcagataatgaagagatgtaacgaaaaagctagatgagttggagaattaagacaagccttgttaattcatggtataaaaaaatcaatagaattttagaatgctttagcaatgtgaaccatagttaacatatgaaaggttctctcatgtaccgtgtttctctccctcgtccctctctcttcctagtctggaacattcaagaaggctaaatcttgtttcacatgaagaacagcccaagatactgaaaaagtaggaatcacagacacgatggcatttccagtggtaatcccctttcccccaagaggggtgagacatgtttctttaggcttccttgtgatagttgtggtcacgtgatcactaaagtacttacaataaaacagagtctgggtttaatttggggagaacacctagaggttaagggcgggccaagggggtaaattgacgggggaaacacgcc

SEQ ID NO: 541577 - DNA, 250 bp, Homo sapiens
  misc_feature (15)..(15): n is a, c, g, or t
tggggcaaaaaaatnggggtagggggcccccccttttttcggtttcccccgccgggggggggggggggcccccctttttccccgcccccccccaaaagaaaagagggggtttcccttaggtgtttaatttggggcccggcctttttatacccccaaagatttttttttctacccccccccaacccccccccccaagggggggaattttttttttcccttaaaaaccccccccccgggccctttttttcca

SEQ ID NO: 541578 - DNA, 193 bp, Homo sapiens
  misc_feature (49)..(50): n is a, c, g, or t
  misc_feature (61)..(61): n is a, c, g, or t
gattagttcatcaacccagagcaaacatgcacatctctgaagccaacannattcttcagantgctggatgaaaaattgaaagggtcgggattactgttcggaagagaggatatcacatagcaccatttttaccactcaacccaggagctactactgtgtaaataggttacacccagttgaaatctttgcaaag

SEQ ID NO: 541579 - DNA, 131 bp, Homo sapiens
gctgcaccgagtaggtggagactataggcacgtgcaccatgtccgagctactttttgtattgttagtagagatggggtttcaccctgttggcaggctggtcttgaattcctgacctcaagtgactcacccg

SEQ ID NO: 541580 - DNA, 268 bp, Homo sapiens
ccccccccctgtcccccatgacccttttcccccggtgacctggggtcccccccccatcttttttcctgttccaaaaaggggggggtggggggttcccctttttgtttcaacttcatggggccctgagcgggaactttttttttccccattaaaattagacccttgggataaatttactttttcaaatttttcccctgaggggttgatgggttaattaaaggagaagattcctaaaatttgagagcccaaataaatgggagccctgaga

SEQ ID NO: 541581 - DNA, 518 bp, Homo sapiens
atagttatatgttgaaggaaagtttttagagaatatagagggtaaagatggatttaaagaattaaataggagtttataagatggtttgttagattgttagtgaaatttgttttattaaaatttgaatttaaattaagaaaaatatttgttaagaaagaatttggagtaaagattagtagaggtgttaaagggaagaaggaggaaaagtaggaagttggaaaggaaggtattgtattatttgaaaatggtgaaattaaagttgaagaggtatagaaaattgaatttgtagataatgagggagaatgaattgttatgaaaaattggggttgattttatgtattttttgggataatttttaaaagttatttttattaagtattttgtaaatgttaattttttaggattttattagttggtatatgaaaatatataaggatggatattttattgttttatagttatgttttttggaaatttatattatttttaagtaaaataaatattagttaaatattgga

SEQ ID NO: 541582 - DNA, 211 bp, Homo sapiens
caacctcaatggtgctgggggtggatctgagttgctgctcatgtggtccttgcttcctggtgcttttctggattgtaccagccatgaaacagcatcctgggcatgggtgtgggcacatgagcacccaccatcccttgtctgtcgcggccccctagagtgcacccacttcacatggccacagcaagcccctgagcaaggagcactgggacat

SEQ ID NO: 541583 - DNA, 297 bp, Homo sapiens
gcagaaggagagacccgggcaagcttcagagcaagagtggaagtttattaaaaagcttcagagcaggaatgaaagaaaagtacacttggaagagagccaaacaggtgacttgagagatcaagtaaaacctcattaacgtaactgcaacaatgaagacattacctagacgtgctggcttcctctttgccttcctccatgatgtaagtttcctgaggactccccagccatgcttcctgtacagcctgtggaactgtgaaccaattaaaccttttttctttataaattaacaaaaaaaaa

SEQ ID NO: 541584 - DNA, 187 bp, Homo sapiens
atcttcacgacgctatgttgtcatgctggaggtgagagtgttgtggttggtgatctgtggctgtgtagaaggtggtagatgcctcatgaggctggtgttgtggtactgcaggtaacgttgttatttcagttgagcctggactgatgcgtgaggttgtagattctccactgaactgaggtttgtggag

SEQ ID NO: 541585 - DNA, 247 bp, Homo sapiens
ttctggaacactgaaatatcccccagcagtcgaggagtgttggctagatctcagtccccatcatcactcacatgcccttaggggacctggggttacagcaccactgccagccccatctacggtaatccagtgacctaaatagaacggaatggcgactgtttcatatgtgcttccgaatgctgatgagggaagtctgaacgagaggggaggctgtggaaacatggtctgtgatcatacacagaggtgt

SEQ ID NO: 541586 - DNA, 803 bp, Homo sapiens
ttagtatatgcaggcataccctactcacacaaatagcttattaccagagataggaaattgcaggtaatttgggagaaatgtcatagccaaatttatagagaaaaaataaaataaaaacttctctatggcctcttgatttaagaaaaaaacagaacaatacaaaaaatataaaaagccctaaaccaggatttatctgagaatgtcttcccaaaagggaagatgacaccaatctatataaacacgtcagtgcgcatttactgccgactccgagtggaaactttaaaaccttaaacagactctcctacagcaaatagatctctatgtgcagcatgaggaatcactgcatagttctgctccaccactaatatgatgggtacacgcaccaaaccatggaaacagttagatgttacacgaacatactgctgcaataatgactgtcaatatgggatcttatgcttgaaccaacatggaaagtactaatttatcacactgttgatccatgattaacggcctcataatcactcaagaaactgaacttactgacacaactctatcattgagcaatcgacaaactatgacctaataaaagcccaccctcgtggggtatcaacaagacatacttaccctgccaaggcacagaatataactatttaaagaggatacaactactattaacaaaagacacatagtggcgaccgaggtgaccctaaaagtcgaatgttcaccaaagtcatcaggttagacagctatctagttcgaacctgttccacgacgatcacacatggaaaacgcataaaaatcac

SEQ ID NO: 541587 - DNA, 865 bp, Homo sapiens
gatggactcggtggagaagggggccgccacctccgtctccaacccgtggggctggctgtcccggggccggcgccgaagctgcagacgcaagtctcgcggcggccagtggccgaggtgtggatgaagccccgcgtacctggacagccctaattctggcccgctggcagtgcagcgtaggcatcccgcctgaagaacattaagcacactggcgggggtcccgcgtcattggctgggtcctgcgtgcggcccgtggattcagggccgccttccagagtgtatgggtttcgacagacccattgatgaatattgaagaatgtggccaaaacaattttggttgcacaaggttcatcgaaagaacgtgctgaacgtttcaacaaggacagcttctaccgtcaactagagtgccagtcattacgaatttctcttacgttatcatacagtgagggtcgaccaatgttaggaaattattcaaaggctacttctccagtgtttaccatccttagctgatcttcaacgaaaggttcgcagaacatgactttcgagaacgaacggactactgagttctgtatctctgttgtgagaacgcccatcaagtttcgatggagctgcaaacttcacggaaacgggagtccgctgaaagttgacccgaaccctccttgaacttttcaattcccatgcttagaacggcctcgtccgacacagacgtgggtagtggccgcaattactcttgcccacgtgggtccacttgaatctggggctcacaacgaccatttgatcgaccgatggcgtactttgcaggcgtggcaacacctgggcttactttggaactgcgatttgacctttgtgtggattcaatgttgcatat

SEQ ID NO: 541588 - DNA, 149 bp, Homo sapiens
aacatatacacaagaacaagttgataagattgatagcagcaatggccttggctggactcagaaaactcattgctattggtcgccacgaagcacacgacgaaacatggtacgtggggtggttgaagataaggatacaaagtaacccggtg

SEQ ID NO: 541589 - DNA, 392 bp, Homo sapiens
ggctgcttttccctcatgtgaaaaaaacctgtttccctttggtttttcctggctttgcacctggtggctattccaaaacagttctccagtatgttttggccctggaaagttggacatgtgtgtggctcaacagttttttcgggggagttcagtgcccttttggtggcccccctctgttttcccctgtgagtttttgcaggtggcgacttcatttgcaaggtcccttacatagcccccctcagctgcttcggaaagcgtgacgaaccagtagtcctcagtgtgtgtgtaagtgaaaaggcccttgtggtagcagggcccatgcttcatttgtggctgtgtccccctttgagggcctggtatccagtaagatcaataaatacttgtggaatgca

SEQ ID NO: 541590 - DNA, 319 bp, Homo sapiens
catccgggccctatattacgagctgtctccacaagaaccgatatggatctagactacgtctgactctccacaagtgcgtgaggggaggggatggctgccatcgtgtgggaggcatgcagacggaatgatgggcctgatggacgtgtcccctatcctgcagattgaggagagcaccacagcggtcaacacacagtctgctgaggttggagctgctgagacgacgctcacagagctgagacataccgtccagtccttggagatcgacctggactccatgagaaatctggtgagtgccttcacatcacctgcccagctcctc

SEQ ID NO: 541591 - DNA, 152 bp, Homo sapiens
  misc_feature (120)..(120): n is a, c, g, or t
  misc_feature (146)..(146): n is a, c, g, or t
ccgacagcatcctacagctaaactgggaaagctctgcggttctcaggcttgtctgaccagcagtgatcttttacatgggttggaaaattaagtctcatttgtacagttttccatttatanatacagagatagaaatagtcaaccanattggc

SEQ ID NO: 541592 - DNA, 137 bp, Homo sapiens
cagactccctgcaccgtcaggtgatctcgcccgccttcggcactcccaaagctgctgggaataaccaggacggttcaggcaccgccgaccctcagaactagcttctttcaagggatgtaccaatcaccacgctccag

SEQ ID NO: 541593 - DNA, 230 bp, Homo sapiens
atacagtgattcaggttcttctctattcctgtaatctaggagtgatcagtgacatctctgacctatgagtagtaatacaggaatgccactagaggagctgtgtattctagccagtctgtaactctctttagccccatttcagcctttcagggatacaagaatggctctataacagctggtcaattgtatgtcagtgttcctggattcatatctagtgtagggcgataaat

SEQ ID NO: 541594 - DNA, 401 bp, Homo sapiens
  misc_feature (34)..(34): n is a, c, g, or t
  misc_feature (185)..(185): n is a, c, g, or t
  misc_feature (208)..(208): n is a, c, g, or t
  misc_feature (253)..(253): n is a, c, g, or t
tgcaaccttgaaaacgcgataccaagggcaagangccagacataaaacgacaaccactgtatgattctacttacacgaaatacttagaataggcaaattcaaagagacagaaagtaactcgaggttactggggactggtggctgagggaatgggacgttattgcttaatgggtacagagtttctntttagggtgatgaaaaagttttngaaatagatagtggtgatgattgctcaacagtgtgaatataatanctttaaaatggaacgtttaagccgggcacggtggctcacgcatgtaatcccagcactttgggaggcagaggcaggaggactgcttgaccccaggagttcaaggccagcctgggaaacatagtgagtccctcgtctctactaaaaggta

SEQ ID NO: 541595 - DNA, 204 bp, Homo sapiens
acctccgtgtgcttcataataagtgcatacagggtttttatccaggcttgaatgacaaagaaattctgacaagtttaatacccatcaatgatagactagataagaaaatgtggcacatatacaccatggaatactatgcagccataaaaaagaatgagttcatgtcctttgcagggacatggatgaagttgaagcgacgtcgga

SEQ ID NO: 541596 - DNA, 115 bp, Homo sapiens
  misc_feature (31)..(31): n is a, c, g, or t
gcaaagatacagtattacagtgacatcagtntatctgcagtatttttacatttgctttgtaagaaggagcatatgcgaaccttttttacaggacccagtagtttttttatatttt

SEQ ID NO: 541597 - DNA, 348 bp, Homo sapiens
  misc_feature (171)..(171): n is a, c, g, or t
cagctggcccaaggccgagaggaacactacgaggaggaagaagaggaggaagaagacggggctgcagttgctgagaaatcacatcgaagagctgaaatgtagcggcacccaatttctagacaacgctcagccaacggattcttttcaagctgctcaaacataaatctgccnactgaactctaggatatttaattacaaaaattaagaacttagacttttttaaaacttttgtattagaaatgcgcatacatttatatgaatatattttgataacgtaggtctagagcttcttttatattcaagctaaacatgaaaaagaagaaaaacaataaagtaaacctgagcccc

SEQ ID NO: 541598 - DNA, 243 bp, Homo sapiens
ggtccctcgtacttctgcccgcgcccggcgtagcgccgcgcgaactggcggactgcggcgcgcctggcctcgctggccgacgaaacgcccgaaggccgcagcatcgtggcgctggccgacaaggccatccacgcgccggccgtgcgcgccgccgatgccgagtactgtgcccttcaccgcgcagacccgtatgagcgtgcgtccacctgaaagaccgcatgatccgcaagggcgcggtcgacg

SEQ ID NO: 541599 - DNA, 777 bp, Homo sapiens
  misc_feature (212)..(212): n is a, c, g, or t
  misc_feature (540)..(540): n is a, c, g, or t
gaggacggggcgatggcgggctgagaggagctgcgtcgtgcgcgaacatgtaactggtgggatctgtcgtgggctcccagatgatggtcgtcctcctgggcgcgaagaccctagtgctcgtcgccgtggcgccatgggtgttgtccgtagccgcaggtggccaaactctaaaatctcctcaaagagtagaggtcgaccatcatagatgacanatttattcctgaggtggaacaggagcgatgagtctgtcgggaatgtgactgtttcattgcgattatcaaaaaactggggatggattacttgggtctcaggatggtctgggtgtcagcacctatttactagttaccatattgccacgtttgtcgttcactctaggctgcaatgttccatggaagaccattaggttggcgtatacagagcagagccaggataacacttcttcatggtatgaggtcgactcatttacaccatttcgctggaagctctagattgggtccttccagaaatgtaccatttagaaggctgtaagagtaaggggantagtgattacagattctcttgcgtggatacaacaagatagttgtgactgtggaggcattttggatggtttaaagctttagcattttagggtaacttgatctgggacaccactccttcaggtggtaggacgaagaggatttggccatgcttgattccagagcattaagattaataaatgctcaaccagaggactaattatggtttaaaagttaaagcagagtagttaggtagtggaga

SEQ ID NO: 541600 - DNA, 135 bp, Homo sapiens
ggaagtgacatcgtctttaaaccctgcgtggcaatccttgacggaccgccgtgatgcccagggaagacagggcgacctcgaagctccaactacttccttagatcatccacctattggatgattatcccaaatgtt

SEQ ID NO: 541601 - DNA, 448 bp, Homo sapiens
tagcagaacttgcgcacgccggagaaaccgcgtacagcggggaccccaccccaagcccgccggccaggcagccgaggctcagggtcgccagaagcttcagggcgatagtgagggtcgcgagccccacgcagagggggaccgccgcccggaagggggacgttgcggtaccgctttactcctcgtcttcattcaccacctgccctctcccattcttccctacttccgctattctcccgacccctccccccttctcttcttccccatcctctcacttccttcctcaccgtcctgattctctcatcacctctctccccccagtcccccatccattactctccatcccctctttctctcacctccactcacctcacacttccccccttctcaatcctactctctacctttcctcgtcttcacctctcctcttacctctctcctcctttccttg

SEQ ID NO: 541602 - DNA, 146 bp, Homo sapiens
ggactcgtacgttatgtaaagtactatttgtccatcttaacatgaatatttattacattacttttagttcaataaattttaacaatatttaaaaattatctaaattcataaaagtatttcataaatttcaacatttaattattatg

SEQ ID NO: 541603 - DNA, 1302 bp, Homo sapiens
  misc_feature (300)..(300): n is a, c, g, or t
  misc_feature (308)..(308): n is a, c, g, or t
  misc_feature (313)..(313): n is a, c, g, or t
  misc_feature (421)..(421): n is a, c, g, or t
  misc_feature (643)..(643): n is a, c, g, or t
gacgacgagcgtgataatccgtgattccatctaattctctcgtcgacacacctgtacggaaggcgcaatgcggtaagtctcttgacctaccgcgtgatatctcaggcggcatatgcagccgtccacgttccctggtagatcggtagtaatttggtcattatcacggcgtttgaactaagcatattgtattcgcccagaatggactagaggcgccttcatcagtgagtagccgctccatggctttaaacgtaccgaactctcccgctccttaatgtatctctagttgtggtgctccgatgngtgagtgnacccnagtcctacgtctacacttgatgctatctgacgcgtcttacaagtgtcccgttgttaattacgtcctcactcgagcgaatgagtaactgctctcaggagccgccgtganacatagaaacttccgggaactaggacgaaaacgtatagagaaatagcttgggttcaaaggaaatggccttgtgccccatctgggaaaagctaactagaattaggcgggtactatcttttggtgccgccataccaaggagtgctccgtacctacgagaagtgctcagatagtcgaaggcagttgtacaccaaactatgaaaattaccccgtactgggacaccnccaagccgtttttttaaaacatttaatacggtgtgccatggtggtacaacaatgcgtttccccaccttttccccacggttggtcatacctaagcaatccaaggcccaaaccaagcaacagtagaggcgaatagggtggtctgttgcccccaataagtggctgggggaagttagaacaggcgtttgaacacacggttcccccacacaaaaagtttccgatagaatttttgccccgagcacatatgttgggaaaacaggacataacaggggctctgcttttgacttcggcttcttttggtggacctttggctacacaagcccttagggtcgtagaagggtctaagccgaggacttctggaaacacctggcaaccttctgaatcctaatggacaacctgggaattgtggccaccgctctttatgtgtgttgccggtaatattttataaaaacggtattttctcccataaacccggttgatggagtgccttgacgttccaacaacaaccttcgtccattattgggcggtatcggtgccacatggtgccggcattgccaaaagtggcacacacgaacaagaccttgtggcggccagaagcgggaagcaatgagtgttcaccccgcgggggggggccccccttttataattcacaattaaattca

SEQ ID NO: 541604 - DNA, 533 bp, Homo sapiens
acacctcctccttgctggagcagctgaacggcagtttaactggtgtcccggctggccaacctacgccagagcgaagaccagtactattttcgggtccccccggtggcttcccacacttttgactcgggcgttccttccggtgtcactgaggtggtcgtgaagctctttgactctgatcccatccctgtgcgggtccctgtagaagtctccaggaagaacccttaatttatggagaccgtggcggagaaagcgctgcaggaattcccccaaaagccccgggaggagtgaaatgtggatgttgcttttgcacctacgggggcatttgagtccagctcccccccaaatgaggtgcagccccccaaagagagctttgcccgtcccccagtaaccaggccccagcctccaggcccccaactccgcccagcctctccccgctttgggtcctgccctctaaccctcgactttgctggtcatgggaagaacaaaattgctcccgcatgccactaattccataaaactgttttgtgggctga

SEQ ID NO: 541605 - DNA, 104 bp, Homo sapiens
gtgtcagtgtgatgatagggatatggaattgttatatgaaaggccggtaatgattaatctccattttaccaggtttggattaggtgaaggtgcctgaccccagg

SEQ ID NO: 541606 - DNA, 661 bp, Homo sapiens
ggctggagacaacactttatcagtttgacactggcaggagtggaacagtagacccacaagaatcgcagaaggccctgacaacaatgggatctcaggctgagtccccaggctgtgaattcaactcgcaaaacgatacagcaccaatggacagatcaccttcgacgactacatcgcctgctgcgtcaaactgagggctcttacagacagctttcgcagcacgggcatactgctcagcaaggtgtgtgaatttcccatatgatgattccatctcaatgtgtcatgagtgttctaaactcaagaggaagctgcatgaactgtactcaacattccaactgcagctctccttgtgcttgtcctcttctgccttcggctacatatgtatacacacttacatcacgactttctcttaacagctgtgtaacagtttatcactttatgtacaactgaagttcgtcctccagtttagataactaaacttcttgggaacctttaactaagatctagtctgttacaccattctagaactttcctgagccattatcagtcatgccttattttctggctaaaacctctatgtaactcttacgtatggcaaaatgtgtaaggtcacctcatttcattctccattgtggaggatcctaaaagactggttactccggac

SEQ ID NO: 541607 - DNA, 231 bp, Homo sapiens
ttagaggtatcccccgcgcgcatatatcctaatctaagattgtgtgctgaggctgtttattataataatgtttgtgtcttcggctataagaatagggcgaacgcgggcctgcggcgtattcgatgtttaagcctgagactagttcggactccccttcggcaacgtcgaacggggttcggttggtctctgctactgtggagataaatcatattatggccaagggtcatgatg

SEQ ID NO: 541608 - DNA, 585 bp, Homo sapiens
gctgtttatcgcccccttatgtgggccccccgggtggcttgagcctcatatgcgatggattgtccaacatgctattaaggtcccggatcttttgcccccggatagagcttcgaggatccactcctgggttctattctgcccagtgggtctcccgggactcgggatttttgttgcccttggtcgttcgatcacggtgcccacacaacggggggatgcgtgggcctgttaagctcgggtcacggtgattaggccccaaggggggccgcgtgggcccacggacacacggcgctcctgagggttctgggcacaccgaccaacgccggcaggacagaggacactggagtcgttgagggcgcgccacgccgggtatcccggcctcccgcgagaatgggtgatttgatggagggcgggccccggagtgaagagggcgtccctcctcccatttttgtttttggaaggctttctgcccagcccctttgttattccctccccccaccttggccccttgggtttttcccccacagggtaggtgttttattttttttggccccttgggtttataaaaataaatttattttcttttta

SEQ ID NO: 541609 - DNA, 899 bp, Homo sapiens
cttatgtaatatttgatcgccgtagtgactctttcagctgactccacctcagttttagggcagcgccctgaacgcatccgctaccatggcagaggtcgctttgggatcatggagaaggcttattgccattattttgtgaagttggtggaagggcccccaccttcacctgagccaccaaggacggcagctgcccatgccaaagaggatatttagcagcttctcagccggacccatccttcacactctatgatgaggagatccatactccacagtgtgtatattttgccattcattttctaaaaatcagacctaaattcacggtcgataacccaacacaaatgctctcattagccctcatctccgtcctccttctccccctttcctttggcgcgggatatttctagatcgctcttaccatgacctatgtattagataaatcacctctcgccccgctgtatacattccctctccgcctctttttcctattcttcttaacctcgtgttaatctatataactctccccaccctttcctcctctcaagttcctctcctcccacagcgcccctttctttctgatttagactccgccacccacctatgacagttccgatcccgtctagtctcgtccatgctttcctcccgctgcagttcagcactcaccttccctctacttttccttttctctatattccccctcaaacctgcacatacatccttctccgatcttcgtatctacgtcgctcctcattatccgccagtttgtagcttcgttgtagctgttacttcatatcccccgtccaaacacatcaattctgcatgccccgcctatccgtattttctccgctccaacatgactatacttctatctctcctgcgcccccctctcccacattctcatt

SEQ ID NO: 541610 - DNA, 736 bp, Homo sapiens
cgccttagataactggttataatagaagcagtctgggctactttaaagaccgattgtcctcccaatggcaccattggtctgtaaccagatcaacatcgggatgttctttacaacaacatcgtagccaacaggcacttgtacatgtcgcatattaagccttcatccttaaaagagtctgtatggtaagacctattaggctccaagctgtaaacaagtctctgtgttaattcatcaaggcctccaatcttgttgtaacgatagtatggtaatcagcgcgttaatccagatttgtataccgcagtacagcaattgccaccgtaatcacggccttataattagcatgcttacacatgtttagtcatgcatcgataatctatggcagcgtaagtcagtctccatacaaccgctagcattcaatgactgtgtagtctgttaatctgtaacatttgtgcctataatgcgtatgaagtgagaacccttcactcaatcgagtatcagaagcgtctattgcaaaatcttctccagcaattgacagtatagtacctccgttgaaaacgtaggtcgaacatcgcagctgctaagggctcccgtctctgtgcagttccatcatcaagtctctgacagcagccgaattcatggctgtagagtacaccatcgtacggctgcgcctgcggatacgactcttgctgtctcacctcgtggcgaattcggcacctcgtcacgaattcggcacgag

SEQ ID NO: 541611 - DNA, 177 bp, Homo sapiens
  misc_feature (26)..(26): n is a, c, g, or t
cattgagcaatgtgcccagctcttgntgtacctactgctcaatcaggatcggtcactgcaggccctgatcttgctatatggaatttaccaatgatagatttttcccttcatatgtggcagatatgtgtaaaccgcctgcaccatcttgtaactcatgaaatcccacaccatttcttc

SEQ ID NO: 541612 - DNA, 160 bp, Homo sapiens
taggtggtgagagacgagaggatgccgcggcatccgctcagatcgagaagttctcgctgtggatctgcgaggggaggattccggtctcgagcaggtcatcgcggatgctgtccatccagtggcccggtccgcacaggaagatgtcgtagtcctcgatgtc

SEQ ID NO: 541613 - DNA, 841 bp, Homo sapiens
gtcatggtagtacatggcaaggatgatatgtatgatgtagaatatgagcttgcgtaagtcggagtgaagttaggttaagcacctagtacgagtcactaggaaaacatggatcagtacatatttataggatctccggcatcaacaatcgcaagacatgtccgggttcacctgaataggctcctcgcattcgagaattcgcgccatccgaagtaggatcagaaaaaaacaatgcgcgtatctccctttctttatctggtataaaaggatggcataagtagagaccctcggagatccgtggcaggcctaacctgaagtctagtcgactaagttcattattgataacagactgtgagcattgtcacatctagattaccactatttaaggttgatcatccaatagagcaagtaggtgggagtcgggatcgggggggatgtcagcaccatctgggagcttgtaaggagactggggatcacgcaggtccgtacgtataacgatacataaccttttcagagttccatgctctcgattgtatagtgtccagaacactggttttgaacttgtcaagggctagatttagctctagtcttttaaagtaatgcgtctttgcctcctccaatggatacgtgtagtttgtctattaactgttcaactcagtaattaccatgtcttactcttgttcggtgaagagttaactgtgcagggcccttttcatccaagttaagtagttctgttttacgcacaaggagaagttgccctaggtggcagcgaacggttgacactatggcgcaagttttcctcaaattacgcgggttaccatttggatacatcacttactttatg

SEQ ID NO: 541614 - DNA, 205 bp, Homo sapiens
gggggggggggggccccccccaaaaaaataattttttggggggggccccccccccccccccccctaggggggggggggggggttttttccccctgggggggggggggggtttcccctttttgggggaaatttttttggggggggggaaaggcccggggtttttttttttttccccccccccctttaaaagggggggcccccccca

SEQ ID NO: 541615 - DNA, 108 bp, Homo sapiens
tgcagggagaagcgggtgggggtagcctggatgtgggccaagatccactgtccgtcctgggcggcacaagctcattgaagaagaaccagcccagccagccccctatct

SEQ ID NO: 541616 - DNA, 141 bp, Homo sapiens
gctagggtgaactgaagactatagcgctctccaagctgccagagagagcacaatagtgtggtggaacttgtggccctttccaaggccacggatctattcggcctgcaaatgtcagcccacgcatctccctgatgcttgtgg

SEQ ID NO: 541617 - DNA, 996 bp, Homo sapiens
  misc_feature (996)..(996): n is a, c, g, or t
ttaccatgacgacagagatgatgttgtggattattgggccaaaagaggaagaggtcgtggtacttttctttgtggcagacggcgctttaacttcaaaaaatcaggtagcagtcctaactggactcatgacacatacacaggggcatgggacttgcacgcacacacgccaacatcacacacctccctacgacacacagatcatcattcaacactacctccagctcaatattctgtctctagtactttttttatacctcacataacacaatgtatgtcatccgtctcactacacttatcaatcacaacacactacaaaacaataactaccccagaatataaacaagaaataataatacccgtcatccaaactccactaaatctctatctcgacatcaacgcatcacccttcatccgccattatattaccaaatcacacaatattaccaacaattaatatcctatatcatatgcccccagaatccatattcaccaatcatccctatctcatatctcatattccacacccccctatttaacatataatatgatacatcgagaattaatgccattgccctcatacccacaacccacctaccgatattcacaattacactcagccccccgctactttatcatctacatcgaagtcatctcatactctaaaccagctcgcattacagatcgttagattctcaaaccacccttactttctctcttacacatacattcacacatgccgtatcctacatcatccaaccgcgagtatatccgcacatatactcgtctacactccactatattttgtcgcgtctatattcgtccctcttcgcatccatctatctttccacccacatccccatctccatttacagaccaccatcgccccacatactttatccattcattaccccactaccctattctgttgtccgccagctgcaaatccgccaagaagatatcactcggcgatgtatatcaaataatcatacattatgn

SEQ ID NO: 541618 - DNA, 144 bp, Homo sapiens
  misc_feature (30)..(30): n is a, c, g, or t
  misc_feature (44)..(44): n is a, c, g, or t
  misc_feature (96)..(96): n is a, c, g, or t
  misc_feature (103)..(103): n is a, c, g, or t
caggatttaaccatggtttattgcagaccnattgtgtgccaggnatgagcccagtgctcccacaaacagtgtctccaggtacgagaactgtaattncgacccnggaacaccttcctgcactcagacagaagcatgtgcagactg

SEQ ID NO: 541619 - DNA, 404 bp, Homo sapiens
aagaaaataaaggaagcaaaggggaccaataagactgttgtgaattcagttttaaataatttggtcagggaaggttggtaagtgagaaggttgtatttgagggaaaagccaaagaatatgaagagcaaattccccatgcagaattcaagggggaaaatatttgaagcagagagaatggcatgtgcaaatgctctgaggcgaagcaagcctagcacatttgagaatggctggagacaaaagaaagtcaaagaaatgaggtcaaagagggggtgagttcaacaaggagtaataaggtgcttgctggctgtttcttccatacctttatgatccagagagaattctcactgcaatttggatacttgcatatgtaatttaaagttaataaaaagatcgggaccaagaaa

SEQ ID NO: 541620 - DNA, 210 bp, Homo sapiens
ggccccaggttagactaacaagaagactgaattgtataatactttaaaagctagtgatctatttgctttctcttccacgacaaatataaggtgccatggaacaggctgttcccaaatgctgactccaagaggtaaagtgttatttcgttgattagttatttcttaggcttagcttcgcgtttatttgttaagattgttaggtctacctgg

SEQ ID NO: 541621 - DNA, 190 bp, Homo sapiens
ccatatatattttagaatagcatcgttatttctataaaaaaaaaatgtcatgaggggaacaggctgaacaactaccggttaggtattatgcttactaccggggtgatgccatcattcataccctaaaccccagcatcatgcaatatacccatgtaacaagcctgcatgtgtactccctgcgaacctatga

SEQ ID NO: 541622 - DNA, 420 bp, Homo sapiens
tgtctctataaaaaatataaaaattagctgggtatagtggtacgtgcctgtaatcccagctactcaagaggctgaggtggggcatattgcttgagcccaggaggctgaggttgctgtgagccaagatcaggccactgcattccagcttggacaatagaaccaggccctgtcaaaattacgacaggacaggataggacaatttatttttcccaaaagttagatcacttatactttcaccagcaattaacacaagtgtccattttcttacatctttgcctgcactgtttgttgccattttatgaaaatgtttgccaatcagatggatgagatcagtgctttacaaactgggtaccccggtgctggagaggttctttgaagctgccccagggcctctaagggttggagaggaccactcaggat

SEQ ID NO: 541623 - DNA, 225 bp, Homo sapiens
ccgctagaggccaacaagctgatatccatgtcagctgaggctctcagttcgcccaagcgtgagtacaacagaggacagctgcagctgaaggctggcaccagcccccaatcccagccccatcttcaggccaatacatgctgctgggacgtgctcagccccagcaccaccctgcaggctccaacacggtgtgtgctgtccgctatgactgcttccagctcatcctga

SEQ ID NO: 541624 - DNA, 206 bp, Homo sapiens
gtgttgaggttgcggtctgttagtacgtactagtgatgccagcagctacgactgggcagagataggagaagtaggactgctgtaattagcgacggatcaacgcaaaggggcgtttggtattgggttatggcagggggttttatatcgataattgttgtgatgaaattgatggcccccaagcgccacgctatgggcctcccaaagag

SEQ ID NO: 541625 - DNA, 348 bp, Homo sapiens
accccgtgtaactggaaggagctattcattatagaaattatctttaaaatgagaaaaagaggctgggcgcggtggctcatgcctgccatcccagcactttgggaggcaaggcgggcagatcacaaggtcaggagattgagaccatcccggccaacacagtgaaaccccatgtctactaaaaatacaaaaaattagccgggtgtggcggtgggcgcccgtagtcccagccactagggaggctgaggcaggagaatggcgtgaacccgggaggcggagtttgcagtgagccgagatggggccactgcactccagactgggggagagtgcaagagactccgtctcaaaaaa

SEQ ID NO: 541626 - DNA, 173 bp, Homo sapiens
gatcaggacagcttttcccctttactcggtttcctacaagcaagtaggaaaaacagtgaattttccctaaaatgtccaatctgtatttatgtcccctgtcagtgttttgctgttggttttttaaaacaatctgatcaataaatcttatccaaatcaatttggttccagttcca

SEQ ID NO: 541627 - DNA, 1059 bp, Homo sapiens
  misc_feature (1059)..(1059): n is a, c, g, or t
tcgctcctcactccatcccagttctgcattgctacgctgctgtgacgttggccgaagcgcccgttcttaacgtacccactaggacgcggttgttcaacgaccgactgtagcagaagtcaatccagaaccaatcacccattgcattgttacgagagacacgagcgacagatgacccagagaacagcgaaggaagagcagcattggctcactacgtggtcattacgagcaggtttgccagcgaaagaccatagaatggcatgcctcattcctcgagctgtgcactcacatggcctagcgtcgcgcatcgatgccattgggtcgcctcgcaataagaactccacgatcagtggtcttaaggacgtataatctcggctccattgaccaagactagtcggaacctgaggaagtccaaccaagtgatggcgagaataggcgccgtcgtgcgcgagaaagtacaaggcacattgtggattagactaggatcgagcattagtcccgcacgacatcgagggacctcatgtcaacaggagtacgtagtggctctttttcgttggccccgtgaacgcctcttcccgtggtcaatgcgtggagcgctggggtactgggtgcctggtctcttggagacggatggcgagcatggagtcattctccctaccttcctggctgacattactccgctgacttcaacgttaccgcttcaataggcgccctggggggcatgcctcagcttggcactcgttagtgccctgtctgggagggttgtcagaccacacttgcttgatcaacgtttcgtgcaagtgccaagtagtaaaagcatctaacattaaagccaaattaccaggttggttataggcccaaagaagcaatcatcataccaccaatagctaggagtaaccaacgcgtactctcgaaacacaattattcccattagagagagagggcccagagttttagacagtacagttaccacgagcattcgcttcggtcaccaacgggtgggcccactattaggagagagcgcaggaaaaaccacatatacgagccaaggaccccagtccn

SEQ ID NO: 541628 - DNA, 312 bp, Homo sapiens
atagacaactagggtcagtctgcaggtgtaagccatttaccaagatagttgtaggtcaagaagggcagatttattagagaaagtcgtgataatatgttgcagtgggcagctcagcagagaaggggctacctgcaaagaggcaagggctggaggaaagttttatagggtcctgctgaagggtgctacgtgtggaatgaggtcattgtgcccgcaggttgtttgtgattagctgtttctagcaattgttcatacaataattgttcattattgttctcaacttggggctctccccaacctggggacccttcctta

SEQ ID NO: 541629 - DNA, 288 bp, Homo sapiens
ctgactacggaggaagtccttggttacatgtcattatagcatttccgacaagttataaagttgtcattaccctctggatagttaaccttagggtgtgtgtcctgaagactatcttctggtctcgaaatggacatgatggatccactgatgtacagcagaaagcctggaggtccaaccgccgtagacaggaaagtgctgaggtccatttgtatgcacacaaagaaaagagtttgttcctttcgaggaaataaaattggcctgaaagacgtcattactctacggagacat

SEQ ID NO: 541630 - DNA, 350 bp, Homo sapiens
aaaaaaaaaaaaaaaaaaaaaagggggggggggggtttttaagttggcccccaaagggggggggggggggcttgaactttttggttaaaccccccccttttaaaaaggggcccccaaaacataggggaaaaatttttttggtgggggggaaaaaaccttggctttgggggccggattaaaagggttaaaagcccggggtttacccattaataacccttttaccttggggaaggtaccggcccttaaacccttgggtcccctaatgggaaaagggggaaaaaaaaaggcccctttccaaagggggggtttgaaaaacaaaggggggggcccgggttttctttggcaaaagg

SEQ ID NO: 541631 - DNA, 418 bp, Homo sapiens
tatatacaacttctctgttacttttttttttgagacagaagccacactctgtctacttggctgtagtgtggagcacattctaagctaactgcaacctccgcctcccagttcaagcaattcttctgcctcagcctcccaagaagctgaaattacaggcacccgccaccacgcgaagctaatttttgcatttaggtagagaggctgttctacaatagatgcacatgactggctcaaacttctgacctcaagtgatctgcccaccttggcctcccaaagtgctgggattacaggtgtaagccactgcacccggcctttttaactttaaacatgttttagaattcgcctaaagatcaaaatatcatggattgaacctcatcaattgatagcagtgagtgactgacgcttccaaatcaagaaa

SEQ ID NO: 541632 - DNA, 885 bp, Homo sapiens
  misc_feature (25)..(25): n is a, c, g, or t
  misc_feature (30)..(30): n is a, c, g, or t
  misc_feature (33)..(33): n is a, c, g, or t
  misc_feature (37)..(37): n is a, c, g, or t
  misc_feature (54)..(54): n is a, c, g, or t
  misc_feature (56)..(56): n is a, c, g, or t
  misc_feature (80)..(80): n is a, c, g, or t
  misc_feature (91)..(91): n is a, c, g, or t
  misc_feature (149)..(149): n is a, c, g, or t
  misc_feature (157)..(157): n is a, c, g, or t
  misc_feature (168)..(168): n is a, c, g, or t
  misc_feature (184)..(184): n is a, c, g, or t
  misc_feature (202)..(202): n is a, c, g, or t
  misc_feature (209)..(209): n is a, c, g, or t
  misc_feature (274)..(274): n is a, c, g, or t
  misc_feature (323)..(323): n is a, c, g, or t
  misc_feature (333)..(333): n is a, c, g, or t
  misc_feature (422)..(422): n is a, c, g, or t
  misc_feature (435)..(435): n is a, c, g, or t
  misc_feature (443)..(443): n is a, c, g, or t
  misc_feature (460)..(460): n is a, c, g, or t
  misc_feature (491)..(491): n is a, c, g, or t
  misc_feature (702)..(702): n is a, c, g, or t
  misc_feature (704)..(704): n is a, c, g, or t
  misc_feature (728)..(728): n is a, c, g, or t
  misc_feature (762)..(762): n is a, c, g, or t
  misc_feature (782)..(782): n is a, c, g, or t
  misc_feature (859)..(859): n is a, c, g, or t
tatgggaataaatacttgttaaacntcccntanaaanatgcattaaaacgtccnanaacacaagccaagggccgtaaaantaagggtaaancaagaccgaatttcccgcacggaccagcaggaaagccagtcacccaaaagagcccaanccccaaanccgccgaaggngcagggcggccccagncccggggcatcctgaacnggtcccnccccccgcgcacggcccgcatgggggtcaccgggcccgtcccacccgcgtgccgccgcaccgtcntcccccccacccccatgaaggggttgtaggtaaacccccccgccagggnggatggcacngtgggccccccgatgccgtacctccccctggcccaggccagcctcccccggatggcggcattgccgcggccccacgtggcgtgcaaacntgaggttgttganggtgtacncggggccacagtagacncctgtgtccggggggagccggcccaagaccnccagcagagctttacacatctcatccgcagtcccttcatagaacttcccgcagccagccacaaacaaggtgtcacctgtgaacacggcagggggctccgagcctccgggcttgctcacgaataacaaatgtgtcctgaagtgtggcacggggtcgccaggcacttgacgttcagagaccccacctgcagtgtggacaggtgagtgatcttntnagttagggccccgatacggtcgtnacccccgtacaccttcagtcccgactccagcttnaccagtttctcattcccgcnagcatggtccctagaagtcaaacaggagacctgggctgccttctgagctgagggggctgcctgctgagctgaggggntgcttctgctcttaaacctagtcaaa

SEQ ID NO: 541633 - DNA, 492 bp, Homo sapiens
cgctccaatatcctgtgtttcgcaggatcctgattagatctgatttcaaaactcgtgatgcatttgaattatggtcacatggctctctgattgttaccacggtagagcggcccccagctgtctacttcctcacagctcctactgctatcaccagtttgagaatgcacacctgtccctactgctccaaaggcagaagcgcatcaactgtgcccgatccactctctgttgccctgcagggctgcatcttggtccctggggcgacattatctacagtcttcaaatcaggaatgggaggtagtcttgtaggcagctagtagcttctagaagctgcttagccgtcccttccgccggtttctcaatataacagctgggcctgaactgatctccaagggcctcatcggcattcgtcctcgatcccagcaaagctgccctttgagaaccacaggtaggcttgttctacctgcagtacagccatatcctccagtgatacca

SEQ ID NO: 541634 - DNA, 355 bp, Homo sapiens
ttcattaggcaaattagtgggtgtgatatggtatctcattgtggttctgacttgatttccctaatgactaatgatgttgaacatcttttcatgtgcttactggccattgtttatcttctttggagaaatgtctattcaaatcctttccacatatttgaactgggtgtctttataattgagtcacaggttctttttatattctagacacaagtctctcatcaaatatatgatttgcaaatattttctccaattctatgggttgttctttgcattttttttttttttttttttttttttgggggacggagtcccgcacggaaccccagccggggcgacaaagcgaaactccgtcccc

SEQ ID NO: 541635 - DNA, 156 bp, Homo sapiens
ccacttcatcaccaacattccaaccaatgcaattcaattgcatagcattccaaatcttaggcataataattgtacagctcaatcaacatcaaaacacaccaagtgttttccaattccacataatacatgtaatgccaatgaggcaatggacatgac

SEQ ID NO: 541636 - DNA, 121 bp, Homo sapiens
gtatctatacctgctgttagctgaggaagaagttcacatgttgtgactgtatgagtcaaactgaagaatgattattacacgtgggaaaaagccaattgcttctcttagaaagctcaagcta

SEQ ID NO: 541637 - DNA, 327 bp, Homo sapiens
atactggaccttctagttttttgttttgttttgagacagggtctcaatctgttgcccaggctggagtgcagtagtatgatcacagctcactggaacctcgaacacctgggctcaagcaatccctccgccgcagcctcccgagtagctgggattacaggtgcacagcccagctaatttttgtatttttaacagaggcaggatttcatcatattgcccaggctggtcttgaactcatgagctcatgcaattcacccaccttggcttcccatagtgctgggattacaagtgtgagccatcgtggctgccctagtagaaggtccaggtatg

SEQ ID NO: 541638 - DNA, 153 bp, Homo sapiens
ccctcactacagggcgacgagagcacataggaatgatttgaaaattgtatgttcaacactgtcattttatttttacgatgttagatatggtgagtagagcgattgaggtgaagtagattaggcgtagccagacgtagagcttaaggagtaggc

SEQ ID NO: 541639 - DNA, 332 bp, Homo sapiens
tattggttctgcattaatgttaaacaactcacgtcggtgacggcgagtaacggacaggcagcttcattagcgctcgcagcctttcctgtgaacctgtagcaactctttattttttcgtacttgctctgtgctgcttcgagcccctaagctggggcttcaaatactacgaaaaactcagtattattcttacagcaaacttgtccaaaagtcaagagtaatgaagaagcctcttgtgaacttgtttaacgatgtcatcgtgagtgcttcaaggaaatacgaaaggacaacaatacccacgagctatgcattgttttctgtattagatgcggggg

SEQ ID NO: 541640 - DNA, 137 bp, Homo sapiens
tggaacgtggaggtgtagtgagccaagattgcaccactgcactccagcctgggagacagagtgagactctgtcttcgaaaaagaaatatgtgagaatttagatgataaagttaacaaagttaactttttagatgtaa

SEQ ID NO: 541641 - DNA, 451 bp, Homo sapiens
tgccttgtcatgtgactcccccctaaggaggggcccttggggaggggctggggccctcccaatgcaaccagcatagccctttttgggcccccccatggtacaccctaaagcctgaaacttgaaccccaatcctttgacagaagaaccccagggtcctggagccctaagtgggactaactttccttcattcaacccaccggggtttcaaactcacctcaccccactgggggtgatttggaatttggtgccccaatgtaagcaccccttcatttgggaattccccacttgagaattacccttttgccccgaacatgttttttttttccctcagttgggcccttccttttggcaggatttttcctccctccctctttccctcccttcctctttccatttaccctccgattgttcctgaaccgatgagaaataaagtttttgttgataatcatca

SEQ ID NO: 541642 - DNA, 105 bp, Homo sapiens
  misc_feature (88)..(88): n is a, c, g, or t
  misc_feature (100)..(100): n is a, c, g, or t
gcggtcactctagacgtgactccccccctcttctcctaacggacgacacgacggggggtccgacgctcgacacttcgtaactactggntcactacgctgntttcc

SEQ ID NO: 541643 - DNA, 107 bp, Homo sapiens
tcaatagtgactgatatagagaaggtacaccgtacacccctttttacaggagatgctgcctgactgaagcttactgatgtgaggcttctagtgggataccctacctt

SEQ ID NO: 541644 - DNA, 430 bp, Homo sapiens
ccaaatttgggggggggggggggaaagaagggatttgggggggaattttccccccccccccccccccccaaggggttattttttaaacccaaaaagaatttttagttcccccccccccagccccccaattttttgggggggggggaaaaggaccccttcaaagtccccggggttggggggggggaaaggggggcaaaaaacccgtcccgttttttttttagggcaaaaaaaggggggttaaaaaaattttggggtccccctttagggggggcccccccccggccctggggcctggggggtggggatttggggggcaggggcacccttgtttcccccgtttgttttttttcccccaaaagggccctttttttttttaaaaaggccccaaaaaagggggaagggtcccggaaaaaaaaattttttaaaggga

SEQ ID NO: 541645 - DNA, 1463 bp, Homo sapiens
  misc_feature (135)..(135): n is a, c, g, or t
  misc_feature (302)..(303): n is a, c, g, or t
  misc_feature (425)..(425): n is a, c, g, or t
  misc_feature (607)..(607): n is a, c, g, or t
  misc_feature (621)..(621): n is a, c, g, or t
  misc_feature (1463)..(1463): n is a, c, g, or t
gtcacaaagatgtcagagacggccgcctgccataacgaggtagtgtgtaatgcggaatgtggagagacagagatgctgagtatcatgcatgctaagacggagacgaatgacgtgcccgaaggtgggtgacggaangtacggatggatggaccgtacatcatatgagtagactcgagatagcattgtacgtacggactgaccgatgttagatgactgtatgcatgtctgatgttctaggcttaccgtgggtcaatcagaggcaagtctggagacgcagtggactgcgagcgagtgcactcganntgctcgagtacactccacgaagcacatatagacgcagagccaggaggagtgagcgttaggaatcgactagaagagatcgggagaagaagtctgaaacatcaaatccatggacataaggcgcngggctggagaacccctactttcactcctcatctcaacatatactcaccgtacatacacagtataatctacagaggcgtgcggggtcagcgctgtgcgcgagcgttatgtaagagtgcgccaccgggctcacccgtccacgagcgaggtgcttcgcagggtcagcgcgacgaccagtcgggcntgattgaacacccncccgggcgtacatgcgcgagcacgacctcttcgacaaacgctcgaaaggaccccggattggaatgttagacttcgcgaccatagccaagggttgcgcaggcgcagaatacccagagacatatccccataggaccgttttgccgacaggagccacccatgtggcgttatgtaatcttctgccgttttccattcccacaggagttaaccactactactaaacagacacaatagcgacaagcatatataatcgcagcacagaccctcacattatcaacaaagcgcacgtttgatggagaccagattataggtgcacatacattctaacagggccgggtgaagcaaattacttttccggataacacagaggggtttcagaagggggccagagtattcacacacacaaacagttgtggcagttccgtgccggagcgaaatttagaaacacccgatgactaatcgcggaggaggccacctttgaccgaggaaagcccacagacttaccccgtccggtggataacacccataacggtgtatcgtaggaaaccccttcctataaacctttttgctttgagggtaggttgagacccatactctcggtttcgccactcttcacttcaacaatcccattcgcaggcagggcgcggagcggcacacaacacaagaagaagcgaccgtctttcgtgctatcaaaaagaacgagaggggcggccacacacaaagtttgtgacttcacaacagcggggaagaccagaccacacgacaagtcctctttagtatttccgcgggacagcgaggagtttcgccccagctaaaacattgggagacagggcgacggcaatagn

SEQ ID NO: 541646 - DNA, 217 bp, Homo sapiens
tatatactcgagcgtagtgagagactgcgtatagcggatacactctgaagagagagcaggagagctataacatgatacatatgcgagtttgctgcacgccttaataaagtgtgaatggacgtcgaatttagcagaagcaattacactggccgaaagaaaatactcagatgagaagaagagggttgatgaactgcagcagcaagtcaagctgtataag

SEQ ID NO: 541647 - DNA, 179 bp, Homo sapiens
ctcgtcgtggggctcatcgtggcgcgtggggtgcatggccgttcttagttggtggagcgatttgtctggttaattccgttcgttatcggaattaaccagacaaatcgctccaccaagcgccacccaaagagccacccaacgagccaccccatgcgccacaccatgagcctcacaacgag

SEQ ID NO: 541648 - DNA, 242 bp, Homo sapiens
acctgaaaatgccatacccatacctgatttatctgaaggcaattctagatataactataaactaggaaaactgtgagtttaacacaagtctacaacacaagttgaaacacctgatcttgtggatactgacatacacttaccactcttagaacaccctagttttactaactcacttactctgactgactcagacgttgagatgaaagaactctgatggtgtgtgaccagaataaactatatta

SEQ ID NO: 541649 - DNA, 687 bp, Homo sapiens
ttctatggttatatttataaaatagctggttaaatgaagaaataatgaaatcagaccatcccttcagggggaaaaattgcagtgttcaagagttgtttttttgtttagtttttttgtttttttgagactgagtcttgcgctgttgcccaggctggagtgcaatggcgcaatctcggctcactcaacttccgcctcccaggttcaaatgattctcctgcctcagcctttcaagtaactgggataacagggctgcactaccacacccacctaattttttgtattttcagtagagacagggtttcaccatgttggtcaagctggtctcatactcctgacctcaggagatccacccaccttggcctcccaaagtgctgggaattacagctgagagccaccatgcctggcattaatgttgttttaattgtcacagcatctgctactagaggatcattattatgatcatttccagtgaaagcatgtttaaaaacaaacaagaatttagactttaatataaaatgtgtagattgatcaaacttggatgttatgaaattttagtgtttttatagactagaaccatctaggaaatccatttcagttagattccgtttgcttggtttgatgtgttcctccaaatcaggtgttgcatgtatatttggaaaggctttacaagggatggccgagggtccc

SEQ ID NO: 541650 - DNA, 460 bp, Homo sapiens
  misc_feature (78)..(78): n is a, c, g, or t
  misc_feature (90)..(90): n is a, c, g, or t
  misc_feature (94)..(94): n is a, c, g, or t
  misc_feature (151)..(151): n is a, c, g, or t
  misc_feature (176)..(176): n is a, c, g, or t
  misc_feature (224)..(224): n is a, c, g, or t
  misc_feature (328)..(328): n is a, c, g, or t
gggtttcaaagggagcgcacttccgctgccctttctttcgccagccttacgggccgaaccctcgtgtgaagggtgcantacctaagccgnacgnggtagaggcggcgcaccccttctgacctcagtgccgcgctcaagatcagaatgccanaacttgaaggacttgcgggacggtncccgggcccggggatgggcacgcctgaagctgttgtgggggcgcgcgnggctacggtgtgcgcgaatctgtgttcaccgtggaaggcgggcacagagccatcttcttctcggatcggtggagtgcagcaggacactatcctggccgagggcnttcacttcaggatcccttggttccagtaccccattatctatgacattcgggccagacctcgaaaaatctcctcccctacaggccccaaagacctacagatggtgaatatctccctgcgagtgttgtctcgac

SEQ ID NO: 541651 - DNA, 130 bp, Homo sapiens
ggaacgtctgaggttatcaataaggttcctagttccagacgccatgggtcatttcacagagagccaagcttattatcacaagcctttgggccagtgattgtgagatgctgagagaaacccttggaagtct

SEQ ID NO: 541652 - DNA, 139 bp, Homo sapiens
tccgttcagaaagaagaaataaagaaacctgtgctaagagctaccttgtgctccctcagagaccacatgccctgccagtcctggagagaagcagagtgtgcagccttggtatctcctatctctccgtgggggtcgccat

SEQ ID NO: 541653 - DNA, 342 bp, Homo sapiens
cggcttcctgatgatggtcattgggggggttgtcatgtgatgggtcccctccaggttactaaagggtgcatgtcccctgcttgaacactgaagggcaggtggtgggccatggccatggtccccaggtgaggagcaggtgtccgtgagaacccgaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatca

SEQ ID NO: 541654 - DNA, 297 bp, Homo sapiens
acttgctcgagaagataacctacgagtattcctgaggtgggctggatagtcctcttgggaggcttctttggtggtgacgagaacgagatgaagaggatgatgagctactcccagacaaggatgctgccgaacgtatacttcgtcttactggagatctactccttctatgccttggtggaggaggcatacttcttggcggagtactactacgaggagatggccgcctttttgggcttggccgccttctaggtgaatacgatcttgatcgagatctatggcgccgtcccaaagcacagg

SEQ ID NO: 541655 - DNA, 757 bp, Homo sapiens
gggttggggtgtgagaggtcgctcgctctagggagattcttcaagcaatcagtatgtcaacgatgacacaggtgtttcccttccttcatatgaggaagatcagggatcaaaactcatgcgaaaagctaagagaggcaccattcgtaccgcgtggaatagcgggtttgccagtccaattgtggcatatggattatataagactgaagagcaggggaagtactaaaatgtccggattcatctgatccacatgcgtgtggcaggccaaggctttgttgtaggagcaaggactgttggtatgggctattccagtgtatcgggaatggctgggcagaaacctaagccgcttagaagaagagatgcggtctatggtcttgtcggaggagcttgtttatagttagatgtcttattattaaagtgacctattatggtggaaagaaacggaattggatgggttagatggtagcatggatttgagtattggcttcctttcttgcagggcttgggttgtgctttggtgaccgaggttacttagtgacgtagtgaactaactaggtcattcagggagtcaaggtaaatgtaaacgtgtcaccctaaatgcattgaagggtggttgaaaatgtgtcacttgctgaaagttttaggatgaagtttaggtctaaaggaagataacggggggcccggaaggaaccaggtcggggcgaaaggcgcgactttgggagggcccaaaagtctatggccatgataaattggcggccgt

SEQ ID NO: 541656 - DNA, 343 bp, Homo sapiens
ggtcgaccaccagcgcccccagcggcggtgcgcgcgattgccatcggcgttacgttgaaatgatggcgggccttgagccagccatcagtcgccgccgccgaggtcggacttgaatcgatgctctaacatttcagctcctgaaaaagcggctgattgccggtgtaaagagcataaatttgaaacaaaccaagaagaactgctgtaaaagcaacgctaccttgtagaaaatagaacgataaaaccagcacgagaccggcaatggaccctctgacggatttgaacaatatgtacctgttcgccaaggtggtggatcacggcgggtttacagcggcggcgaaggcga

SEQ ID NO: 541657 - DNA, 157 bp, Homo sapiens
ccggaactagatacataattgctttcctctagatcatccagaaaaactgcacacatcaatttaaccttacaactataaatgcaagcgccgattaataaaacgcacggcaatctgacgtcatggactaaagcgatctgcggccttatttcaccttgag

SEQ ID NO: 541658 - DNA, 485 bp, Homo sapiens
acccacggccagtgagacttattgttgtatcattaaactttcgggaataaagatgctttaagtaatttttaacttttaaacaacttatgaagctctgaagacaatacaaggtttggtttcacactgactctcacacattcttgttcattagactaaaaatcctttatatacctgtatccaaggcaggaatcaatgtgcaaccctgaaataatttcaaccctgaaataatttcaaattagaagctgattcttaactctgctcttttcctgtaatcatggcattatcccttgtaatcgagatcattaaacataatctcacattgagagaagtttttatataaagatgtactgtctattattaaatagaatacttaatatcctaggctgaagatgtgcaatggtattactccattaggagccctatttcagtagggaatgcccctatttgtttggccacccatttagacacttctggcagcaaaattt

SEQ ID NO: 541659 - DNA, 111 bp, Homo sapiens
actcacgttcaatctctgtcttctctcaatgtgctagttatgtattatatcatccagaatttctacagctcttggcaagatctttagagaatgcttttggcccttatcgag

SEQ ID NO: 541660 - DNA, 125 bp, Homo sapiens
tccggggcatagggtatgtatgggggcggctcagccgcatttctcgtctggccggagggtctgccgcgcccccagcacctacgggggcgcgctgttgtctcatcctcccgcttctcctctggggg

SEQ ID NO: 541661 - DNA, 469 bp, Homo sapiens
cagttctctccctatgctgcgactactaatctaacttactgtctctatggactgcctattctggtcctttcttataaatggaacgacgcaacatgcagcccatgttttctggctgctttcactgagcataatattttcaagattcacccatgttgtaacacatatcagtgcttcattcctttttatggctgaataatactccattgcatggacagaccatatttgtcttatctgttcatcactgacagacatttgggtttgttccattttttggctgtcatgaataatgctgtcagcatgtatgtatgtacgcggtttccttagtttttatctaatgtcattttcctgttccaggatccccttcaagataccacattatgtttagctgtcatgtttctaggctcccttggctgtgacatttctcaggttttcattgtttttactgaccttgacagttttgagttctggt

SEQ ID NO: 541662 - DNA, 1009 bp, Homo sapiens
tataaaattattagtataaaaggggaaataggtaggacataccgtggtaagggccatagattgtggggagagaatgggggtgggtttggtattatcccaaccttgctctatttaatttttcaagttgtgtccaccatctgtggggacagtaggtggtgcatatgaagggtggaagatcaaatatagcgcggtcaggttaacaagttaacaggtttacaggcaggggtgaagtggagtgcgcttcagtaaagtgggtgggagatatgaatgagagagctattatgtgtgttattatgtggtgacaattatctctctcgacataatatgcgcctccatatgtggacacccaacaaaacgccggatatagcgagaggctcaagagctctctcccctaagagagacagcaaagagaagagagtgtgaaacagtagagacaatattttaaaaggggttttgttctaactcctccagtgtatttacaactttgttgtttcccccagtggtcgcccaaaaacaataaatataattacagagggtctccggtgagaatgactctgagaaaagctatcatcaagagtgtcgtagcgagtactaccgctagaagcggaaatagtcgcgccgagcgtcaagcctaaggcctttatgcgcggataatcaatattcactaaacaacaactacagtgtttacacataataatcaaaccacaacgttgtggttatacagtatataaaacgagagtattgtagtatacacccgcggcattacaaacattgtcggtggtataatattataatagatctacaatctcctccataatgtgttgtgggggcataaaaatttggaacagcgcaaagactatgtggccttaaacaagcaatatttttagaggacgcagataatgacacgttgtgtaacaccacgaccgagatcaacacacttctccgcgccggagctacatcccagaaaaagagcccccgaagaaagaagtattctcccacctgtttgtat

SEQ ID NO: 541663 - DNA, 777 bp, Homo sapiens
agattggtctaggtcgaggctggttggaattggccgagggctgggtccgcccgcccgggcccacacaaatggcccggtagctgaccaagggggagcggcccacccgccctgggcccggccttacccacgccgctccgccgcctgcagccccggccgcggtcacccgaccgtccgcgcctcgccccgtggtccgccacgtgctgctgctattgctcctccgtgcccgcggctgtatgccggtcgcttcggcacccggccgccctcacctcccttaccccttcccggtgccgccgcaaaaccagtcccgctggcgccaaagcgatccctgctccgcgctgaacctgctgtgcccggcggcaccgcaagagagcgcggtgaccgcacttttacgcgcggcaccgttaggttccggtgacgcgctcgctcaggtggcattcagttcaccactttggcggccaggcgggagtaggtttcagcaagggcccgtagggcgcttttacccctgccataaagcgtcgtataaagttccaaaacaaacaggttcgaagaagcattcatcggaaactttacgaagagcgcgggctacaaaggcggggggttcacaagtaaagcccttagcgaaacacaccccaggagttttccggacaggtgctccccctttaggggagggctctttcttaggggaaagctgagcctaaggaaccaggggcttgaagaactaaaacaggcggcggaacttgccgggcaaagggcccttgaaaggacccgaactttgcc

SEQ ID NO: 541664 - DNA, 773 bp, Homo sapiens
  misc_feature (245)..(245): n is a, c, g, or t
  misc_feature (251)..(251): n is a, c, g, or t
  misc_feature (255)..(255): n is a, c, g, or t
  misc_feature (258)..(258): n is a, c, g, or t
  misc_feature (266)..(266): n is a, c, g, or t
  misc_feature (273)..(273): n is a, c, g, or t
  misc_feature (281)..(281): n is a, c, g, or t
  misc_feature (289)..(289): n is a, c, g, or t
  misc_feature (293)..(293): n is a, c, g, or t
  misc_feature (297)..(297): n is a, c, g, or t
  misc_feature (308)..(308): n is a, c, g, or t
  misc_feature (312)..(312): n is a, c, g, or t
  misc_feature (326)..(327): n is a, c, g, or t
  misc_feature (331)..(331): n is a, c, g, or t
  misc_feature (337)..(337): n is a, c, g, or t
  misc_feature (349)..(349): n is a, c, g, or t
  misc_feature (357)..(357): n is a, c, g, or t
  misc_feature (361)..(363): n is a, c, g, or t
  misc_feature (373)..(373): n is a, c, g, or t
  misc_feature (377)..(377): n is a, c, g, or t
  misc_feature (382)..(382): n is a, c, g, or t
  misc_feature (386)..(387): n is a, c, g, or t
  misc_feature (389)..(389): n is a, c, g, or t
  misc_feature (392)..(392): n is a, c, g, or t
  misc_feature (453)..(453): n is a, c, g, or t
  misc_feature (508)..(508): n is a, c, g, or t
  misc_feature (512)..(512): n is a, c, g, or t
  misc_feature (515)..(515): n is a, c, g, or t
cggagtcttattgtggcggtggttgtctcagaatcagcggactttttgggtcgtaggaacctggtatgagaaaacgaggtacaaatccgacgtagtcgttctttctacctaatcggggagcctccgagccttctacccgccggcaaaaagaaaaagaacgcgaaaacgctctccccccctccggtcaccagcggtcgctccgtaacaccctaacaggagcttaaccatcagccaaaatatcggtngggcgnggcngtntatgttcncaacttnagtatccngggaggtnaagngggnagactataagnctangagactgagattanntcgnttaatncggcgaaatttngctctcancaannncataaaaacnagtngggtncggnngngtncgttcgcaactttagtcatctaggaggtcgaggtaggagaactgtccgaatttgggaggtngaagccgtagcgagtcgagactgtgttatcgtatcttagttcgggcgatagagtnaganctngctctaaataaataaataaaaaactttatagtcaccggactacttatagacccccctcccataactccgcctcttccgcttacggattactaacagccgatccgttaggcccaacctccctaccgtccgagaagaaaggaactaaaggatcgcgcgcagcaagtcgatggcaaagccaagaccaaaccaagatagagagggaacatacactatcgttaggtttgacaggaaaaactcgtctccttccccaacaattat

SEQ ID NO: 541665 - DNA, 277 bp, Homo sapiens
tcagcattccagcaggcgtcagcatcagagatgttagttccagttgagcctgagctgctgggaaaggtagttgattcctcaccgaggtctgcggttagtgagtagtggcaggtaaccctatttgggtggaggctagggctgccgagaaaggctgtagattcttcagttgaggcccgaggtaggtgctgatcctacagtagacaccagtgtagtagtgagtatgaggctaggccggctgtggaagcgttgtaggctcttacaccacggaacatgaggt

SEQ ID NO: 541666 - DNA, 782 bp, Homo sapiens
  misc_feature (714)..(714): n is a, c, g, or t
  misc_feature (717)..(717): n is a, c, g, or t
  misc_feature (741)..(741): n is a, c, g, or t
  misc_feature (753)..(753): n is a, c, g, or t
cggagtcttattgtggcggtggttgtctcagaatcagcggactttttgggtcgtaggaacctggtatgaggccctttatatcgactccgaaccttcgattttaagcgacttctttgtactggttcatatcctaacgtccgtcccttcaataaaaccgacttcaaacccgcgtaaagatttcgtcgcttaaaaacccctaaacgaacatcgaaagtacaaagcgaaaaaccatcgcccacgataggccgagtactttagcccgaaaacccgacactcgaatcgccttaaagcttagaatcccccgaacgttaatacgatatctaaaaccctagacccgggacctctaatcgtaagcacaacatagcaccttaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 541667 - DNA, 945 bp, Homo sapiens
  misc_feature (877)..(877): n is a, c, g, or t
  misc_feature (880)..(880): n is a, c, g, or t
  misc_feature (904)..(904): n is a, c, g, or t
  misc_feature (916)..(916): n is a, c, g, or t
cggagtcttattgtggcggtggttgtctcagaatcagcggactttttgggtcgtaggaacctggtatgagtcccgaagtacccccgctcgcgtctttcgactcctaggctattattacgaagcctccagtagcttcggcatctccgggagcccttactccctcggctctcgtttagaacttgataatagtcgtcttagtcgatatgcacttagtcatcggcttcgtcgacgacgaagttttcgacgtcgaaattatcgtcgtcgtaattatcgtgattatcgtcgtcttcattatcgtaattattgtcgtcctcattatcgtctgcaaagataccttagccccatttaaacgggccggggactctttgaacggcagagcgcgctttcgagacggaactagtccgagctcctcgtaaccggctataatcacctacgtccttcgcgaccctacttaatcatccattccgttcatgacacttttcccactctcaactagcccacccctccctaaacaaaaaacaatcacgagtaataaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 541668 - DNA, 755 bp, Homo sapiens
  misc_feature (687)..(687): n is a, c, g, or t
  misc_feature (690)..(690): n is a, c, g, or t
  misc_feature (714)..(714): n is a, c, g, or t
  misc_feature (726)..(726): n is a, c, g, or t
cggagtcttattgtggcggtggttgtctcagaatcagcggactttttgggtcgtaggaacctggtatgagaccatagaccctccccccgacgatggcggccagggcaagaagtggtccccacaagtcccacccactctccccaaccattcttcctcttcgctctaacgtctatatccatatctatcccaaaaaacccccactccctacgggactcacactcaaacaatattatactacacgcaaaccaagaaataccttaaacacctcttgggataccgaaaggaaactaagtaaaatacctcgcaacgcgcaggtaatcccaaaagcgtccgaggtagaagtaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 541669 - DNA, 975 bp, Homo sapiens
gaagaatcacgcctgcgagatgtgcggcaaggccttccgcgacgtctaccacctgaaccgacataagctgtcgcattcggacgagaagccctaccagtgccctgtgtgccagcagcgcttcaagcgcaaggaccgcatgagttaccacgtgcgctcacatgacggcgctgtgcacaagccctacaactgctcccactgtggcaagagcttctcccggtgtgcaggggcctcgctgcccactaggccggtgggggggagggcaacaaggtggcctgtctttggctggtggggaggcggctcccgttcctggggacaggaaccactcccaggaggagggaagttgctaggaacagggggtggtactttagaagaggtgggtctctgggctgaaggaaagcagcctctgggcagaagaggaatcttggtttgagggctttcctgcctgaggactgaagctgagggggaaacgctgggacctttgcagaggcattttggaggaacctaggtagatttgaggcacaccttaccttggagcctaagccctaacacacaccccctcccactcaacatatccctaggccggatcacctcaacagtcacgtcagacaagtgcactcaacagagcgggccttcaaatgtgaggcctggtcatctcacgcccatttcctacagatcaaagaccccgagaatctgatccccttatttgttccctttctttatccccgaaggtttactcttctgtgaccccaacttcgccagaatggagcggtttgtagaggttctcgaggccacgtcgcacgagagaagtccgtctggctgcggagagtggtcggtttattcgacatgagggcgccagccccacggtggggctgcacagttggggtgcccgcggtagcgggggggatgtgcccctggtctggggggggggccccgcgggggggggggtccccgtcacgcggggggtcgctcgcttga

SEQ ID NO: 541670 - DNA, 281 bp, Homo sapiens
cgaagagagcgagagagagaaaacagagccacagatgacagaaacaaaacggactcacaaaaatatctaaactcgacgagatggagcgttcgccccgtggaatggaagtgcagacacctcagcaaactgaattgctgcccgtgcgctcacaggtgctattttcgccgaggatgcaaagactgctttgtaaacgactacagagctctacatgtggtctctgcaggaccccacaggaagcaggaatgtcttggcaaccgccacgcgaactatagaagccacac

SEQ ID NO: 541671 - DNA, 841 bp, Homo sapiens
  misc_feature (51)..(51): n is a, c, g, or t
  misc_feature (704)..(704): n is a, c, g, or t
  misc_feature (774)..(774): n is a, c, g, or t
  misc_feature (809)..(809): n is a, c, g, or t
  misc_feature (825)..(825): n is a, c, g, or t
ttaaatcggcacgaggctctttatgttgcccaggctgacctcaaactcctnggctcgaacagtcttcccacctcaccctcccaaagtgctgggattaacaggcataagccaccatgcctggtttaaaactgcatttcccaatgatgattatgttctctgagccccatctgagcgcacacatgtgtggtgctcttgggagtcgggggcacagcctcaaatataatacaatatttccaacatcgtgtccttggaatacagatgatttttattttcttctttatttttttctatgtttttctaagctttctctaatgagcatgcactactgtaataaacagaagacaaaaggattaaaacaattttttaataggagaaatttttaaatttctcatttacaaaagttctatgagaagataccttttaaattttaattattttaaacatacagaaagggataatttctaaactttgagaggatgggggatctacaaagacattgatttgactatatacatttgaaccaaaataaaaggaacatagacttaggaaaatatttgcaataaggatgacagtgtgagatctttgttacataaagctgacacaaaatgagaacaaaagcattaagagttggggcacggtggctcacgcctattaatctcaggcactctgagtcccttaaccgaggcagcctgcttcttgatggntaggagggcttgagggcaagggagggcttcacgttgagcttcaggaagttggggggctttcaggggagcntgtgggtttgttgcccgcttgcgcttcccgggccnccgggaccaaccaggnggaggagaccccttgg

SEQ ID NO: 541672 - DNA, 754 bp, Homo sapiens
cggagtcttattgtggcggtggttgtctcagaatcagcggactttttgggtcgtaggaacctggtatgagccttagaggaaataggagtttaaattcccggaagctagtcacttccccttattagcctaagacgcaccatttagaatcgtacctcggcaacggagtaatcataaccggctaagcgaccacgcaaactagcggcctccaatccccaaaggactacgaacttaacaaaatcgcatagactcttccttcagaaaaacatacaaatacaagtatctataactcctacggaaccctaaaggtcctgcggacctctcgaagtttactcgccatgactaccagagagctacagattcacatccccggcgcaggcgaaaccacccaccctagaaacccgccccgaatagctccacaaactacaaattacgggttaacccaaactcgaccctccaaaactcgtcgtcagaccggggctcaacccccccccaaccaaccgtcagaacgaacgagacttagaacaccagccgcgcgttacttaatccctagacgttaaccccgtatcgagtagaaacttccaccgtcatcatcgtaaaagatccccgccggcacttcgttacttacccgccgtctcttaacttccctatacgataattagagcgatactcaaaaacctaaacccccctacgctacctctcctcaaaaaactccctagaatccgaagattttaaatttcccgatacgggtacctta

SEQ ID NO: 541673 - DNA, 1033 bp, Homo sapiens
  misc_feature (965)..(965): n is a, c, g, or t
  misc_feature (968)..(968): n is a, c, g, or t
  misc_feature (992)..(992): n is a, c, g, or t
  misc_feature (1004)..(1004): n is a, c, g, or t
cggagtcttattgtggcggtggttgtctcagaatcagcggactttttgggtcgtaggaacctggtatgagagcagactctttgcccgacttagtaactttatcatcgggcactcatttagaagaaaacaagctaccacataaaaaagacatccgtatatatgcccacagtagtataacccgtaaccgtaaaaacacggaattaatttaaacgtttactaactaacgagcggacaaagaaaacgcgagacacacacacacacaccacacacacacacacgaacatcatcaagttacaaaaaaaagaaacaacggtacctgtagtaattcggacggaaccggagaccaccacctcaagcgaagcaatctaggaacggaaaattaaatagcgcacgcctctatctacgcgggagtcaagtcacgaggatgtaaaggtacaagaacgacataccggctcccggggatctaggggaaatagcggggagcgccgagggacaaaagatcacataccgggcatagcgcatatcgtccgggcgaagggcgcgttgaaactctagaaactattgtcgaacaatccaccgacgcaaataaatattattcgccttttaaaaattcacccagacaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 541674 - DNA, 896 bp, Homo sapiens
  misc_feature (759)..(759): n is a, c, g, or t
  misc_feature (829)..(829): n is a, c, g, or t
  misc_feature (864)..(864): n is a, c, g, or t
  misc_feature (880)..(880): n is a, c, g, or t
tgtatgtttttctagaaatggggtcatatatgctgccaggagttcgaagcttcagtgagctggagtgcagtggtacgatcacagctcactgtagcctcaaacttctgggatcaagtgatttttctgccttagcctcctgagtgctgggattaacaggcataagccaccatgcctggtttaaaactgcatttcccaatgatgattatgttctctgagccccatctgagcgcacacatgtgtggtgctcttgggagtcgggggcacagcctcaaatataatacaatatttccaacatcgtgtccttggaatacagatgatttttattttcttctttatttttttctatgtttttctaagctttctctaatgagcatgcactactgtaataaacagaagacaaaaggattaaaacaattttttaataggagaaatttttaaatttctcatttacaaaagttctatgagaagataccttttaaattttaattattttaaacatacagaaagggataatttctaaactttgagaggatgggggatctacaaagacattgatttgactatatacatttgaaccaaaataaaaggaacatagacttaggaaaatatttgcaataaggatgacagtgtgagatctttgttacataaagctgacacaaaatgagaacaaaagcattaagagttggggcacggtggctcacgcctattaatctcaggcactctgagtcccttaaccgaggcagcctgcttcttgatggntaggagggcttgagggcaagggagggcttcacgttgagcttcaggaagttggggggctttcaggggagcntgtgggtttgttgcccgcttgcgcttcccgggccnccgggaccaaccaggnggaggagaccccttgg

SEQ ID NO: 541675 - DNA, 748 bp, Homo sapiens
cggagtcttattgtggcggtggttgtctcagaatcagcggactttttgggtcgtaggaacctggtatgagtctgcgttgttaaaaatttgtccggcgaaggtttggctagtaatatagcggtacctagcatcgaactagtggatttaagagcgagcgagttagccctcgtaggaagagacgttactcggatcgaaagatttcccaacctagatctccatctagagcgcaagggtaaataacacgctaaaaggatacggcacaaaaaacccgcaggagcgtagtcgcgtaatctctctagacataagacccatccgagtgatctttctataggaaaaccccacaatacaggcgactagaggggttacggagaagactatcgttagcccgcggacctacccccagacggatgtatcgggtagtaatctatcctcgattagccattaactaaagaaggccaccctagagtagcctgttaggaattcgcttaacccggagaaacaggcggctatatttaaactaaccacgcctagcggcacgaacgcgggatcataaccttcggaaaacggcagacgtcgtataaagccattcctcgccctactaccgtaaataaaaactaccgaaaacatcacgttgtacctacccaaagtcaccccggccatcacgcacaaaagctcataactcaaccaacagtaacatccagagcccaccaccaggaaaagaccgtcgagagcacccactaggccccca

SEQ ID NO: 541676 - DNA, 744 bp, Homo sapiens
cggagtcttattgtggcggtggttgtctcagaatcagcggactttttgggtcgtaggaacctggtatgagataggcgttcgttattatgtttagtcaaccccccgcacccccagcagagatggggccctattgcgccggttaggacggctctgactcttcgattctgcgacttatttgttctggttctttaaagcgtcgggaccataggtgcgagttattgtgtttggttaacaacccccccagcccaagcctacccccgcttttgtcgacgaaagccagagtcgtccttcttaggtagtttcgggagcaggggtatagatccgcgttctgtcctttagtagtcgtttagcgttctcgcttatatttattctttcggcgcatccgtttttcatagtagtagtttagacttcttttcggaccaaaaccgtaatcggcgtttcaatttaaaatccgagaaaaaacctctcactatacttatctcctcggtacccgcagaactctcggtttcgggcgcgctccccttcgcagtcgccatagaccctccaagtagaccctccaagtagacggatacgcttagacctacgttcaaacacttagccgacaatcggaaaacgtcggcctatggcctcccagcaaagaccaacaagggacttttacgcgtcggggaacgcgtccctacccgagcggggacactaggaagaaaaggaggggtccgggcagcaaattccatcccgttaacccaa

SEQ ID NO: 541677 - DNA, 124 bp, Homo sapiens
cctttacacacgtagacagcttataaacacagaaatgcaggataacacctatcctgagattttgctgtctaatttatggatcatttgtgcttacaacttgaatgaaacttggctatttgatgac

SEQ ID NO: 541678 - DNA, 162 bp, Homo sapiens
ctgtgatagactctagagtatcccacgctccagcatgtgcaatcgtagaagctggtctgaacgagagacactcaggaccagagtggacttcaccaagcagagcagagacttgaaacgttgtgtgtgttttacctagatggagggggaagaaggggagaggga

SEQ ID NO: 541679 - DNA, 744 bp, Homo sapiens
cggagtcttattgtggcggtggttgtctcagaatcagcggactttttgggtcgtaggaacctggtatgaggagttccggacgtcgtcgtcgtcgcggtcgttaagaccaacgttacgtctacggtaaaagggaagtcgaaattaatctagaacgtcctcgagaagtcctaggtcttcggtaaaggttcaatcagtaacaaaagtaaggacgattcggcaatcagtcgaagcagaaaccaacgacgcgttctctatacgcaggaatccgtcgatctgaggatagatctaagatgagactagttgatccagcggggtcgtagcactaatctgagggaggcctacgataatcgaggaaaaagttaaagcgggattaggggactgcttaccacactcctacgcctagggttagatatgggaaccagcggatagagtcgcaaattggactaaagaaaccactattaacggagcggcaaaagtcgttataggaataagcttaatccccaacggcgtaatagcaatcgctcactattagttagtatttactgtctagccgctcttagtcgccagttagaagttctttccttagctagggacgtaccacgcctaagacaaaccacccgcgggctcagaatacgtcgcatttatccccaacgctaaggagaaggcggaaagccttaagtcgtcttcacccgtagtataccctgaacgaaataggcgttaaagctccttcgttgggttaaaagc

SEQ ID NO: 541680 - DNA, 1006 bp, Homo sapiens
  misc_feature (938)..(938): n is a, c, g, or t
  misc_feature (941)..(941): n is a, c, g, or t
  misc_feature (965)..(965): n is a, c, g, or t
  misc_feature (977)..(977): n is a, c, g, or t
cggagtcttattgtggcggtggttgtctcagaatcagcggactttttgggtcgtaggaacctggtatgagtctgcgttgcgtatgcgcaaaatacggggtagttccggaatacggcgccccccggagcccttccctctatagccccttactcttttatcctcccgactagctacgcgcttgcgattctgccttacgatactaggacagtcgcgcccgtatattacgtcttacgcctacctggagttaggaggggcctctagcggagttcggtccagggaatagggagtgacggaagaacgttaataccagtgccggctcctctccgctaggaacgaaggacgtccgtatatacgtatttttctatctctatatccgtatatacatatatatatatatatgaaacggccggcccgctaaaatctatcgcagcatacaaagtccgtatctcgtgcttcacactcagtagtacggggcatgcccggtagcctatcttaccagggggcaaacaacccacgattacctactcgcccccacgaacccccccactcagataacaaccgcaaacaaagaatctattactctcgcctacccaaaaaaaaaaaaaaaaaaaatctgagggggggtttggcatttaacctgtttcacagcgagctgcaccataacctatcggttgctgccccataatgctgcgatcgggaaaatttcggtgccatttaatccaactgttccgtagtatactttttccctgttagtcggtgcaacagtgaagaggtttgtattgactgtttcctttaatagccgtgtagttcgaacggtgaacggtaaaccgcaagtgccaacaccccgccaaaacctgtgccaaacccccgccaaactagtctaccccccaattaacaggttgaaactggtaaaactttccacaaactaaaagaaccgnttnagacagggccgagcgccgccttancccggaatagancttatcacccaaagattgcgggttcttaa

SEQ ID NO: 541681 - DNA, 290 bp, Homo sapiens
  misc_feature (41)..(41): n is a, c, g, or t
  misc_feature (47)..(48): n is a, c, g, or t
  misc_feature (58)..(58): n is a, c, g, or t
  misc_feature (77)..(77): n is a, c, g, or t
  misc_feature (159)..(159): n is a, c, g, or t
cttagcttaaaatgctaatgtgttgtatagctatataaaantatttnntttattcccntacattattctatagcttnttcctgcaaaaattttttttgttgttataaactaagacacacacattgtgcctacaccgggtcaggagcatcaatatcactnttttcttcctccacatcttgtcctactggaaggttttcaggggcagtaacatgaatggagctgtcatctcctataataactgcttttttctggaatacttataaattgtctagttattatgtacagtacat

SEQ ID NO: 541682 - DNA, 399 bp, Homo sapiens
  misc_feature (14)..(14): n is a, c, g, or t
ggaaaaccccgcanatgggattacaagagaaagcgcttgccacgtggactctgatttttacaagcctcctctccaggcaggctcctggctcccccgagctctcctgtccatcccaccagcctgctcagacacagccacacctgccccggctgggcctcccagactcactggcatcgaagacggccttgagcgcctggatgtccgtggccacgcccgatatcctgtagatgccaacctcctcgatacccctcttctccacctcctccacacactgccggacgatgtagggcaccttggagcgctcccgcctggggtggagcgcgaggatgggcggagggcagcccccacgacagctctcccgtagcaacccccacccagcacacacacaccctgtagagc

SEQ ID NO: 541683 - DNA, 127 bp, Homo sapiens
tgtctgctctatgatggatccccgaactatgttgatggcttcatatgatgggtcactctcctcaccctgctgccctgcagagccaccagtgtgtcacacgtggcatgatatgcatgccccagcatgt

SEQ ID NO: 541684 - DNA, 669 bp, Homo sapiens
  misc_feature (31)..(31): n is a, c, g, or t
  misc_feature (33)..(34): n is a, c, g, or t
  misc_feature (59)..(59): n is a, c, g, or t
gctccacagaacgtttatgacagagataggncnngaacagagcaatttagatgtatttngtggtctggtttcagaattactggttgtcactcatgcagtcttaatggaaccattttatgagaagtttttattttccctatgagattgcatcagatgactttactacatgaattcttaattattaggtctttttctagtgaatatctctttcaggtgttaacattttttaagttgtggaaacttgattcagtcgtgggtataatactgaatattttctcttttgataattttttcccttaattctctttgttgtctccattttattttttgattcatactgtaagccattcacatctttctcatgttatacctctgatttttgtcgtattaccttaaacaccagagatatttgccagtatcttggaatgtcagcaggtgcatttggtatggctgggtatccattaaatctagagtttgtatgctttgtttttgtgtatatgtcacaataatttagaactaaagcctaaactccagttatagcaaatgttgatatgaactcttgagagattaggtacttgtaacattttaatcaaaccattaagaattactagtttttagtaaatctctttgtcattgacaagattaagaatcacagtattaggagtttga

SEQ ID NO: 541685 - DNA, 215 bp, Homo sapiens
aaataatactacccatatatataactatgctacaccggacaaaaagaaccataaagatacataagtatgaactgagctatgatatcaattgacttccagggtttatcgtgtgagcacaccaatatattatacagtacgaatagacgtaaacacacgagcatataacaactccgctaccataatcatcgctatccccaccggcgtcagtatagata

SEQ ID NO: 541686 - DNA, 328 bp, Homo sapiens
  misc_feature (31)..(31): n is a, c, g, or t
  misc_feature (33)..(34): n is a, c, g, or t
  misc_feature (59)..(59): n is a, c, g, or t
gctccacagaacgtttatgacagagataggncnngaacagagcaatttagatgtatttngtggtctggtttcagaattactggttgtcactcatgcagtcttaatggaaccattttatgagaagtttttattttccctatgagattgctctgttcaagtcctatctctgtcataaacgttcctgtggagtctcatctccatgtctgggcttccctacctgaaaaatgaaagctttaactggaaagggcagacactagataatttctaaggtccctctcaactgttaaattccaggattttatgaactttcagctagaatttgtcgtcg

SEQ ID NO: 541687 - DNA, 851 bp, Homo sapiens
tgagcggagtcccacgccccaggccccaggcccagcagcatgcagcagcagcccctgctctcccgcgacccggagaggctctgcagccatgaaagccaaccgtcccgagggacccgccgtgtaagcagggagcctccgcggagctcccgccgtcgatcccccttggtgagtcctgtccgcagacgagaggcatggacgaaggccgaaacaacgagggggccgcagatcagacctcgaccagaaacgacgaggcgcaaaagaccccaagacagaaacaaaaaagccacagcgggaccagactagataaagacagcaacaagacaacccaacaaccatacagcaccacacaacgcagcaacgaaaaggaaaacaaacaagaagagacacaagcgcacacaaagagggcaaaccacgaaccaacgaaaagagaaaacacacaaatagcaacagacacgcaccaacggagaagacgacaaacaagaacacaaaaaaagagaacaagacaaagaaaaagaaaaaaaacagcacagaaacaaagaaagcaagaaaaaacaacacagaggacacaagacaaagacgacacaagagagcgagagaaaccgacaacaacacaacaacggcacagcgaaaagcacacacaaaggggacaagaagacagaagaacccagcagcaagcaacgacaacagacgaaacagaccccaaaacggagcaagaaaacgacaaagaaccaacacgagacgcaacaaagagaaaaggggacagacaaacagcccacaaacggcacaaaaagagaagcaacacacaacacgacaagaacaaacacggcaacccaaagaaaccacacgacgag

SEQ ID NO: 541688 - DNA, 330 bp, Homo sapiens
actgagctttgatgatatatggcgtgttcagaaagggataagcattattaaaagtatataaaaaattaaaatagggaagaaagggaaaagaacctgtttaaactacttcatagaactgtttttaaaaatttctggctggatgcggtgactcacacttataatcccaccactttggaagcttgaggcaggcagagtgcttgagcccaggagttcaagtccagcctggccaacatagtgaaatcccttctttacaaaattccaaaaggaaaaaaacccaaaaaatttagctgagtgtagtgacttgtgcctgcagtcccagccattcaggag

SEQ ID NO: 541689 - DNA, 1513 bp, Homo sapiens
tctggcagcatgacattttatatttaatttctctcagcgtggtagcttttttcattctcagaaacgtggagcaccattttttacacgtgaggtgggtatatctccattccttcgttccctttagcgtatagggcatagtgtgtgaacaagaggcgttttcaagcaacgtatattttatattgtgtattatacacacagtgtgtggcgtagtgaacatttacaaatttatattattattattatttctatagaggtggttataataaaagccactctacaaaaagtgtggtagctctataccagtggtattaagtgaacatccgtggagaaattaaaaaattcaccacttgtctataaacatataatatcttctgcgtggctgcgtggcaaaaaaattattttcatacatataccatgtggcattatgtgatctacaaaaaaacaactctttttacagtggatgtggggggataaatttcttataacagacattagtttaaagaagaaagagtgtccaaacaagtgtgggtactcgaggatacatctccccgcgtgggttataagaaaatacagtgtgcgagggtgcgcaccgatagggtgtgtctcacaattttccgtggcgaaactataactatagaggctttcaccacacaagtttcaaaatacccgtgcgatatattataaaaaacccccgagcggtttctgttggaaaacggggggcattgttgggcggaacacacctcatatataaagtcataagaatatttaaaaaaagtggatataaacggggggggggggcgaacaaatatgacgggatctatgttggacagaaagcacacctgtgtggtaatattcaaaaagaactcggaggaaataaaaaaaaattataaggcccaaggaggggatcactattaaaacatttttgtaccacaacaacgaaggcacctatacattgatagcttacaccaattacaacacgcgtgggggagaaccatattcgggcggcaccacccccccacagaagattgtggtggctcccaaaacacgctgccccaggagggagacaacctaccagggcgcagcacacgggagaaaaatataacaccaaaaggaagagagcctacaaaaacaaacaaaagaggaggacgagggagaacaaaacacaaacaacccggaggagaagagcaacaggagcaacacctagcagtccttcgacaacacacccaccacttttctcactggcggaggggcggggacgcggaacgaacaccgaccacagaaggcagaccaacaacaactacagcaacaacaagaaaagaagcgggaccacaaaaagagcgcaccacatacaaagaacacagagcgggtggactaacaaccgacgaagaagaccagcgaagtaaacacacacgaatgctaccagacaaagaacaaagaaacagaataagcaaaaaaaagacaatagaaaacaatagaaactcagagggacaagaagacccactacgacggccac

SEQ ID NO: 541690 - DNA, 1123 bp, Homo sapiens
  misc_feature (1123)..(1123): n is a, c, g, or t
gccatgcggaagccacgctgcggcaacccagatgtggccaactacaacttcttccctcgtcaatggcccaagtgggacaagaaccagatcacatacaggactcattggctacacacctgcatctggacccagagaacagtgcgatgatgcctttgtctcgatgctcttccaaggatctgtgagcgatgtgaccccactgcggtttttctctgaattccatgtatggacgaggcagacagtcatgatctaacgtttggcgcgcgtgggagcattggtccgatggatacctcctttgacggtaaggatcggactcctggcttcatgccttcgctcgccatggcacgtggtgttgggggagactcccattttgatgacgatgagctatggaccttggcgagaaggccaagtggtcctgtgtgaagtatgggaacgccgatggggagtactgcaagttccccttcttgttcgaatggcaaggagtacaacgagctgcactgataccgggcgcagcgatggcttcctctggtgctccatacactacaactttgagcaaggatggcaagtacggcttctgtccccatgaagacctgttacaccatgggcggcaacgctgaaggacagccctgcaagtttccattcccgcttccagggcacattctatgacagctgcaccactgacgggccgcaccggatggctaacgctggtgacggcaccattgaagactaacgacacgcgacacgaagtatggccttctgccctgaagaacgcctgtcacaggtaggagagcaaccagaacgtgcccctggtgtttccccttcccgttctcgcggccacatattcgagactgcccacgccggacacgagtagcaaattcgggtgtacacaaggcagatacacacagcgcacactggagccacgccctgtacccaggtactgcgtgacacgggaacccagatttgagcaaccggggtgtcatccagaacgggcgcggggacgtacaacagaagcctctccagatcggagcacagcaacggcctccacagtacgcaccagcgccgcgaataacaagtcgagaccatctcagcccagagacaaccgaatagtcgcgagtaaaccacgtan

SEQ ID NO: 541691 - DNA, 182 bp, Homo sapiens
ggcctgtcatgtgaaagacgactgtgcgactgtacgtggctgacggacctggggatggggagactttccagggttcgactgagggtctcttgtaaaccacaagggtctgtaggagagggagaaggatttgacaaacagacagcagaggtcagagtcacgagagatcttgaggatgttactcc

SEQ ID NO: 541692 - DNA, 734 bp, Homo sapiens
  misc_feature (176)..(176): n is a, c, g, or t
  misc_feature (215)..(216): n is a, c, g, or t
  misc_feature (351)..(351): n is a, c, g, or t
actagttcactatcggtgtctgattagtatttagccttaccgggtggtcccggcagattcagacagggtttcacgtgccccgccctactcaggatacatctatgagattttatgatttcgtatacaggaatatcaccttctatgttgaagctttccaacttcttctactatcatanaattttgtaactcaatgtaagatgtcctacaaccccttnntacaggtttgggctctttcgctttcgctcgccactactgacgaaatcattatttattttcttttcctgttgctactaagatgtttcaattcgcaacgtgtctcgctaatttgactatggattcatcaaaatgcanctgaggtttgctcagttaggttaccccattcggaaatctccgtatcatagtttatttccaactccacgaagcttatcgcaggtaatcgcgtccttcatcgactttcagacccaaggcatccaccaaatactcttacttaacccgcgtacttttttttttttttttttttttgcgactaagatgtttcaattcgcaacgtgtctcgctaatttgactatggattcatcaaaatgcaactgaggtttgctcagttaggttaccccattcggaaatctccgtatcatagtttatttccaactccacgaagcttatcgcaggtaatcgcgtccttcatcgactttcagacccaaggcatccaccaaatactcttacttaacccgcgt

SEQ ID NO: 541693 - DNA, 1526 bp, Homo sapiens
gcagcctaaagatgagcccggagccatgcggtgggaggccgctgtcgtcgcgcgccttgtgtttttctgttcctttttttattttgttttgaactcccgtggcctatacagcaggcacgccatcagcgccatataacgaccatttactgtaccatgcgcggagccccttttggagccacattagcgtggccctcggaggacctttaagactgtggacaaccttttgtgcctaatgtgtaccgccccacctgtggcattaatacgtgtgggtggccctcattcttccctgtcacgagggggtcgtataaagtctgtgacgccacgattggccgtgatgtgtctgcggggctcgcgctgccgtggcgcgtgttgctccccctatgtggggggtcacctttgagcgggacggaatgtggccccgtgttgctcgtgagttttggccccggtggtgggttggcgtcagatctcaccccgttggttaactcggcaggggcgtgagtcgcgtgtcctgtcttattccacgaagaaacccgttgtcttgtgggaaagaccaccaacgcgctttctattatctctctccagactctctgtggaacaaaccaagggattattgcgccaggggcgacaggagccaggcccggatataaatctcgcgtgggtgtgaaccaccagctttcacacaagtgtgtgtgccctgttgtggaaaacccatgtctcaacaggggcttggcacgtgtcgtgcggaggcaccgaccatttacaagtcacgtggtgtgggagtgtgcggcgtagaacttcgacccattttatcctctctccgcaccacgaagaatatatttcacccgccatccgcgcgtattctacaattctgcgtaaaacacgcgcctggagagtgaggccccattctgtggtgttgggagcgcccaagagagcttccttaagttgggggcggacgttgtttgcgcccctccgataacattttctccccgttggacacaaggtataggtcccatccatccgcgcggaaacagggcggaaacttctccaccaaggcttcaccgggagaaagcagtgccgttggtggggcacaaaccccctctccttatcgataatgatctccgtggggcatcttaaaccgtgttgagtggtccatatccaatgtgtaaattttcccccgtttgttgtgtgaccatagggactggcctgtatgccccgttggggaagagactcccctttgtgctagccgttatggaagttcgcgttgtgtgaaaagggcccaccgctcctacacaatatcaatggtgccccctaaggaaagggacacctgggcttgtgacattgtccccaaagggggcgcccgacgaagaatattgacccaaagtgaggcgccaagcgtaaagacacatgttgtcacgagaaggttgttgtggtggacccgcaagggggcttccagacaaccacctttgttgccccaccaaagaggaagggagagaggccaccctatagtggcgttgtgcccaaaaaaa

SEQ ID NO: 541694 - DNA, 929 bp, Homo sapiens
ggtggttgagatgattacctcggacgtctacggaaacgagcgggcgcatgtgtccgctgtgtgtgtgtgtgtgtgtgtgtgtgtgcgcgtacattgattactatccatttctttagtcaacgctctccagttcctagatttcgtgctattaaggaaaactgttgaagctttcgtgctattcatgtcatcagattcttaaacgacagcaccagagcaaagaactcagtactacagagttctaggaattctctcccctgaaatcaaaacgctggaagactttttatttcttattgtaagttgagaagtttcataaagctgcatcaaggattagattttccaggactctgcggaggaagcggcaggaagaacctcagagagggcagaggtgacttcaaaggtgactggggactccgtcctgagggtcacttggccctgagcccctgcgtgcccttgcggaagcccagaagcttcttcctgctgcagcctcccgtttccgctggtgctgacgtatatgcatttcatgatggggtccaacaagaacatctgacttgggtgaagttgtgcaatattggagggtgagtgtagggctgggcagctgggagacaggctcatgggtcaaaggctcatggctcaggcggttgcctgcctgggcgggatccccccctgcccaacccacaactagggttctggggttcggtcacgaacggtaaagggagaggtatacggcagggctcaaagtgaggggtccacggaaaggcaacatctgtatatgttctcacctggggaaacaggcaaagcccaattaccgggacatgggacaaccgttcgggacacaggcccgccccctcgccgggtaaaaagcgcccgagcaacagtggcgtagaaaggcacagactcccaacagggggagaagagggcccaagaagggg

SEQ ID NO: 541695 - DNA, 134 bp, Homo sapiens
gcggccgcctaactactactgctcgaattcaagcttctaacgatgtacggggacatggaacctctttctttgatcttctttttcttttctccccctcttttttgttctaaagaaaagtcattttgatgcaaaaa

SEQ ID NO: 541696 - DNA, 1562 bp, Homo sapiens
  misc_feature (183)..(183): n is a, c, g, or t
tggtggctgtccttggccctctgaaagcttgcagaaataaagccaatgggctatactcagctttgcaccacagctcaaccccctcaggggaaaataaggttaaaacacaaaaagagctccatccaagaggacaagggcacagcacacttcaaagagataaggggaacaccgtgccctcacagnattgagagaggacaccagcacaagaaacttcgtgacaattctcttaaaacccagaaggtggtgtttctttacctctccaaatgtgatctcatatagcttccccagcagagtgggtgtgttaactcaaatttaaagcagccttgaagtgtgacagaatattcgagaaactcgtggaagtggttaagaaaagagctctccagagtgaaatatcacggggggagaaagagtttggaacacctccaactccggaggggaacaacacgagttacaagtgtgctctcccagaggagttttgcaagagatagtgtaccacgagcccccattttcttagagaacagagaacacccaaagagctgtgagaaacctttttctatagcaaattgtgcacacacaaattttttcactataggcgggaaagatatctcccgatattaatatcaccaaagctttagagagaggcccattttcaaaattatcgccacagcgagatatttcacactccgtgagaagggagacagaagggaagttctccctacgaagagaaggcctctccaaaagagaaaccaccactctcccttttttgtggaaactcttccaaatgttgcccgcggcggcgacggacaaccaaacacatctttactacgcacacagacgggcacatttttttttcacaagaaccaaacgttgtgtaaaagaaactttcttacgaaaaaaaaaaatttagtgcggcggcacttatactgttgtcttacacgggggaggcaccccaaaaaaccgctatatattaaagtctaccatgttgtggggacatctttcccctgtggaaagaaagacagcaaacagaggaccgcgcgaaagattgtttacccgccaaaactgtctggtggaaacaacaccgcgttatatttgaaggagaaataatatatagggtcccacacgcggggaacaaatttttcccccccccgaggtgtccctccaaacctatacaaaaaagagcggggtggggcaccacttttgggggtgagaaccccccccacatggaggagacccaccgttgttggagagagaaaatcttcctccaaaagaggaaaaccgcacgggctttttaccattcttcaaaaccccccgaggaggttctcctctatataaaccgggggggttgttatacccccacgaggaaaaaattaatgctctcttcttgtccgccaaaaaagaatttattgttcgccccacaattatttttatagtaaagccgctgttcaccaaatgtgcacgaccaagtggagctcaaccatattatgcccctcaaggggtgggggtgggctacagaacaaatgtggtacccgtgacccacacggtcatcaataacccggcacaga

SEQ ID NO: 541697 - DNA, 965 bp, Homo sapiens
cgtggtggcgggcacctggagtcccagctactcgggaggctgagacaggagaatggcgtgaatccgggaggcggagcttgcagtgagcggagatcgagccactgcactctagcctgggcgacagagcgagactgcgtctccaaaaaaaaaaaaaaaaaggaaccggttgaggtttttccagatggggttcccaggaagaaagaagaggttctcctggagaattaggggaggcaggtacccaggttttaaaaggctccataagagggtcaacacaaatgtggaggctctggataaacgtggatgtagaattttctatacgtaggattaattaatcttccagtggagggaacgcaggttacaggtaaacagggattaaccgggtgggacagatacaggatgtgcgcaaatatttaaggggtggctttggatttacacacgcttggcgttcagcggttggatctcttgggttaattaggttcccaaaaaaagccaccctttgttccaacttcagcgacacttggtgggggggaccgaaggcgcaaacttttctcaacaaatttaaacaaacctttggggagtttagattttagacgatttcacacggatgggggtcggattttcaaatgtggtcctcgggcggaaaaaccaacacatatccaacgtggtggggtaaaagtccttctaaaagggggcaaagacggatttctaattaagtttaatgtggttgccaacaaatggggttttaaaacccttacgagggttacaactgttgcgaatggcgcgttggacactgtggttgtttaacccttgtgaagcttacattctccgtggaaaaagcgccacataattttgggggggggggaaaaaaacaatatcaaagggatttggtctataaagagattttgagaaacccagaatggaaacacaaaacggggaaaagaacaatatgggggaaaaggagggtc

SEQ ID NO: 541698 - DNA, 157 bp, Homo sapiens
agaggatgttggctgcgactgggtgcggacgggcgctcctccgcgggtataccagttcgcctacgccggcaagattacatcgccctgaacgaggacctgagctcctggaccgcggcggacaccgcggctcagatcacccagcgcaagtgggaggcgg

SEQ ID NO: 541699 - DNA, 184 bp, Homo sapiens
cgttagaaattctgtaataatgggtaggaatgttgctttagatggaggagaggggactacatatagagaggagggaggagaagtggctgcattggggagggactctaaaggttaggttaggaattggacacggagtgtcaaagtcttcatgggcaggtgaaggctgggggagtgtggtgatgga

SEQ ID NO: 541700 - DNA, 306 bp, Homo sapiens
  misc_feature (118)..(118): n is a, c, g, or t
  misc_feature (156)..(156): n is a, c, g, or t
tcattaattctgtttttcctgctttacaaaattcaaatatgtatgtcaagagaaaggaatgctctaccagctaagctcatgttattttaaaatgagaattattaatttattaaaatanctagaataagcatttatttttataccataaagcataanacacaaatttcttaaatgatatttccttcttcgttatgacctagccaaagttttagaaggtagctatttttaaaggccttcttaccacattggctccatccactttgttcaaggccaaagcaatctgaaataaaaataacagctcaccta

SEQ ID NO: 541701 - DNA, 325 bp, Homo sapiens
  misc_feature (175)..(175): n is a, c, g, or t
tgttgtggtgatctagaggatcccactttagcaggtctatgacttgggttaatctgtgtgacgtgtgtggtggacgaaattttgacaacctggggttagtatagcttagttaactttcgttattgctaaaggctaatcactgtgttcccgtgggggtgtggctaggctaagcgtnttgagctgcattgctgcgtgcttgatgcttgtcccttttgatcgtggtgatttagagggtgaactcactggaacggggatgcttgcatgtgtaatcttactaagagctaatagagaggctaggaccaaacctattgcctgcataaaagtg

SEQ ID NO: 541702 - DNA, 373 bp, Homo sapiens
cttattattgacatcacgaggttcgtgtggactattcaccctcagaagacagcgaccctcctgatcagcgatgagcgtgggcgtagagaacactgctgtagggctggcactgtggtcgcatcaggtactgttgtgggtgttgttctttacactggcagagaactccggagtgtcatgaatacctcagatccccgaagtaagatcggcctgtacgacttggaagtgaactgcctcaccaagatcctcttatggttgccctgggtggtggtctcgctggtcatggttgcccttcagcactttgcaggccgttggtacctgcagatcatccgcttcctcctcttgtataccaacatcatccccattagttttgcgc

SEQ ID NO: 541703 - DNA, 122 bp, Homo sapiens
gcggccgcctactactactaaattcgcggccgcgtcgacggttgttattagtagagtagagcagcctttcatcaggttgttattagtagaggagattagatgggaggggaggagagggccca

SEQ ID NO: 541704 - DNA, 130 bp, Homo sapiens
gctcttagtagattacacatgcagcatcccgttccagtgagttcacctctaagtcaccacgatcacaagggccaggcatcaggcacgcgcattgcagctcaaacgctaggctagccacactcacggaaca

SEQ ID NO: 541705 - DNA, 442 bp, Homo sapiens
tcccgggggttttggagggacccttttctcccccccctgggttttttttccttcccccccgggttttgcagggaatggggggcaccgcctttttttccccaaacccacagtgggagcccctttttcccactttttgggggccgttgcccccttaagttagggggccccccgggccctttccctcccctccggttttttaggggccaagcccccccccccctttttgggtggtgagatggggggttagggggggtgctccccacctcccttaaagggcccccccattttttgggcccttttccgggtgtgggaggtcttttggggcccttaggggttcttccttggaagtttttttggggggggtccccggggggctgggcccaaaagcccttagaaaacgggggttctttactggggttaattaaacggggtttccccctta

SEQ ID NO: 541706 - DNA, 291 bp, Homo sapiens
caattcactggagcaggaggaggggataaacgagattgagcactaggagcaacagtggcaggacacccaacagcccaaagttggaaggagcacaagtgtacactgatggatgaatggataaacagaatgtgatctaaacataccatgaaatattatccagcctttaaaaggggaggaagttctgatgcatgctacaacatgaatgaaccttgaggacattatacaagtgaaataagccaggcagagaaggataaatgctgtatgattctactcatatgaggtacctagagt

SEQ ID NO: 541707 - DNA, 694 bp, Homo sapiens
  misc_feature (49)..(49): n is a, c, g, or t
  misc_feature (90)..(91): n is a, c, g, or t
  misc_feature (142)..(142): n is a, c, g, or t
  misc_feature (168)..(168): n is a, c, g, or t
  misc_feature (185)..(185): n is a, c, g, or t
  misc_feature (191)..(191): n is a, c, g, or t
  misc_feature (193)..(193): n is a, c, g, or t
  misc_feature (203)..(203): n is a, c, g, or t
  misc_feature (205)..(205): n is a, c, g, or t
  misc_feature (226)..(226): n is a, c, g, or t
  misc_feature (229)..(229): n is a, c, g, or t
  misc_feature (233)..(233): n is a, c, g, or t
  misc_feature (265)..(265): n is a, c, g, or t
  misc_feature (293)..(293): n is a, c, g, or t
  misc_feature (326)..(326): n is a, c, g, or t
  misc_feature (329)..(329): n is a, c, g, or t
  misc_feature (342)..(342): n is a, c, g, or t
  misc_feature (344)..(344): n is a, c, g, or t
  misc_feature (365)..(365): n is a, c, g, or t
  misc_feature (503)..(503): n is a, c, g, or t
  misc_feature (685)..(685): n is a, c, g, or t
agaccacaagcccaatcaccacagcttcttgtagagaacatggagactnccaagatcaacatcaggtgccgcttccttcctgtggctttnnatcttccagtcagaatggtattttgccttgaagggccccaaaacaacagcnctggctatcatcttcatcccaaaagnggagaagatgggcaggnaagaananggagggtgtnanagagaggttcccatcaggttnatngggngcccgatgtacctcttggagaatgtcagcttnaatcagcttctgcagctccttggtcttntccagtagtaggttcagcttaggctccagagcngcntgctccttaagtncntcctgctgcttctgcaccatnagctctttttttaaagacagcagctgggactgcttcagattttgctggaggaattatagttactcgagtccacataccttggtgaggccaggatcataaacaggtgttgcagctgaagattggtaagcttgctaattngatcctccagcaatgacaaatggtaaccatcttctctttggtctggacctgcaggatggctggagccagctggaactggctcacagacaggacatctgcctcctcactcaactccactgctctctgggctaagaagatctcaagctccatgagctcatcaaggaactgattccgggtctcantgtattcaa

SEQ ID NO: 541708 - DNA, 614 bp, Homo sapiens
  misc_feature (398)..(398): n is a, c, g, or t
gggttctcagagaatactccatccagcatccaggatctccctccctctcatccctgaagggctagaaggtcaaagcacagaaaaagcctccttggtgctgacatgggagacaaggatccgttcttcaggcggcagggagaatggggatagaaacggactcgggacttgacatgtagtgctcagccacacgccctcaccaagacctgtgcattctctactctgatgacaaggaaaggccacggcaaggggggtgggatcgggggtgtgggggcggtggcacggcgggtgggagccacggcgtggcgcatgcggggtgacggtgtcaccgccacacacggctcgggggcaggcgtgatcagggagggggggagacagacaaggtgaaaacgtaacacggnccaaggattccccggcttctgtggtactttccaaaattctcggatcaaaaaggtataggggaagcacaccattaaaaaattacagtttaaggtatttacaaaagccatgatgatatattacacaagaatcaatacacagtatatgaacaaatcttcagggaaagcacttgtgagaaccggtctccacagggtacggagctcgaatcgtatgtagag

SEQ ID NO: 541709 - DNA, 202 bp, Homo sapiens
ggagtgataaaatgatgcggatatcctaggagaggtgcggtgtgtatagtagcggtaggatttctatacagagtagtggatgatacatagtatagtagtaatgttacttcatcatcgtttgtggcataaagtaatatcccatgaaagattgggccagtgacctctaacagcttcaggacttaactttcccacttggatcaat

SEQ ID NO: 541710 - DNA, 432 bp, Homo sapiens
caaattctaattaatcattcactttgtaggtctttggttcttacactcttttgttagcaaatacctctggctgatttacagtagaacccccagagatgacttaatgacattttggccgccaatataactggtttgtgagggctgaacatcagtggtggttttgtaatagtaatttatcactctgttttaaagacagctttcaaagataactgaattcatacaaaaattagaaaatgtataacctaaacagcataaattatataggtcattaacttcttaagtcttgttactcccatgtattttgttatcaaagttataaacaagaagacctttaagaaataaatatgaagtggatcagagcacttaaagaatgagccgagatagcaccatcgtactccagcctgggcaacaagagcgaaactacgtctcaaa

SEQ ID NO: 541711 - DNA, 1218 bp, Homo sapiens
taagctggccccaagggggtatcctaactcttttattaaggggcccggcgccggaagagctcaaatattaaaaacacaaaagagccccactcgagttaataacaatataaaaaaccccaaagagtggaaaacgtgagggggcgaggggaagagaaccccggggccgaggggcacgaggagccgctggtgttcttgtgggccacgggcgcgtggccgagggggttccccgcgggtattgtgggtggtgtgcaaccagagggttgtggggggcaggcgatgtgggtccgtgtgggggaggcccccggggttctctcgctgtggggtgggggggacacctcttcaagttctctctctcgggggggggtggtgcctcgaagatttctgtggtgtgcccccgggatattgtgtgtgtccaagcgagggcccaaaacatgtggagaggcccctttgtggggggggttttgtgggttcacccggggtttcaacacacagagagaggaggctctccctttgtgaacccctgtgtggggagccccgggggggccatttgtggggtccactctctctcccgagttgtgtcccagagggagagcgctcactctcccgagggtgtcgaaatttctccccgagattcgcgggggggagatatctctcactctttatatcgcgtgggggacgaaaacttcgctttacagagcgcgcgcccgtggtagagagcggtggctctcccaggggggaggagttccacaaatctctcattcgataaggggggggggaggggggggcgcatctcccgaggataaaccccccccgtgggagggaggggcacaaaattactgtgagacgaggggggggagaacactattaccaccctgtgtgggagggacggcccaaccagctggggggggcccccctaaaattgagggcacgcggcacccccgggcaccagggggggggcgccccactctaacactgtgagcgggaaccccacagggggagggaggagagcccatctgagaaaaaagttttaaaaagcaccgcggaggtgtagaccccgggggggggcccggcacaaatgtatgtccgtggggacccccggggtgtgggaccaccgggggcccgcggcaaaaagtgagcagtgagagcccccgagtgtaagcgggggagaataatctcacacagggggcggagtatagccaagcacgaggagccacaaat

SEQ ID NO: 541712 - DNA, 194 bp, Homo sapiens
cattaatccaacttttgtatgaagcattctactcagcacagcggcacagttcatcacggcagagcttgtccagcttttccatcctccttttccggatgggtagaacccggggtacaagctttcctaccagggttgtaaataaggcgtaagaaccttgaactagctcccaggcttggataaagctcctacattaa

SEQ ID NO: 541713 - DNA, 509 bp, Homo sapiens
gttcctcgaagaggtttaggaggcagaatcccagagcagccctataaccccaggtccagtggcctggaatcctgagactcgcgtatccttggccagtggataacacaggacgtgtgtgcgcatgtgcaagtgtggatgtatgtgtgtgcgtgtgtattgctcataacttaagaggaacttgggagtcggggttggaggtgctgggcaatggaacttcaaattcaatgtcgcccagcagtgaggggagtcgagaggtgaggcctgtaggccaaccaattgatggagtctcagcgatagcccaggtgagaagtggttcacccagaggagcagggtgggggcctcaggcagatctgtccctcttggcccctctgtcctcaaatgtccaaaatgtaggaggacctctgtacatatcccacgcctgggctcgtgccagcagtggagttactgtagagggatgtcccaagcttgtataccaatcagtgttaagctgtttgacactctcctgtgta

SEQ ID NO: 541714 - DNA, 642 bp, Homo sapiens
ctgcttaaatatttttggagcgcaaaatgtttgtgaataaaagcaataaacgatatgtggcccctctttgttaaaaggggaccccagatagaggtggtctcccccccgcttgttgcggttcttcgtgcaaaaacattaacactcttggcccctcgagtcagtatggggtaccattagctggccccgcttagatggaacaccatttcggggcaatttttgcgacaacacacatgtgtgcacttgttcagccactatctcgtgtgttaacagtgccaccgaaactgtttgcatccccggatggcacggccaccacggggtaggagcattttttcctccgactgtctattctccacacgctctttgttgtccccacaacaagagatctcggtctcacagactctgacgattgctccaccgagcaagttgtagtccatcaccgacgggagtgcccctcttggtggaacatatcaaactgtggatgtagattgttgtaatagggttcccaagaggcagtaactctttgcagcacttgtcttcccgagggagcaatagtttctcctcagccgctcgccaaaaacatattagggccttttgtcccgcggatatacccacccgcatatacgtcccctgcataacacaaaa

SEQ ID NO: 541715 - DNA, 154 bp, Homo sapiens
aactgaaaagacatccgaaaaggcgatcgtgggtctaaatagtgatgtgattgcaggagtaatggggaagttccatgtctgtgacctccagaataatggcaggtaatcatttatgtctacaccttagcagaaatcaggctcctccacaacctct

SEQ ID NO: 541716 - DNA, 315 bp, Homo sapiens
acgcatgcctgctgagtagctgggattacaggcatgtgccaccaggtcgggattgttataaccctggcagtagagacggggttggccatgttggccaggctggtcttgaactcctgacctcaagtgatccacctgcctcggcctcctaaaatgctagtattataggcgtgggccaccgcacatgggctcctcctccttaaagtctcaacttgtgccactttctccatgaagcctcccttgccacccgcagtcactccagcttccatggcctcttgtacacccctctatcatgttggactgaaactgtctatttac

SEQ ID NO: 541717 - DNA, 489 bp, Homo sapiens
cactagtagatagggaggctggtgggggtgtagtaaaggcctgtctcttattctaggaggctagttagatgagtacaattcgtgaacagtcaccaagctgtaggtaggacaatttgtgcacttatctagtatcacgctttaataaaccatgtttaaaatcatataggggcatcttggtttcacatcccctgaggtgccagtgacatatccagtacctcgaagtccccatcccatgctaagtgaaacgtgctattctcaacacacagctgcaatctctacatttaaagatactgagactgatatagcgggttctctggctcctggacacgatacagtctactacacagaaactaggcaccactttatcactaatatgataacagctatcttcccctaaatgtcctacacctactcatgtaccttatagtgacttataccatacaacgtataagtatagtatcgtaatgccagttacagttgtagcatcat

SEQ ID NO: 541718 - DNA, 282 bp, Homo sapiens
ttccaagacctcttatctcttggatagcaatattggtgtatgctcaagtccctgatataaaatggtttagtatttgaatataactcatgcacatctttctgtatatacttcacatcatctctagattacttatgatgcctaatacagtgtaaatgctatataaatcattattatgctatattgtttggggaataatgacaagtaaaaaaagtttgtacatatttcagcacataggcaattttttctgaatattttccatccaaggttgttgggttgactttg

SEQ ID NO: 541719 - DNA, 742 bp, Homo sapiens
tcagacatatatttttggagacagactctcactcttgttgcccaggctggagtgcagtggtgtgatctcagttcacagcaacctctgcctcccaggttcaagtgattctcctgcctcagcctcccgagtggctgggactataggcgtgtgccgccacacccggctaatttttgtatttttagtggagacggagttttaccatgttggccaggatggtctcgatctcttaacctcatgatccgcccgccttgtcctcccaaagtgctgggattacaggcgtgggccactacacccaacctcaaattgtttttcaaagagaaaacacttacgtgtctcagcatatacctagtgtgactggacaacaagatctaaaagaatcaagggatccatagacttaagagtcaggacatccttacctgattccttgagctgataaacttaacttctctgtatgttttcctgatgggcacaaataagagcaattcttattaggcccttactacctaggtattgtacactctttgcgattaggattttgccttttatttctctattcagattgttaatgggaacaactgcactctagcctgggtgacagtcagactgtgtctcaaaaataaaattaaataaataaataaatgctcttttctcagagggggagaattgcttgccccagaggtggggattgcggtgagccaggattgcccactgacctcagcctgggtgcagagccgacttcgtc

SEQ ID NO: 541720 - DNA, 633 bp, Homo sapiens
  misc_feature (3)..(3): n is a, c, g, or t
  misc_feature (79)..(79): n is a, c, g, or t
  misc_feature (116)..(116): n is a, c, g, or t
  misc_feature (144)..(144): n is a, c, g, or t
  misc_feature (152)..(152): n is a, c, g, or t
  misc_feature (184)..(184): n is a, c, g, or t
  misc_feature (215)..(215): n is a, c, g, or t
  misc_feature (304)..(304): n is a, c, g, or t
  misc_feature (344)..(344): n is a, c, g, or t
  misc_feature (350)..(350): n is a, c, g, or t
  misc_feature (395)..(395): n is a, c, g, or t
  misc_feature (447)..(447): n is a, c, g, or t
  misc_feature (460)..(460): n is a, c, g, or t
  misc_feature (509)..(509): n is a, c, g, or t
  misc_feature (622)..(622): n is a, c, g, or t
gtncccgtttgttccttcggggctgggcctgaggaggtggcgtttttcctcccgctcgctttcattgccccgaggagantcttcctttcctgtctatttggttttagaacaggggntgggactgactttctctattgctacttntggcgtgncctcggggtggcgtgggccccttggccttcgnaatacttaatttttggggtattcttgtgagncgggttggtatccatcgtgccgctgttgcaggtgcttcttctgtgtttgtcaggaggttcactgttgtttctccagtgttttactgggnttcacaggggtgttacaggtggaccccagtgatgaaaatnactgtncccaccagcattttaaatcctcctaaattagagaaccaccctccnagaaggtttgctgggtcccatccctcccaggtttggactggtacacgggctncttttctgatgtntgaagcgatttccagaacctcttctccattattgcctatgttaagacancaattggagatgttaaacttaccacagcccgcaccctcttctgctaataagtagtctagggccagcctgttttgataaattgccgcgcgcatttggttttgttgttgcgcganattttctaggg

SEQ ID NO: 541721 - DNA, 296 bp, Homo sapiens
  misc_feature (28)..(28): n is a, c, g, or t
  misc_feature (61)..(61): n is a, c, g, or t
  misc_feature (74)..(74): n is a, c, g, or t
  misc_feature (289)..(289): n is a, c, g, or t
  misc_feature (296)..(296): n is a, c, g, or t
ggtcttgctctgtcccccaagctggagngcagtgatgggtcatagctcactgcagccttgngctcctgggctcnggtgaccctcccgcctctgcctcccgagtagctgggacctgtacaggtgcatgccactatgcctggctaatttaaaaaatttaaaaatttgccaagaatggtggcatgggaggcaaatggaggctgaggcgtgggatcacttgacctggaagccaaggctgcagtgtgccctgattgtgccattgtcctccagcctgggtgacagagtgaatacngtttctn

SEQ ID NO: 541722 - DNA, 539 bp, Homo sapiens
gtctatgtctcgatcgttactcccccattacatcacttctccttgcctcagtgattaagtccaaactccttaacagccccggctcggccctgccttgcaagggcagcctcactgcttgcccctctccattacatctgctatggagtccaactgagcctcatctgccccttgaacgcacactctttctcctctgggagtctctgaagtgggtaatatcctctgcttataatatgcttccccttaaacctctactctcttcctagctagctttgactcctctgtcacttgtccgctttggcatcacctcctcatagaagacttctatgactcccgagattctcaggagcattggcaggtgaagtgctcctcccatgaatggatggagattaaggagtgtgtgtaattcatgcttaattcaccagtgcttagctgagtaccgggcatacaatagtcactgtggcggccaaagtaataacccccaccgccgtcaccaatctctacaaagaaagcgtgcatacccatcaacgaagttcagatat

SEQ ID NO: 541723 - DNA, 1073 bp, Homo sapiens
agcggttgcaggtgagccaagatcacgctactgcacttcagcctgtgtgacagagcgagactccggctcaaaaaaaaaaaaaaaaaaaagacagggcggattatttcctggcgggcttaatagattggagaatgaaaggagtagagacggtacagactattttacctcagagacaatggaaaggccataatttatccagagagtcatacgtgcattactggaccaggcatatgaggcttacctcttagaagcatttggtcatcttggaattaacaatacgtcttcgtggtatttaccttaagtgaagtggacaacttttcagaagggtttcagggggtgaagataaactggaataaggagataactttacacaagcagaaaaagcctcatctctatcgggatcccgtttaagtgccaggggctcatcaccagggtgttagaactcagtcaccttttacccagggcgtgggaccaaccacctttctcaatctacggggtggtgttcacctttagacaatcttctgacatctcacgtgttcagcccaacaacaattttctccttccaagcctcgtgcaagtctcaatgaagtggacaggaattatatacttgctgtataaaccatacctgtggttaaccttaggccaaagccagggatcctcataagggaaagatgtacttggaaagttacttccccaacacattgggaggcttttccgtgttggcccccctggaatacactgggtagtaaccactggggcaaaaatgtgcccagcccaaatcccaggacctgggtgggtacaacctttcatctgatctaagaaagcggggcgttagcaacagaaaaaaggcaaaagcagtaaggctcacatccgaggatttaaaccgcgcaagggggttgacagattgtaaccttacttaaagtattttgataaagcgctacactctagggatgagacattgcacgtttggcgtgaggtagcacgctttttaggatatggactaaagccccttgattaaatgagacatcaatatcattcgaaaagagtttagccaaattgattctttcccccta

SEQ ID NO: 541724 - DNA, 382 bp, Homo sapiens
gcacagctacgaacataagtatccaaccaagtcaggggccacaatcttgacacagatattgcatccaacagcaaatcatcatgcaaagggcaaataagcacatgcacagcatgctgcaaactcattaatcattaggaaaataaaaagtcaaacacctaacctcaccagtatcatgcccactaaagtgactaaaattaacagatcagctataccaagtgctgtcaaggatatggagcaatcagtaccctcagacattgtcgttgcaaatataaaatggtacaaccatttaggagtatcatttgacagttttttttttttctttattggagatggagtctcgctctgtcaccaggctgaagtgccgtggtgcactctcggctca

SEQ ID NO: 541725 - DNA, 153 bp, Homo sapiens
agcaagtacggatgtggatgagatgatcaggaggctgacatcgatgagatgcaggtcattataaagttgtcagatatgactgaaagtgaaggcccccgggcagctggcgatgccgttctcttgatctctctcttctcgcgcgcgcactctctc

SEQ ID NO: 541726 - DNA, 205 bp, Homo sapiens
tgggcggaacatgaggtcaagagatcgagaccatcctggccaaaatggtgtaaccccgtctgtaataaaaatacaaaattagcaggagtggtgatgcatgcctgtaatcccagctactccagaggctgaggtgggaggattacaccactgtgctccaccctgggtgacggagagtactattgaaaaggagaacgcgtcaaaatcg

SEQ ID NO: 541727 - DNA, 1630 bp, Homo sapiens
  misc_feature (1089)..(1089): n is a, c, g, or t
  misc_feature (1463)..(1463): n is a, c, g, or t
gtagaaaccgatgagcaccttagatattcgtcttcgtggacttcccagaccgtggtacctatcgaaccatgaattctggtcggattccatttgctctccaagcatgaacggatcgaaacaagatgttgtttcaggtgtgcttcatttgttgcacatctggtaacagtatagcagtcagtagagttcatcgagctgatttcggtcaccttcctctgccgttgttcacttgggagttctgatgctctgtagctggactatagtcacgtgtagagaagctcagcggcctgagttgcgagaagcgagattctccgacgggtgtgatcctcgcgaaaatcatctgtctagcttatctcattaacgtacatttcgacgccggctagtggtgatgtgaagcgttcgtacactgtagggactgcacgtctctgtcagccaaggcaatgctggcaatagacggtacgatacgacggagatcactccggtctgaacattgaccgtgtggtgatagctatcaataaaccgtttccaaggaatgatcgtctagctttgacaccagtggtcccgttttaatcactatctaggttcccaatatccataagcgtggttcacgcatagtgataccagataccaattgtaccttatacaaactcgcacggtacatagagacagaattacctgcgaggccaagctcgtccacctgaggctcagctgtgggatgctccggggtggaccccgaatggtaaaggggcggcgaacgcgtgggttcctagtgggttgcacggccagacggaccccgggtcggaaaggggcaactccagggtacacaagtgccagcctgggaggccagccataaggtaggcggaccggaggcaaaattgccggctctaggaccccgggacaacgcggggcctaactacgtcatagggaggccaatgcgagtccctagggggcagcagtacacataccatatcgagaacccggggggtgccatggtcggagacggctgtcaacctcatgccggcctaaggggggggagagccgtgtcccgggggggacaaccccagcgaagtccccggggcctaacaccggaanggaccggggcctctggctgaacctcgctccaattatggcgccgcgccaaaagtggggccaataacagggagaggggggggcccacggttctcgggtgttagctccgcggggggacaagcgcacgggggcgccctctctccacaacattggtggcacatgggtgtcccccctgggggggggcgcaaagccaagaggcggcgcaaccacgatggagggtagcctggccaggacaacagaccgggggagaacgcggtgagactgcagccccgggagataatcggacagcacagtgccaccggccggcgggactcacaaacgccagaagaagaacacaccgcgagctggacagagtgaccccgatgcgtcgcagagangatgaattcctctccacgacacagggagagcgatagcagcgccagtagcagaaacaacaccaaagccgcgggtgccaccccaccacaaacgagacgatcagacaccgtgcgtcggtgaaggaaccaacggagccagcagccgcaatcaagacagatcataacgatcc

SEQ ID NO: 541728 - DNA, 260 bp, Homo sapiens
agaactggcgattcatttatctgcaatctaatgcatcccgtagaggaactggttaagcaagctgagaacgcagtgtaggttcagaaactgtatgaacatgatcttccttgtgtgattgtcacaatgttgattagcactataatactgccaggtgctggtttagactaacttgtacatcaagcttgcaataatagaacacttatttccctagtctcatgaaatgttatttaatatgtcaagtgtcatagggcatcagcggg

SEQ ID NO: 541729 - DNA, 482 bp, Homo sapiens
  misc_feature (482)..(482): n is a, c, g, or t
agctcaggtttgcctccactctagaaactcatcagagtgatgcccttctcaaatgggggaggtcccaaagcggatatcctggcagtgtgaaaggccggctaaaggtttgtgccaagaggatctgtggaatgcatctcctacagctggtgctgctgagtaaccactctgatctggcatcttctttgatcaagttacagagcagagtttccagggctggggattgaagtcctgcctcctccctttgtctctggttgtcctcggtaatgtttttccctcaaggtactcatgatacttcccatggggtgagtcagggacaggtctctttccagggaatccaggatggtagggaggttggttgtctaccttgatctcactttttccattgtagaaactgtgagttggggaaagttttccacacacttggtgctggacagattgtggcaaggggccccacagatataaaaatctgattcttttaaccn

SEQ ID NO: 541730 - DNA, 878 bp, Homo sapiens
  misc_feature (54)..(54): n is a, c, g, or t
  misc_feature (61)..(61): n is a, c, g, or t
  misc_feature (87)..(87): n is a, c, g, or t
  misc_feature (101)..(101): n is a, c, g, or t
  misc_feature (144)..(144): n is a, c, g, or t
  misc_feature (162)..(162): n is a, c, g, or t
  misc_feature (167)..(167): n is a, c, g, or t
  misc_feature (175)..(175): n is a, c, g, or t
  misc_feature (225)..(225): n is a, c, g, or t
  misc_feature (229)..(229): n is a, c, g, or t
  misc_feature (261)..(261): n is a, c, g, or t
  misc_feature (266)..(266): n is a, c, g, or t
  misc_feature (289)..(290): n is a, c, g, or t
  misc_feature (302)..(302): n is a, c, g, or t
  misc_feature (313)..(313): n is a, c, g, or t
  misc_feature (339)..(339): n is a, c, g, or t
  misc_feature (348)..(349): n is a, c, g, or t
  misc_feature (351)..(351): n is a, c, g, or t
  misc_feature (397)..(397): n is a, c, g, or t
  misc_feature (406)..(406): n is a, c, g, or t
  misc_feature (441)..(441): n is a, c, g, or t
  misc_feature (462)..(462): n is a, c, g, or t
  misc_feature (488)..(488): n is a, c, g, or t
  misc_feature (493)..(493): n is a, c, g, or t
  misc_feature (656)..(656): n is a, c, g, or t
  misc_feature (691)..(691): n is a, c, g, or t
  misc_feature (717)..(718): n is a, c, g, or t
  misc_feature (720)..(720): n is a, c, g, or t
  misc_feature (723)..(723): n is a, c, g, or t
  misc_feature (735)..(735): n is a, c, g, or t
  misc_feature (737)..(737): n is a, c, g, or t
  misc_feature (752)..(752): n is a, c, g, or t
  misc_feature (754)..(755): n is a, c, g, or t
  misc_feature (769)..(769): n is a, c, g, or t
  misc_feature (784)..(784): n is a, c, g, or t
  misc_feature (790)..(790): n is a, c, g, or t
  misc_feature (806)..(806): n is a, c, g, or t
  misc_feature (836)..(836): n is a, c, g, or t
gcgggggtggtcgtggggggatccggtggggcatggagggggggggggtggggngagggangtgtggtggaggtgcgcttccttctnaggggacagaaatnaacccgtgttctgcttattgttagcacaacatcaccagaaaangataacgacagcgaagcngaganagaaagtnaagtagtactttcacactcccaaacttagggggggctataaccttaaggngggnggatttgctacacaaaagcactatccacagcnagggntgatgtagccacaagaataaatnnggggagaggggngcctagaattnatgttccttacgcctcatagcgacgnaccctgggnngntggttggtctagcatctacgcagaatatgttcaccttgttgggggngatgggggnggcgcaagatagctccttagcgggctgaagagggngctagatgggctgtggggagnttgctgttcatgctgcagttggaagnggggngctctttagttcagtgcgctgcagggtgggaaagcaacaacacggacaccgtcccaccctcaacccccccactggcacagggtcacacaatctgggtcaaagaaatagtggggcccttgtggtcatcaaagcgatccatggtcttgaggctgaggatcatgtncaggccataggtgaagatgaagagcatgaacaggnaggtgagcagcaaaaaaaaaaaaaanngnganaagaagctggcncngtcgctggcgtgggngnnctgctcccccattncgttgaaagcctggntctggnagttctgaagcatcanctgccagggagagggctgcgtgcgggccangaggagactacccttcttgctcaggctgctgaaatactcgct

SEQ ID NO: 541731 - DNA, 124 bp, Homo sapiens
cacgaggttatcccggaggaatgtcatcccagggggtgaaggtgccgggcttctggtcgtatggggacgtctcctcctcgtcgtggaggtatttgttgtacctcccccggccgttttccccgta

SEQ ID NO: 541732 - DNA, 580 bp, Homo sapiens
  misc_feature (7)..(7): n is a, c, g, or t
  misc_feature (27)..(27): n is a, c, g, or t
  misc_feature (50)..(50): n is a, c, g, or t
  misc_feature (63)..(63): n is a, c, g, or t
  misc_feature (71)..(71): n is a, c, g, or t
  misc_feature (77)..(77): n is a, c, g, or t
  misc_feature (90)..(90): n is a, c, g, or t
  misc_feature (136)..(136): n is a, c, g, or t
  misc_feature (141)..(141): n is a, c, g, or t
  misc_feature (152)..(152): n is a, c, g, or t
  misc_feature (166)..(167): n is a, c, g, or t
  misc_feature (173)..(173): n is a, c, g, or t
  misc_feature (177)..(177): n is a, c, g, or t
  misc_feature (184)..(184): n is a, c, g, or t
  misc_feature (190)..(190): n is a, c, g, or t
  misc_feature (205)..(205): n is a, c, g, or t
  misc_feature (225)..(225): n is a, c, g, or t
  misc_feature (236)..(236): n is a, c, g, or t
  misc_feature (255)..(255): n is a, c, g, or t
  misc_feature (257)..(257): n is a, c, g, or t
  misc_feature (260)..(260): n is a, c, g, or t
  misc_feature (268)..(268): n is a, c, g, or t
  misc_feature (285)..(285): n is a, c, g, or t
  misc_feature (318)..(318): n is a, c, g, or t
  misc_feature (327)..(327): n is a, c, g, or t
  misc_feature (329)..(329): n is a, c, g, or t
  misc_feature (367)..(367): n is a, c, g, or t
  misc_feature (376)..(376): n is a, c, g, or t
  misc_feature (380)..(380): n is a, c, g, or t
  misc_feature (388)..(388): n is a, c, g, or t
  misc_feature (395)..(395): n is a, c, g, or t
  misc_feature (397)..(398): n is a, c, g, or t
  misc_feature (400)..(400): n is a, c, g, or t
  misc_feature (411)..(411): n is a, c, g, or t
  misc_feature (415)..(415): n is a, c, g, or t
  misc_feature (419)..(419): n is a, c, g, or t
  misc_feature (433)..(433): n is a, c, g, or t
  misc_feature (454)..(454): n is a, c, g, or t
  misc_feature (473)..(473): n is a, c, g, or t
  misc_feature (475)..(475): n is a, c, g, or t
  misc_feature (487)..(487): n is a, c, g, or t
  misc_feature (558)..(558): n is a, c, g, or t
tgggggnaactgcccactttattaggnaaaagggggcccaaaggtctccncagggcccacccncaaagtanaaaaancaaaaaggaaaanaaaaggaacctgcaacccagtcctctgtccctgggattctgggccnggganaggggggaaanaggaaggggggggnnggcctnaaanaggcctnaaaaanaaaaggtcactggcnagggatgcaaaggagcgcanagcggggactnggggaggatgacctgtccnanagnggcccatntaacgcagcctcctgtntgggagggggcctcggctcggcatccagggggnaaaggggantntaaaaaaccaactgcaggttcaccttgtggcccaccancccccgganattnttgaagcnaaaattnannancgttgggcgcnccangganaggccccaggaaanaaccgaaaagttctcgggaanccccaagggcagcagcttntntggacggaaaanccccgagtttccgacctccacccacttcttcaggccttggtggtagctgaacacctccatgctgggctctntttttgggttgtaggctggctt

SEQ ID NO: 541733 - DNA, 360 bp, Homo sapiens
  misc_feature (196)..(196): n is a, c, g, or t
  misc_feature (283)..(283): n is a, c, g, or t
aggaccagccggcagttaacatggcacgacagggcagcaaggagacagaagggagaccgaaaagaggcttctatactataaaagctattgtgtaagctagatatattaagtagttggctcaggagttcgatagttcttgggcagtgagagtgagtagtagaatgtatagtgagcctagggtgttgtgagtgtaaantagtgcgatgagtaggggaagggagcctactaggggtgtagaaatagggaagtatgtgccctggcgtccagggcgtactgaactggnttgccatcattcgggatgaagaaatagcccaagggtggggaataaagtgtggattcccgaaggaagatataaacgat

SEQ ID NO: 541734 - DNA, 165 bp, Homo sapiens
atacaaggttggcaggtaggtggtaacacctgtaatccagccctatggcaggcgggcggatcgcttgacgccaggagtatgagaccacgctgcgcaacatagtgagacccatctctacaaaaaaatattaaaaattagccaggcatggtagtgcatgcggtagtc

SEQ ID NO: 541735 - DNA, 352 bp, Homo sapiens
ctttcctcctcatcatcagatccaaagaggtcaatgtcatcatcatcttcctatcgtgtagctccacttcctgaagtgtcttccacatgccttttggtaacacttaatgtgattataccactgtagggcttcacccaagtcgccagccgttggtctgcacgcggcttcaaatactgccacatgcgctgtgtaatggcacatacccctcaatgtagctcttgtcccacaggtaatcgttgagcacttggagccgcacaggcgcttctcagtgtctccgaaacacatggtgtcgcgtgtatccgagatctggagaacagcagagagagagcgcgcatagtgtgcgcgccctcgt

SEQ ID NO: 541736 - DNA, 534 bp, Homo sapiens
tactctggcccagaggcccagtccaaccggttggggggatgccaacaatttttccccacccccaaaggaccgcccctcaaagtggcgctcggcagtgccccaaattagcctggggtggccggccccaaaggggtgttgccaacatgttcctgacctcccaaaaagtttcagcccacgggcccggcccggcctggcccttcaagggatggcccctgtgaaggaccctttccaagcctgcccgttgccaatttgctgtgaaaggggggcctccctgccttggggccttagccctggctttgcacttttcctccggggaaaaaggaccctgcccctcccccgacctggggccacactgttgccttttcccaggacggaggcttttggaccctcggaccccatccccctcaaccaagtgtctttttgtgtttggggggaggaggggatgatatccgtgtggttccatgtattatttttaagctccgtgagtgggtgggtcagtgtttgcattaagtggaataaactgcccccccccca

SEQ ID NO: 541737 - DNA, 305 bp, Homo sapiens
aggattgagagcaagagcacgggacagaggcggggtgtgtccagcacccgcagagcttgtgctcgggcagtgggtgtggtgaggctgtgttgaggcagggccacacaggctgctccaaccatgggggtagggtcaagcgagaggcgggcaggggagaggctggtgccaactgactcgagcccagaagacccaaagcaggcctgtggcccaaccagagtaaagattgttcagttgatccagactagctagtggaaccccaagaatttctttcatacagaaggctgtagcttttcctttgtggggtc

SEQ ID NO: 541738 - DNA, 511 bp, Homo sapiens
tcagcctcccgcgtagctgggactacaggtgtctgccacgtgcccggtagatttgtatttatgttctggtgtatgtcttattactctgatatagtggtctcagtcagtggctagtgtcttctgactggaaataaggtatgatcaatacagataatgctttcatgccatgttcttctttcatattttctctgaaactctgattacatgtgtgttagatctgcctgcctattacatttttcgatgtgtcttatccatattttgtatttcttacttttgtgctaacattctggatttcttctgacctgtttagttcctactaattctcttttcatccatgtctaaaccgtttgttaatcccacccatatgattttttgttattgtctggagatagggtctctatcaccccaggctggattgcagtggcacgaattacgagttcacagcgaaccttcaactcttgggcttaagcactcttcccgacctcaaccgtcctgagtagttgggactatg

SEQ ID NO: 541739 - DNA, 173 bp, Homo sapiens
gatccgcctgtgaaacgagacgacctctaatatttatctaagttaatatgtattcagatgaaacctgtatattaggtgttcatgtggtcacttttgtatttaaagatcaaattatttgactatttgctcaggaaccatttcttcatacttctgattggtaaccactgcagggt

SEQ ID NO: 541740 - DNA, 1845 bp, Homo sapiens
  misc_feature (573)..(573): n is a, c, g, or t
  misc_feature (599)..(599): n is a, c, g, or t
  misc_feature (1143)..(1143): n is a, c, g, or t
  misc_feature (1146)..(1146): n is a, c, g, or t
  misc_feature (1161)..(1161): n is a, c, g, or t
  misc_feature (1645)..(1645): n is a, c, g, or t
  misc_feature (1669)..(1669): n is a, c, g, or t
  misc_feature (1688)..(1688): n is a, c, g, or t
  misc_feature (1709)..(1709): n is a, c, g, or t
  misc_feature (1798)..(1798): n is a, c, g, or t
ggactcgcgggcttggctggtctcggctcgattagcacgctcgcgacgtccgcttcgtccatgtctgtgggttagtcaccaaccggctatcggacttagacgagtccgagtagtgctagtgctggtgcattggagctcgtcgagcaaagcggtctgatgacaagctatggacagatggctcatggtggcgtagagctgaggaatgatatgaacgatacccaaagagcatggattgtccagcaagatgaccaatgggatccggcatgaaaggttttgaagggtaggcttgagacgcaccctttatttccggatcctaatccagtaatgctccggtgtaatttattccaggtagtattgtcgacctatatgtgcctgggaaagagatttattgaagcatccatgaggagagagagcatatgggaaggcctaaagcgtttgtggacaatagaaggtgtcccccggttctagtatccgctagtcctggcttgacctaaggactatcttaatgagcttgggaagataaggaagggaagaagaaagatgaacaagaggcatgcgcaaggctctgagcancttgcgtcagaagatccgaaaatacnacgtgatttcgagtcccatatcacaagctacaagcagaaccccgagcagtctgcggatgaagatgctgagaaaaatgaggaggattcagaaggctcttcagatgaggatgaggatgaggacggagtcagtgctgcaactttcttgaagaagaaatcagaagctccttctggggagagtcgcaagttcctcaaaaagatggatgatgaagatgaggactcagaagattccgaagatgatgaagactgggacacaggttccacatcttccgattccgactcagaggaggaagaagggaaacaaaccgcgctggcctcaagatttcttaaaaaggcacccaccacagatgaggacaagaaggcagccgagaagaaacgggaggacaaagctaagaagaagcacgacaggaaatccaagcgcctggcatgaggaggaggcaggacaatgaaggcggggagtgggaaacgggtccggggcggagctgccgtcggttaaggagaagccaagaaatgtttgccaagggaactgagatcacccatgcatgtngtnatcaagaaactgaantgagatcctacaggcacgaggcaagaagggaactgatcgtgctgcccagattgagctgctgcaactgctggttcagattgcagcggaaaacaacctgggagagggcgtcattgtcaagatcaagttcaatatcatcgcctctctctatgactacaaccccaacctggcaacctacatgaagccagagatgtgggggaagtgcctggactgcatcaatgagctgatggatatcctgtttgcaaatcccaacatttttgttggagagaatattctggaagagagtgagaacctgcacaacgctgaccagccactgcgtgtccgtggctgcatcctaactctggtggaacgaatggatgaagaatttaccaaaataatgcaaaatactgaccctcactcccaagagtacgtggagcacttgaaggatgaggcccaggtgtgtgccatcatcgagcgtgtgcagcgctacctggaggagaagggcacntaccgaggaggtctgccgatctanctgctgcgcatctggacanctactacaagttttgattacnagggccatcagcgacaggtgacccgctgagggcctcctcaaagtctgagcaaggacaggcagaaaatgagggcgaggactcggtgtgtngatggagagactgtgcaagtacattagccaaggacgcacagacggat

SEQ ID NO: 541741 - DNA, 192 bp, Homo sapiens
gctgtggttaaaggcaaaggctgcagcctgattggcgtgcccaaactgggctgggcactgtcaggaacagccaggctgactccagagcctgccttctggttggattctcccggattaagtctggccctgcaggaaaaacgacaggagttatcatgccaaccaagaatgagacaatcagagactggcaggtat

SEQ ID NO: 541742 - DNA, 283 bp, Homo sapiens
  misc_feature (10)..(10): n is a, c, g, or t
ccgacagagntgtgcatgtgtaaacacaaaattatcatgggtttatgtcctttaggctcacttgcaaatatcgggaatgaggtttatccaaaaaagaatgacaaggaccagcagattaagcctctgcccctgccagagggctcaaagggcaggaaaaggcagtgagagaaggagagacagaaaccaagatgacagtgcagaggaggcatggggatgagatcacacacggagccctcacagggaatgagttggggtcatttgatgttcatattagaagctgcag

SEQ ID NO: 541743 - DNA, 95 bp, Homo sapiens
aggcgagaggagacgagacagcggggcacgacgcgagaaggcatacgccacaaaaaaacacgacgggagggtggagggggggggggaggggcggg

SEQ ID NO: 541744 - DNA, 106 bp, Homo sapiens
  misc_feature (16)..(16): n is a, c, g, or t
ctacatcttatttganagctacccatcacagagctgatcaaacagattattaaaagacaatcaaaccatctacaataagtcagcctcaaggttgacagcagcaagg

SEQ ID NO: 541745 - DNA, 343 bp, Homo sapiens
gctgcaggcgcggccgactggtgtttatacgtcactcgccgaggttccttgtgtcatggggccagcctgactgagaagaggacgctcccgcgagacgaatgaggaaccacctcctcctactgtgcaaggacaggggcctggtccgcaaagggaagaaaagcaaaagacgtggctaaattcgcgatccgcccagccactggcgccgactgcagtgacatactgcggctgatcaaggagctggctaaatatgaatacatggaagaacaaggaatcttaactgatgcagaagtgccggagcactggactccggggacacagcttggtgggttttttttgggggccg

SEQ ID NO: 541746 - DNA, 585 bp, Homo sapiens
ggctgcatggtttcgatagataactagtatggggataaggcggtgtagtgtgtgcctctgtgtgtaagaacgtgggctagcggcattgtttaactctttagcagcgtaaagccttataactcacgtgcgcccgtctcattaagtgggactggccagtggcctagcgtttaatagaatacgttggcgtggtatgggtgtaaattgacgtgagcgcaggcagtccgaaggaacggttcacgtatgtgggcaaatcaaaaaattgattcaaggcatacataatgtatcacagaggatcgagggttcgggtccattatagagtgtagagtagtaattggtctaatcagattttggtatctgggcagggttctacagttctggcatataggtcaattggtatggggatggcgatgcattcaggtccgcgctgggtcggcatgcacgcattattttgcgcacggctgcggcgattcaagtcagaagcgcgtgtgacaactacgacatgcatccacgttactctgccgcgcggcagacagcacccttggagggccttgggcagcggcctgggggccccggggccgggcgatc

SEQ ID NO: 541747 - DNA, 159 bp, Homo sapiens
gagaatgttttacgatgcattgttatcattaaccagtctttttagcctactaaacttaaatggcaattgaaatacagagctctgaatgcgaaacaacttgacctgaaattgtcgacagagattgatacccattaaaatagttaagaatgacgaacatag

SEQ ID NO: 541748 - DNA, 238 bp, Homo sapiens
  misc_feature (65)..(65): n is a, c, g, or t
  misc_feature (136)..(136): n is a, c, g, or t
  misc_feature (161)..(161): n is a, c, g, or t
  misc_feature (219)..(219): n is a, c, g, or t
tctggtcactgggaaattgccggtgtcccggttctgtttgagtggggatatttctccgatcacgnaaacagcttcccgcaagagctgctggataaactggtcacgcgctaatctgccgggttacctcggtaactgncactcttccggtacgtcattctggnatcaactgggcggagagcacatgaaaaccggcaagccgattttctatacctccgctgntccgtgttccagattgcct

SEQ ID NO: 541749 - DNA, 564 bp, Homo sapiens
gagttaattggaggcagagaccatgtactccagttgcctctacagcacatgacacatgccagacacctcatcagtgttctagaacacttgctaattagctgtgacagcattgcatgtttcttactccgttttgtaacccaagagatttactgggattttctgtttcaatatgcatgccttgactctttactaatagaatttctaagagagacctatagctatagataataggaaaacattatgttcactaatgtagttttttcccccatttactgagtcaacagaaagtcttaaaatgctaaaaacataagtgacaactactaacatcaggtcacaaagcacttccataattattatctcatttgatactccagtaaccctgtgaatgttatcaccttcattatcatcatcatcaccactttgatcattaccacaaccatctcaattttacatgggatgaagaaacttgaggctcagaaaaatgaaaagacctatttgaggtcagtgtatgagtcaggacttttggttgtattttgaaagtagcccaatttgaactggcttaag

SEQ ID NO: 541750 - DNA, 106 bp, Homo sapiens
ggttttcaacctagtcacagagcagcacctacctcctcctcctttccacacctgcaacatctttttccttgggctgaatatttagtgtaattacatctcagctttg

SEQ ID NO: 541751 - DNA, 206 bp, Homo sapiens
atctcactccctcctccagtgccctgtgtcagtgcacagtgacccgcagcctccagctcccggccctctgcctcggcccgctcatgttcctcccactgcccgcaagtcaagctgccttctcctctgcccagcaagctggtcaacacttgcgctgcttcttctcctagggtgcacacaagctgccgctgctgctccaggtccatggt

SEQ ID NO: 541752 - DNA, 215 bp, Homo sapiens
cacagcgattatgagtggtttaataataccagtgtactcaactgatccacagtccaaagtggcaggtccctaagaaatttaccacgcacttcagttaaatccaaataccttattatttttgtgtccatcccaacagtcttctgtggggagggaccgaaggctaggggtaaaccgagtctccgtaatggcccggggttcctgtttgagcttttgga

SEQ ID NO: 541753 - DNA, 409 bp, Homo sapiens
cggaatatcattcagccttaaagaaagaaagaaatccttctaattttgacacatgaatgatcctgaaggacattatgctaagtgaaataagccagacacagaaggacaaatactacatttatatcacttatataaggaatctaaaatagtcaaactcatagcaacagagaatagaatagtggttgccagtggttggaggaagttggaaaaggggaaatattagtcaaagggtacaaagtttcagttgtgcaaaataaataggtcctagggatttgtatggcatagtgcccatagctaatactgtattgtatacttaaaaatctgccaagagtgtagatcttatgttaagtgctcttactgcaaaagtagaaagaaagaaagaaaggaacaaagaaagaaagaaagaaag

SEQ ID NO: 541754 - DNA, 251 bp, Homo sapiens
gtaaaatgtgcccgggagcggctccctgagagcgtccgtgaactggccccactcgccctcggtcacgatcctgagctcctggtagtagtgctcgaacagcttgttctccttgacgatctcggggtagcgtcgttcccagaccgcttaaccgcgctttccaccacctgaggcgccatcctcggcgtcatccgtccgatggtgttgctggagccgccgtccccgcgaccaccgcaccatagcgcatgcggccg

SEQ ID NO: 541755 - DNA, 169 bp, Homo sapiens
gggtgccccccccccccccgttttttccttttccccattccccccttttgggggccccccgggggggggggggtttttttttcccccccctgggggcctttggggggggccccttttttttgggggggtttttttcttttttgttttttcccccccggggggttttcca

SEQ ID NO: 541756 - DNA, 691 bp, Homo sapiens
agcggacaaataagtgaaattatagagatgctaatttggagttaatagaagtatgtttttagtaattagagctgtctgaccataaaatggactgcacaagataatgaactttcctaaatgaacatatataaaaatattaataatattatttacctgagtcttggcaaagaataattttcaaaaatgataaaattatgactgtcattcaggtagaaaatgaatatattttaaagattctgcttagctcatcatttactgagggaatcaggcaaatatatcataattgagagaactcagaaagcagatatagttctagatcagggatattaaaatgaattttcagataggtacaaaactggcttttgtccctctaccaccagatataatttatttgcatgtctgtagacaaaattttgcaatgctatcatttttctgtaagttacagagttataatatagactactcaaaaaaagtgcatatccttatagaatgaatttctgaagtctctagcattttcgtgaaagaatatccagtagtctcttttgcttgttttaaagtgttaaaattttccttatagtctcctcttcttagtaaaaataacctcaaaaataggttattcttgatcactagtttttatatttggcctgattatttacatgggcataacaagaatgtcaatttaccatatagg

SEQ ID NO: 541757 - DNA, 1020 bp, Homo sapiens
cactgcccggatggtctgcttctcggcgcctcggtgcgtcccacctttgagaccggtacgaacgtcggcctgttccgtggctgcgactgctttggctgagtcatggggccttctccttttcctgccctcgggtacttgccccagtgtgcaccatagaacccttgtgccatggtgcaaaacgttggccacagagtaatctctgcactaagtagcgctatgagggagattgacgccccttccactatgaacagagtgattggtccggaacatccttgtcacaggatcaagtgtgatgaccaacttgtatactttaagctggaggtagccccactgaaccaagctccgccctatgtacccatacaatcgtatggacaggaaatcgcaggaaacttgcctaacctgcatttgagattgctgagatcagatagagagcgtgcatgttacacaagggcatttcccatgtgacaaagcttcgcacgtggtcggttgagcaaatgtggctcctgtacataaatgtcttgcatcagtctattccatctacactcgttaacatagggtaagcgccttaggggtgcgatcctcgagcaaggtcatttctctccaagaatgaacactagtaaataggtgtagccaaccgcatttgatgtacatggagcgaagccatgtgaacctgaggccttccaaatcatccctgtataaaagctatgatgacttgaccaaatagaggtctcaatcgaatgacgctcgaatctggtcttaacaatctcggttatcttcaaacactaagtctgaatggaaaatgcaggtgaacggaaccaagatgtgtcagacgcgtcgtcttctgtgacgtcttaaagcttcggtgttcctcggaagtttggtgctaacatgccgagaagaaggctgactcgcagtggatcgtcgccaaaaccgaacacctgtggcctgctgttttcacactagcctgcgccaaactttagaaaagaaatttagaaccgtaacacttcacaatagttcctg

SEQ ID NO: 541758 - DNA, 779 bp, Homo sapiens
  misc_feature (696)..(696): n is a, c, g, or t
gcactttcctcgatgccaagaagagcctgaacctgcaacatcttcctgaagcaattgaagtgctccaagcgaggaggtcgctgctatgatccgggctggagataccaccgaaggtttgatgtggaggttcgtcaaacaactcgcttaagctccgttcccgagaagcgacgagattgaaaacctgcgggcattcacagaggagcgagccaagctggccagtggccggaccgacttactgacgcgtcctcctgtctggctcagtatccctgtctacctagctgcgtaatcgaagtgcgaatgctgcctgtgtgatgggcgcggatcgccgtgctgggacagtggtgcaggccacagaggctccagcatggtagctaggcgtgccgtgccgaaagctctgctcaccgagccgccgagctggccctattttctggccaggcgtgatccatgagaacttgggatacttcctcaatctacggcaggccatgaccggatgacgccgacggcttcaagagtcagcgacattgctgagagcatcacgggagaccaagtcccagcagaatcgcgtgacgctgctgcaccaggtgctgggaggaagcggaaaagagccatcccgagctcctgcagctgccccgggaactggaacagacctcgcaagcagcagggatcaagctggagatcatccggtcagaggccagntccaagctgaagaagcgtctggagaccgagcggaaggtgtctggctccgtgggccgaggtccaggagcagtacaacggagcgg

SEQ ID NO: 541759 - DNA, 364 bp, Homo sapiens
attctaaatacaaaatgaaacattattgtcattaatttgcaatatctatgattgaatcctctaaatgaattgtgcaggagaggcgattagtataacacatgactactgacgttcacattgagtcatctttaaaaatctgtactctgctatttggatgcttctcgtgacgcgagttggattttgtactgaattactagtcgttccattcctttttttgaggtgttcttagtggggctataacatcgccatcctattaggacgagagtacgaaaaacaggccatagagaaatagccagtttccatcatcttatttctgagtgaacgtctctagttcgcacatcctcatcttgcatatagatcgctt

SEQ ID NO: 541760 - DNA, 856 bp, Homo sapiens
gaactggcgcgagacagcagcgcttggggaagacctgagagccccttcgtaaattcgcgggccccgtgtgcgcccgccgcgaagggtcccgggaggcccaacacccccccgtcccgtcggcgaagaaaccgggccccctctcagcggggtagggacacggccaagcgcgggtccgagacccaaggcaaggagcccgtcgtgcgaatacgcccagagaacacgtgctgcggagagataattcgccgcagacgtccccccgtgggaccaccctctgggtccaccggcccacaatttctgcgagccccctatgcaacaagaacgccgcgcgcccccgcggggaagccgcaaggcatcacgtgccctggaagaatctcacctggcaaagattccacagagcctgcgcgataccaccccagctgggagggctcccccgccgactcggaccaaggcatcgggcgagagcagcccccccccgcagctaccaccctctggggcaccaccaacgagttaccgggccccgcatctgggctatttgggcgtactataagaagcccaagggccgtcgcctctcccgacaacacagaagccggccagcagcgtcacagatggctagaagaccctggcggcaagagatgtccccgggcagacaagtgagaccccaaggaccgggggtggacaaaaatggtaacgctcgggaggggcgcgcaggcacgcacacagggggccgaagcccctcctatcacggcgcagacgatgagagccggacgaagtcccgcccagctcacgtcaggagagcgcccgaacacgcccccaggggacatgggggccccacaaaagaaaggacccgcaacaaaac

SEQ ID NO: 541761 - DNA, 222 bp, Homo sapiens
  misc_feature (63)..(63): n is a, c, g, or t
aactaatcacttacatcgccttatgtcttatcattattctaacattatattctaggctggaangatcgggacgtcggccccggcttctactccttgagcgtctcctgtctctacttcgagatcttcttcgctctcggcttctgtctctctctctacttttggaacgtctgaaagggggacacttttcatttattctatgaccaaatggagctactatttcag

SEQ ID NO: 541762 - DNA, 134 bp, Homo sapiens
  misc_feature (2)..(2): n is a, c, g, or t
tntctggggtagatatatttatttcaggtacatacattaagtggcactaattacacagtagctataaggtgaaaacgatgaccacaatatctggatttgtggcgacatactgagaaccgtagaaaaagcagatt

SEQ ID NO: 541763 - DNA, 362 bp, Homo sapiens
tcatccgcaacctggacgcggtacgcatgcgcgccccgacacctgccgccgagtgtaccgcgcgtcatcgccgagtgtgcgcagccggccgaggagcggcccaccttcgagttcctgcagtcggtgctgaggactttacacgccaccgagcgcagtacgagtcagctagccgccggcgctgcgcccgtgcccactctgcgcggacgaccccgacttccgtgccatcccagacgggcgcgaaggcggggtgtcgcctgtgcccttttctcagacccggaatccagtgggcagaggcacgttcgcagggggtccccggacggactccttcaccgactgcacccccgggcgagttacgcggccgc

SEQ ID NO: 541764 - DNA, 1674 bp, Homo sapiens
  misc_feature (243)..(243): n is a, c, g, or t
  misc_feature (372)..(372): n is a, c, g, or t
  misc_feature (651)..(651): n is a, c, g, or t
ggttcttatcagcggctctgtttggtgcgtccgctcctgtcttcgctggtgggtgacgacagcatctcaccgccctcggtgtgtgtttgcgcctcccctgcaatggtaactcctccgtggcgcgcgtagttcctctctctcgtgcgtggtttagttctgtctctttggcctcggcgggctgcgctgagtattatctctcgttttttcgtgctcacaccgcgtgtatacgcctgcttgtgtgcncccatcttagcgtgccgctccttttctgtgcgggccgccccccatattgttggaggacactgttgttgtgccgcccagtatatagtcgcgtggcgttgtggtttctcttccttccctggttttttcccnctcggcagtttttttctcttcgtgctgactcatacactttgttgtcttttcggttgctcgcttgcgttctgttaatgttgtgggtgcacctttttttatttctcgggggtaacaatcatacatggtgttgcaatcatcattatgcttgtctcggccgtcatattataccgccgcgggggggggggtgcacatcatagatgtgtgattgtcccctccctcgtccgcctcccctcactggattatttccttcgcgttgatcgtcattttaattatgatctntttttgggtgggtggcgcccccaccatcgctgtcttgctgccacatcaacaaccccagccagagatgttgttggtggcgccccccccccccctctgcttttctgttgccaccagccaccacagacgtctctccgcttgtttttgcccgcggcggagggtgttgttacaccacaacagcgagagtatttttcgcctctttctccccctccgcattgtgtgtggtgactacttctgctcgggggagatttttgtcttctctctcgcgggggggggttcatcacacacatttgttgttgttgtatactcgtcgtgttgtttgtacacacatcgaggagaggtctctctctgcagagttttgtgtgtctctctcacacagagacacctctctttattttctcagagagcctgtgtggtgtgtgtgtctccccacagaggccccccctctgtgtgtgaagagaattttgtctctctctctgtgtgtctctcttctgtcgctaccccgcaccccccgcttcccgacacaccgcgtggggctcagagaggtctccccactactatgtcgcgcgctgtcccccctcgggcgcgccacacacagagagaggagagccacacaccctggacgctcctctgtgaggagaagaagagagagagagtttaaccacccacaaacgcatcatgcttataaaaaatattttcacgcaggagaaaatatatgtattgttaaagaggagaaaagagaattgccccacttttcgcccacgcttgttcccctcggagagagacacacactcttccccccgcgggccaagctttttgtgcggggcacatatacgtctcttaagcccgggcgacacatgtgcgccgagccaagagaggggtatattgggtatagagggcggcaaaagagttggaggtttttatttttatgggaaccacaagcgcgcccccaaagcgcgcaaataaactcccttgttttttttcttcccacggaaaaaagagggtttttttttttttttcccccca

SEQ ID NO: 541765 - DNA, 705 bp, Homo sapiens
gaaggaagcgaggcgcgacactgctggggagaggagggcagtgaggagcgaggagcgggcagaggcagctccggcggccgagaggagggagcgcggcgcagagaggaggggcttgcgccccgtagaaatgtcaatcagagcccggagccccgggaatctccgccaatctgttcggacctgacctggctcctcgccgccgccctcgccgccgccgtcgccgccgcggagcaggatcaattaggcgaacgcggacgcacagacgcagatgcgggcggatgcgcggcccaatgcgccgggccatgccccccgatgacgcgccggagcccgccgggcgaggctgtagctggtgcgtgccggggggtctgggcccccttctccgttccgtgccctcgtggtgcaccagtgttcgttcccccagtctgggataccaactacatgctgccgcttttagccgtgcagagacgcccgggggccgctggccggcgagcggcggcatgccgtcgggtgggccctggggcgagcgtgggtgccggagcctcggagctgaacgcctcgggggtccctgtccaacgtgctctccgtccgtgtacggggcgacctacagccggggcgtgcggcggcggcgacaaggtacgggcccttctgccctacgccgggagtgggctatcttccgcagtggggcgcagatgagctgaaggcacgccg

SEQ ID NO: 541766 - DNA, 1291 bp, Homo sapiens
cgagcgaacagttacaaacaatccccgcacgcaggacctcaccgccaagcttcggaaagctgtggcagaagggcagcaggcaggacaccattttctgaccttcatctggagcaacccccggtcatctgcatcaggctcaggcagacaacccctactcatcgtagcaggcaagggtgcaggtacaacgtgcatgccatgttgctgcccaacagcagccacccagggcttcccatcgtgcccaggctgcactctgggacgtccatggcagcaacccatggaacttcatgcaggactgcatgttacccgtgcatgcacgcaccgacggcccatgctggcagcaagcggtatccaggttacgatggatggcaccatgttaccatcaaacacacacgccggacgaacgactgggactcatgaccacacccgatttgtcattttgatgcttgatcaaggctcttggcacacatgccagcatgttaaggtcgaacggtagcatatttcggtcgacgaccgcatttgtggcatctgttcaccagcacacactccaaagggccaatcacacatcatggcagtcaacacactgaccgtgcacaggcattcgtcacaattagaggtcgcacccaggcaaagcccacacgaacatcagaaaatcctagcgtgggacacttgcacagcgcagacgcgcatctcagccagcaggtcagtcgcaaccatggggccccaacttcacttcacggtaggcccccccttcgcttggcaccacgccgagcagcaggacgcaaccttaacagtccatccccagaataacaatccagccgcgaacagcatgggagaagtcaaccacaaagaacacccacgaccacgggcatgaaaacgcccattactcaaaggataaaagaaccggcaaactagagaagaggcaatagacacccgaaaaagaacgacccggggtaaacgtggaacccagtgacagaaggcccgagtgcgaacacggggcacccccctggaacgataccatggccaccacagggaaaagaaagaacattctacccagccacacgacaatctgtggcacaacaactgatcccaaccatcgcatgatgcacaaaacacatggacctgtcagtaacaacccaacgttacacagggaacaaccagaaacaccgggaacaagagcaccgggactatacaacagaaagctgggcgacggggcacgcctagacacacagacaacaggcgtgaatatccccacagtaggatgagcacactctggcgccaacaacgccgtgac

SEQ ID NO: 541767 - DNA, 591 bp, Homo sapiens
tgcctcagctcccaaagtggtggatacgggtgtcgccactgcgctggccaaaatgaacattcttttagaaaaagaaaggcaaaggtagtagttttcattatgtgtggtattaaaatattctcacttaggaaaataaaatttaatgaccctattctccccctaagttatcaatatggtttcaaaatatggttaggtttctagactctgtaagaaattgacagtatagtggaaggtgcttctctcctgtcctcagcattggtgactctcagtgagctagctactgctcttattgaggttgtctttctctactcctctgtaacatcgtataaattggtgtgttgcaggagccttgtggctatgatgtaagtttcgtctctgcgcagttaatgggtccattatggaactgaatatacaattttggtgtctctggcacatctgtctgacaaaaaactaattgtcctggattgaacctattattagaccatcttgtgtcactcgaaaattaatgtaccaggggtcaattcaacatctcaaaatacaataacctctaaaataggcaagtcatgggatgatcataaataacaggctaga

SEQ ID NO: 541768 - DNA, 295 bp, Homo sapiens
agggttttttcggggacaaaaatcactgtcacccagcctggagtgccgtagtacgatcacggctaactgcagcctgacctccttgtgatcaggggctcctcccatttaagactcctgagtagctaggtgtgtaccaccatgcctggttaattttggtagttttttgaagagatggggttttgctatgttgcccaggctggtctaaaactcctggactcaggcgatctgcatgcctcggcctcccaaagggctgggattacaggcgtaagccaccgggcccagtccatattttttt

SEQ ID NO: 541769 - DNA, 712 bp, Homo sapiens
  misc_feature (111)..(111): n is a, c, g, or t
  misc_feature (200)..(200): n is a, c, g, or t
  misc_feature (219)..(219): n is a, c, g, or t
aaaggtagtagtcagcggatccttacaccccctttttaccaaacacatccctctctagcaacacacactcttacgacccaccaaaacatcacaatgacatattttctatcnaatctcccacaccctaaaccgtaaacaaaggtcacccacagaaccacttagtacacccaatccttctttacgcggaggagtgtgggggnacccaacaacgcgcccacncacccaaagtaaaaataccaccccacgggataatacgaccctggcccgggcaccaccgattatcatccacaacaaccaaggatccgagagagccctctatcgggagcccacaaagagcagtaactcgaactagattgacctagtcacagccaacaggtggtcaaagagcaaccacccccccggaataaaaagcgcaggagtatggggagacctcaggagcactatacccaactgcgggaggggtgagggactaagcctgacatgaatggataagcggcagcctacgaacgcatcgacgccgacacaggcgcccaatgggaacaagggaccgcctagggatacaaggtcgacgccgattgtaggaccctagccacagaaaagctgacccagaccttagaatgctaaccacggcaataccacatgtgccgtcccctacggaggggagttctggcatcaccgggatctgcgtctacggccgcgtagtagcaccatt

SEQ ID NO: 541770 - DNA, 447 bp, Homo sapiens
  misc_feature (100)..(100): n is a, c, g, or t
  misc_feature (174)..(174): n is a, c, g, or t
  misc_feature (221)..(221): n is a, c, g, or t
  misc_feature (379)..(379): n is a, c, g, or t
  misc_feature (381)..(382): n is a, c, g, or t
  misc_feature (409)..(409): n is a, c, g, or t
gcctaccgactgacactgacccgattgccctgcgtgaactcaacgagtctgatgaggggaagcctgcctccccgctgctggtcaacgcggttgcctcaanacggatggctccttccgctgcatctgccgcccgggattcgaacccacgcaccagcacaccaccttgcgcccgcnacgccacggcctgagccctggaacccgtggccgcccacccgcgccgncactcggggcccctgccgcgatcctgcagccgcttatgcgtatgtgcacgggccgcccgcctggacctggagaagggactacggacgcctggaagctgcgacgccctgcactgtcccgcctccaccagcgcctcccactgatgtcgtggtcccgggcncnncaggggcccctttacatgccctctccnttttataaaattttccattaaaaaccacctattttcta

SEQ ID NO: 541771 - DNA, 1184 bp, Homo sapiens
aaggataagataataagagaacagttgtagaaaatcacagtgaacaagaccctgtccgtaccttgtttcctaacgttcatcgagtctcctggatgttgagtcctaatgaccaatgaagagagagatggtgctcatatattgacctggtactcccagaggaagggcaagtggtgctagtgaatcaaaacactcttacacggaccagcacgtaacttccgtgtctctgtgattggcggttaggtggcatgctcgaaaatagctcaaagcctacggtagcatcctgcgatgggatgtgaaaactaaaagtactgcactactcttgaatctcatggcagtactgctgtgctcatcatgagttatggattttcgcggtgctgcaatggccactgcgagggctagaacgaggaggccccaagcgcgaatgtgcaatatacacgttgagcacttgtggtggggatcttggataccaagactagaattcgcaaggaggcctggggtgagaagggtccgaattggttcctttgccccagaatggacagtacttccaatatggactgaaacggttgttggatgaaaacatctgggtgtgaattcgcacaaccttacccagaaacaaaggagtgttgccaatgaatttcggtcattgggtgcctccgcgcaggagggaactgagggggacaaggaagcccctttctccgttggggacccccttgagagtcgcattgggtagcctccggtctatcgtacggaccctttagaagtgtgaccgaaccccttttcgccttacaggacggcttggggacgtttgggcgtccctccctaggcctttgggttgtccacggagtcggtcccgcgtacagggggatggacattgcgcattgtgcaccaaaggttgcttaacagatttaccccggggcgaactttgggccccttttaatgggccaccttgggagcgtcccaaaaaggtggcaaccgataagacaagtcggccccacgagtctttaaacttcgactcactattccaattgtcggcactgcaagccttcgcgaaattgcgcccattccgggcatcacagcccccaacagccgcccatttcggcaccgagggtggaaggtacaagggcctctgggggagaacacccggaaagaagaagcggaatgggctctctgattccaacgtacat

SEQ ID NO: 541772 - DNA, 161 bp, Homo sapiens
aggtgactctagaggttcccccttatttccggtgtccttaaaaaataaagggcagaccgtgcaatacaaccccagatcagggctggcttagctaatatggggccaacggcggtggaagaaaaatggtcaaacaccccaaagtggtgtaaatttctggtaaa

SEQ ID NO: 541773 - DNA, 935 bp, Homo sapiens
gggaaaaccgtgtactattagccaatggtcaatcccatccgtgttcttctgacacttgccgtcgacggctgagtcgccgttgggtccgatgctctcctttgagctgttctgcaagcaaggtcccaacagacagtcaataaaaatcctcgtgctctgagcactggcaggagaaaggattcggttataagggttcctgcttatcagcagcaattattctcagggctttatgtgtcagggctggtgacttcacacgccataactggcactggatgcgcgaagtccatctatgagggagaaatctgaagatgagaacttcatcctaaagcgtactcggtccaggacatcttgtccatggcaaatggctggacccaagcacaaatggtccctaagtcttattccatctagcgactgggaagagaattgaaagtcggtatggaatgggatagagcagtggtggctgtgtgtggcaagagaggtgataggaagaaagggcagtgaatactcgtggacggccaatggaagcgcgatttgggtcccaggaaatggaaggagcaaggccaaggaagagtcaccaaatgtggcttggacctgggtggtaactaaacggttctgtacatttaagaggtttcgcagccttctgggtggtaagggcattcctctaaaggcgcaaacccaaggaattctacttttcgccgtaattcctcgtttaagggcttccagaggaacgaaagacagagacccgagttacacaatgaccacaactctcttggtcattccggcaaggataatacgccattacgaagaagttcgtctcatcggtaggtacagtccatacggtccgttgcacaggtgtatcccaccttatttgggaggttaaccccagtaggattatataccccctattggtttacacccgtcccccgagtggcccctaa

SEQ ID NO: 541774 - DNA, 250 bp, Homo sapiens
gatatagatgtgagccgagcatggtatatgcccgagggcatagtaggaggagttcgccaccgggggcactgaccgcaaggacgtacttatttctaccaggcagacgatgagcactacatacccccggagccgtgctagctggactatggaaccccggagtgatccactaccatacctcaactaccccgctatagccaaagctctaacaacctcagatgaacatcatacctagtcaggaacataggagtga

SEQ ID NO: 541775 - DNA, 678 bp, Homo sapiens
gaggatttctcatctggtcaataaagctgtttagaccagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaattgtgggccccttggccaaaaaaattttaaaattggaaaagttttataaagggggccaaaattggggacaattggaaaaatgccccaaaagggggggggataaaaaataaaggggccgggttttaaaaaagtggaaaggggaaaaacctgggggtacccaaataaaagcctttggaaaaaaatccctttttgccaagtggggaaaaacggaaaaggccccgaacgatgggcttttcaaaaaagtggcaaacctaaaagggaaaaggaaaatggaagggtaaaaattttggaaaaaatgcgggaaaaattttggaaaaaaaacttattttttaaacaaatgggcaaaaatgggaaaaaccctttaaaaataaaaaaaataccccgaaaagggtttaagggttttccaatttggaaaaaagagccctttttaaaaaacgggggtctccacgtaaaagggggaaaaaccgttttttagggcgagggccccattagggcctcccctttttttgg

SEQ ID NO: 541776 - DNA, 898 bp, Homo sapiens
tgagaggctcgtgcagcgcaaggctgcgctgccgcggcctgagcgcaacctgcgcaacgagcgcctgggagcgtgtgagtggatgcaggccccgcccctcctgagtgaaaggccccgcccctgcagtgaaggagtcgtggcctcgccggtgtctggaagggacgtggttgtggcatgcagcctgccccctggagtgaatgtgtgacctaggtgtctagcccctgactgcgtgcgatgtgcgcctgctgccaggggtctcagtgatgctttttacccaacaaggtgccaatgcagggcgctgggtgtcccagtggagctgaaggaagtgcttgcccaaggccggacacggtgtaggcatcagcggagataaggaggttggggattggggccgggtccgacacctttgcggttcattgcctcccagctcaccagacctgcacttgccggactgacaccaaggtcgtgacctgaacttgtaacgttggttgcatcagccccccgttccctggaggggcccgacaatagtaggtcgggggccccactggaggaccaccttgccacggatgtggacctgtagtagggtcggtaagggaggccttggcattgctgtagacctgcgtagtcaacaggttgtacaccgccaacaacaagaacaccctacatacacatgggaataacctagtccgtttacatgcagttagtctcgtaggtggcgtggggggatcgtggtgcacggcgtgcatggcgccaattgggtcccccgtatgagtccgtaataaccatgacaccttacaagtatacgcatcgttccataagagaggtgcccagaaagaacgccctaagggacgaaatgggaagtgagcggggatgaccaaggggaacgaggtccatgggctca

SEQ ID NO: 541777 - DNA, 866 bp, Homo sapiens
  misc_feature (866)..(866): n is a, c, g, or t
attagaagtatgggacagttggaggctggctatgaattttcctgcatacttatcccagtgcagcagtaatggccacaacaacagctaatatatgtccagtgcgtatgtgcacccgggacaactcactttcaagcctccagcctcacctacgtctcatgaaagagaaaccagacagaggttaagcaagaagtgaaggccatgttaatgaaatactaagctggggtttgaacctaggccttctgactctggtatcaatgctagttttgcaacagcaggtactgctttgcccctgaatcgtgcgggatacaatgaaagcaaagagtagcacatttcctggaagaaggaagggtggaggagaccaaactgcttcttggcctgagtcaggtatcagctctaatagttctcatattctctaagatacagatgtccttgtagagcagacaaaaatgtgagtgagctttcaaagacatttgaccacatacgtgatcctaaagcttgctgccatttgaaattctatgcttcagtgtcctctcagcacacttggtgggcactactgtaactggtgccccagcactgttccagccatccactccatgacagaatgtgggtggaaatggagcctccaaagccttggatgttggactagtctgtactggcctcccaagccccaggactgatgtgtggaactgggagaaagcccaggccctggcaaaaggtaagtttgaagggtttcctgaacaggggtgttcggctcctaagaaatggtgttcccaagcaaagttggttccttaaaaagggtttcagctttcaaaaggatggggggcttttggaacgacccccgggagaggccacgttaatcgggggcn

SEQ ID NO: 541778 - DNA, 749 bp, Homo sapiens
actccagcctgggctggacagtgagactttgacagtgagactgtcaaaaaaaaaaaaaaaattaatagataaaacaggccactagaagggtgcagttataaagaaatggatgaggtttttacctttttaaaatatgggttagaagttcaaaaaccatcccttaaagggtgattggtttttttggagacaggggtctcggctctggtcacccagagtgggagtgcagtggtcctggtaatctcagctcactggcagcctctgcctcccgggttcaagcgattctcctgcctcagcctctttagctggggactacaggcgcacgccaccacgcccggctaatttggtatttagtagagatgggtttcaccatgttgggcaaggctgggtctaggaactccttgacctcgggtgatacacccatctcggcctcccaaagtggctggggataacagggcttgagccaccacgcccagcttaaattgtgattctggatactggttaaacgtatcaggtggcaattaacttgtggcaaagtcagtcgaaataagccctggggatatggccttatgtacactgtaatggcagacaggtggctttcatcattcatgtaacattctcacacagtgaggatatcatctcctcaccaattccagatggtaaatgtccatcttaaacaatctgaggtcccaaacagagtattggactgtcaataggtgtccttgctgcaggatgcgatgtacctgagcaaa

SEQ ID NO: 541779 - DNA, 743 bp, Homo sapiens
cggcgaaggaggtggtggctgcgttgggctccgggaagccgttcgggctggggctgtcgggcgcggggtggaggcactacgcgcgggggatggcccactgcgtgaccttggttcagcatgtcacatattcctgttagaccaatctcattgacaacggacatcggctccaagtctgacccagtctgcgtccttttacaggatgtgggagggggcagctgtgctgagcttgggcggactgaacgggtgcggaacgtgcttcaaggccccttgagtttcctcgcaaggaactctacagcttgagtaccgctttgagacagtccagaagctacgctttggaatctatgacatagacaacaagacgccagagctgaggggattggattgactttccctagggggggtgcttgaggtgttccctaggacaggatgtgtccagccaggtactgactctccccttgatgctgaagcctggaaaacctgctgggcgggtgaccatcgagggtcttcaggctcaaggcacatttaacaggacaaatcagtgtagtaaccatggaggtagaggccagagaaccctcagaataccggaaccgcgacctatgccctggggggacaacacatcccgaatccgaattgactgggagctaccttccggccagggatgatgggacaatggcacctgggtgttacagatcttgagggtcgatccacgtacgcagaaccttgaaggcgctaacactgggacc

SEQ ID NO: 541780 - DNA, 265 bp, Homo sapiens
caaaaaaaaaaaaaaccggggcccggggggccccgggggggtttttttttgaacttatcctaaaccgccctggccccccccccccgggcttggccttttaatcctgggttttaaactaaacgggatttccccctgggggttggtccccccctgaaaaaacccaaggttttaggttttagggccctttatcccgggggaagggttggggaaccccccccggggggtttttttttttaacccaaaaaaaggtttattttttccttta

SEQ ID NO: 541781 - DNA, 106 bp, Homo sapiens
tcgaacgggattctaatatagatatagttcaatttctcgtgtaatatcgaaagtatttgactgctatatcctgtctaattagggtaacagacactagatttaccgt

SEQ ID NO: 541782 - DNA, 287 bp, Homo sapiens
  misc_feature (59)..(59): n is a, c, g, or t
  misc_feature (67)..(67): n is a, c, g, or t
  misc_feature (251)..(251): n is a, c, g, or t
gacagtgtctctcacccagtctggaatgcaacagcgtggtctcggctcactgcaacttnccccctcncaggttcaaaggattctcgtgcctcaggcctcctgagtagctgggactacaggcatgtgacactatgcctggctaattttttttgttacttttaagtagagacggggttttgccatgttggcccaggcaggcggatcacttgaggccagaatttgagaccagcctggccaacatggcgaaaccnctgtatcactcttttagacccttctgtcgtcttctc

SEQ ID NO: 541783 - DNA, 549 bp, Homo sapiens
  misc_feature (151)..(151): n is a, c, g, or t
ttaagccctgagataaaggatgtcattgagcagctcaacttggtccccacctggtggcaggtgcagaacctcggaattgaggagggtaacaattttggagtggctgtccagaaaaaggtgtttgagttgatgaccagcctccacaccaagntagaggggttccacactcaaatttttaagtatttttttgaggggggtgatgcagtgattaaagcagccaagcagccccatgtgggtgattatcggcagttggtgcccaagttggataaggcaaagtcccgggaaatccggttaatggtcatggagatccccaaggcttatgttgtgttatatgacatcatcctgaagaattttgagaagctcaaaaagcccaggggagaaacaaagggaatgttttattgagagccctttttcccattttgtgatgaggacagcaaaacccttccggttttttatgggggactccaaattttccccaaactggtttttgttgagatttttccccccccttgcctttcgggcccaataaaaatagttaaccccctgcca

SEQ ID NO: 541784 - DNA, 330 bp, Homo sapiens
ggggcccaaaaggggggggtttttttttccccccccccccggttttaaaaaaattgggggggggggggttaccccccgcttttaaaaaaacccccccctgccccccggggggggggggggaaccccccccaaaaaaccgcttttccttttttgttgtggggggggggaaccccccaatggggggggccggggggggggggaggggggttttttttttttttttttttgtgagacccccccccccccccccccccccgggggggggggggttttttaaaattgaggcgggggttttttttgggggaaaaaaaaatgggggtgggtttttta

SEQ ID NO: 541785 - DNA, 635 bp, Homo sapiens
  misc_feature (252)..(252): n is a, c, g, or t
  misc_feature (272)..(272): n is a, c, g, or t
  misc_feature (292)..(292): n is a, c, g, or t
  misc_feature (338)..(338): n is a, c, g, or t
tatcgtgtggggataatgggggataattgggggggagggtatgtgaagggtgtttaaagccaatcgatttggtactatgtttgaaaatgctgctgtgcttcctcagcccgatggagggggccgaggaaagttagccgtggttctcggggaggcggtggcacggggacgtgggctcaggagaaagccccagggggacggtggacccgagaagatttccgggagtggaaccgtgagtggaaacgctccggtggntcaggaggaggctgcaggantggtggccgccgggcttgcnagaactttgcggcagttttggcctccacttctccgattgtgcgtgngccatctcttctgtgggggggccgcccccgtgtgggcggggctctgggggtgggtgtagagcaactcagggggacggtgacgtttgggccctcccgtgaacgcctcgagctcctatggcagagcactgtgacccctgggtgggcaccgcatggagtggctaggcaggccccttgcgcaggcgctaggggggactggcttccaggggtgcattttgggaagaatcttgcccacggggtatctgggggaatgttgtccggaagcacggtcggaggggtcgacagtccctctcggacttg

SEQ ID NO: 541786 - DNA, 95 bp, Homo sapiens
aaaaaaaaaatcccttttttggataaagggcctccccttttgttaaataatccctttttttgggaaaaattgttaatttaaatgggcccccttga

SEQ ID NO: 541787 - DNA, 904 bp, Homo sapiens
ggactagtctcgagtttttttgggggtgccacaggaataataaattattataatcccgatggtggggtatgcacataaaaaggggggacctcttctcaccaaagggtgctggccgttgcccaaagtggcggcaacataggagaggcgcccctgatggcccggcccgtgccaggcccgtgttctggtgcccaggtgtggtgctctgaggacacggttcctgagggccttgctcttcatccttcacagtggggacacggccctcatgcaagtggcacaggggtgccggcagacagaatccctgacgcccttgtcccccgtgggtgccccagggtgctcagaagaaatgccgtaaggattgaggcccactgttggcggggagcagacagccactttatgggccaagccttccctcaaaaaggaagcctgtgccctggatttgcaaggcttcctcgggggtgtgctccaccgttgccaaaaagaaagctaaacccaataccttgcgaccagagaatccccatggttgtgttcaaaggggttcccaagtgtccccctggggttctaaggcgaaccgagtaggggggtgcgtttaggacacacaggagaaggtttctaacaaaccctgagttgccccctcacggctgctgaaatggaccttggacggtgtaacaggccacggtggaagcagctgaggatcgcattgggccctgggaggaagtcacttggaggggcttctcttaaaagttggcaaggccccccaggaaccgtcctggggcatatcccgtttgtcacgggtgggcattcgttgggaggcccaggcaaaaataaaagaggaagtaccaaccacaggcgcttaagaaggcacacaaaagtgttgacaggagggtttcttgcccataatgatggg

SEQ ID NO: 541788 - DNA, 479 bp, Homo sapiens
atggaatggtatgaatgaatgaatcaacccgagtgcaatggaatggagaggaatggaatgaatgaatgaaactacccgaatggaatggaatgtaatggagtgtaagggaattgaatagaatcttccggaatggaatgaatgaatgaatgaatgaatgaattgaatggaattaacccgaatacaatggaatggaatgaatgaatgaatgagtggaatggaatgaatcaaccgagtgcaggggaatggaatgaatgaatgcaatgcaagggaatcatccggaatggaatggaatgaaatgaatgcaaagcaatggaatcaactcgattgcaatggaatggaatgaatgaaaggaatacattggaatcaacccgagtggaatggaatgaaaggactggaatggagtggaatggaatgaatgcaatgaatggaatcatccgtaatggaatggaaaggaatggaatgagtggaatggaatgaat

SEQ ID NO: 541789 - DNA, 1112 bp, Homo sapiens
gaacgcaagcagcctgagcagcggagaggcgccgctgtagttaactcctccctgcccgccgcgccgaccctccccaggaacccccagggagccagcatgaagcgagctcaccccgagtacagctcctcggacagcgagctggacgagaccatcgaggctggagaaggagagctgcggacgacgcaactggaaacttgacgttcggctctaggttccactgtccccaactacactcttcccagcacttttggccagaaacacacgacggagcaggaactaacttgacgaagcgccgacgagaccggactcaactaacagtttgtctgagctgagcaaggctggtacccagtgcttttgagaagcagggatctgctaacgctacgaaaaacgccgagatcctgcacgcatgaccgtggatcacctgaacaatgctgcatacggcagcgcaggcgacacggttacttctgacgcgcacgcccttgctatggactactcggagtccgggactttcgggaatgcctggcagaagttgcgcgtcatctgagcatcattgacaggactacatgcctctgacccgcttcgagttcgactggtttcgcatctcaccaactacgcttcccagcggcgaagcccgcgagcggcgcccacgcgggccctcggacacattcctgggggaccgtcttcggacatcacccgcacatcgcgcacccgctcgtgctgccccagcaacggccaccgggaacgcgggccaccacggccctcaaccacggaaccgcagcacaaggccaagctgagctcggcaccataccggaggccgccggattggcaaacgcacctacggcaagctccgaccggtgctccttgcggcacctccgcctccaacatggccgcacgccatgggactaccacagcggcactcccgtgcggcactcaccgtataccaacaacgggccctccagccacggcgctccaccgggccgaggccctataaacacaccagcgcgcaacctgtggagcccataactgcgcgcgccgaaacacagccctaaacacgccgccaagtacgcggcaggcacaaacacccagggacacggccgcacccccaacccaca

SEQ ID NO: 541790 - DNA, 1005 bp, Homo sapiens
tgggggcaaaaaaaaaaaaaccccctttttttttggggggaaaaaaaaaaagggatatattttgccctggggggcctttgtgttccccaaaaaaaaaccccccctttttgccccccaaacaaaaccccctcgtcgcctgcgcgccaacggtgcccctggcgtctcttaagaagcgtaattccaatcaaaaaaaattcttgtccccgcgaggaagaagctcttgctcccccaagtagaacacgtagcaggatttgaggagttttttttactcctcttttctcatatatatattctttctttctctctagtagatttttgacaaaaatcaactggttgtggtagtaaaaaaatctctctctttttttctccctcgagagaaagcccaaggtgagtgcgcccctcctctatgtctgggcgcgccacgaggtggagcccgcgcctagatatagtgggagtgcagacctctctcgaccccacgagcgtgcggacgagcaccgcggggcggagcgatcgagcaagagagagcaaacacagaggagagagcaatcatatttctaccaacacccgagcgggcgttgctgtggggcggacaacagcccacacacacgctcgctgacgtaaaaagtaagcagccgctgtggctttggttgagcaaccacacacctgcgatgtgagagagacaacgcgctgtgtggtgagatacagcacgagattcaaacaaccaccccattccgctggaacccccccgagagagagaaaaaaaatatccccccgaagcgtaccacacacccatcagcggaacgagggagggacgagatatatatttgtgtgtgtcaaaaacccactctcccccgcctcaaaacacgagcagagtatcgtgtgtgtgagaaacacagagacggcggggggtaggaacccaccaccatccggggcggttgtagcagaaacgaccgaaggggtggggtcccccccccccaaccaaacaatcaacctccgcccgacgtc

SEQ ID NO: 541791 - DNA, 158 bp, Homo sapiens
ctgagagtttcccacagatatattatgacagtctgctgtcaggcttatgattgcaataatagtctattaatttaaaaaccaaaatggcaaatttgtatcttatatcctataatagtatctgatatctctgcatatacatcttaggataacttcccagt

SEQ ID NO: 541792 - DNA, 149 bp, Homo sapiens
agaccttatgattggcgggcacttatgcacgcttatcatatcttaacaagctttgagtgcagagatgaagagtcaaatctgaccaagatgttgatgttggataagagaattctctgctcaccaccatctaagttgcccgcctaatcgaa

SEQ ID NO: 541793 - DNA, 222 bp, Homo sapiens
gccctcaaatttatcacgaaattggtggggacgcacattcgagccaagaggaagcctgaggagctgaccaacgtactggccggcatgaggaaagctgctgccaagaaagactgtgcccctaccctgccctctccctgaaataaagaacagcttgacagaaaaagcaaatcttgattataaggaaattgagaaacttgaagagggagcacgtcggccgactaa

SEQ ID NO: 541794 - DNA, 158 bp, Homo sapiens
gtagtagtagcttgagtccttccgtgttcagctgtggaacactcccgattctcatggcaagacaagcgctcacagcgggtgactgcggagcaggggtagttctcagggcactcgaaggccaggcagcggaagccgccctggcatgttgcaaacaggtc

SEQ ID NO: 541795 - DNA, 712 bp, Homo sapiens
tttttttaaagccagcttttcttcagatttttttggtgggcaggtcgtgaaagacaggtgaggaagtagatcttgggctcagcatgcctctaaaagtataatttcttttttttaatgtggaaagaaatgcataactctgtttctgttcctgtccccctctctgcctctgtggtgcctgagatactggggatcccacagctggggccactcagaggctaccaggaacgcttccagtttgcatctggctgttagtgccagggccagaaacccacagacctcttcacagacctcctgaccgtgatgtccctgaagcctggaagttgttccacacaatgaagcagaattgagtgatggggtgttttgtggaacccagtgaactgtgtaacacagtgaactgtgtaatttgagtgaagtcaaattccttgacttcatttggcccatttcttccttactaccaaaaagaaagatgttagatgggatttaatactttgcttaacagtacagaaaaacaaaactttggattaatcccagaagagaaatgctgaccctgttgccttctgaattgtaggaggggagctggcactgtctgcattctcagtgctagtatttctgtggctgcacaggttacaaagactctttgagggccttttcctcagggtcttttccatggtcatggattaccgtcgggcaatccttgtttgggactttgctt

SEQ ID NO: 541796 - DNA, 334 bp, Homo sapiens
ggcgtgcataagtgagatatataaacagacagagaaattacactaggggaaagaacatcactataagctgatcgtcactgtcctatgacgttgggaagaaaagagccacagaagatgtgatggtgaagatcagcattaagcccacctgcacccctggtgctggcaaggcatggaacaggcaggtattgatgtatgacgcgcgggcaccggacgcgtttggctcgtcgtttccaagatatccacgctggacgacactgtggcgatgccacgtcgcgcgtcacgtactaggccacatgtgtgagctatgaatacctagctcactatgagggacaat

SEQ ID NO: 541797 - DNA, 115 bp, Homo sapiens
cgtgtgcaaacatgtgtacataccaacaacagaattcaaacacatagatcacagaaatgaaatgagaaataaacaaatccacaattgtaagtttggagacttcaacactcttctc

SEQ ID NO: 541798 - DNA, 814 bp, Homo sapiens
  misc_feature (58)..(58): n is a, c, g, or t
  misc_feature (105)..(105): n is a, c, g, or t
  misc_feature (193)..(193): n is a, c, g, or t
  misc_feature (211)..(211): n is a, c, g, or t
  misc_feature (229)..(229): n is a, c, g, or t
  misc_feature (255)..(255): n is a, c, g, or t
  misc_feature (338)..(338): n is a, c, g, or t
  misc_feature (344)..(344): n is a, c, g, or t
  misc_feature (366)..(366): n is a, c, g, or t
  misc_feature (424)..(425): n is a, c, g, or t
  misc_feature (467)..(467): n is a, c, g, or t
  misc_feature (476)..(476): n is a, c, g, or t
  misc_feature (496)..(496): n is a, c, g, or t
  misc_feature (522)..(522): n is a, c, g, or t
aagtgctgtactgcccggattacgggatggcggttccgttaggtctgagggagcgatngcggtacgcgcgttgaagctgctgaccacactgctggctgtcgtggncgctgcctcccaagccgaggtcgagtccgaggcaggatggggcatggtgacgcctgatctgctcttcgccgaggggaccgagcctacncgcgcggggactggcccnggggtggtcctgagcatngaacgggcgctgcgctcccgggcagncctccgcgcccttcgcctgctgctgccgcacccagtgtgccgccgacttcccgtgggagctggaccccgactggtcccccagnccgtgnccatggcctcgggcgccgccgncctgcgcgactgagcttcttcgggggccttctgcgtcgcgctgcctgcctgcgccgtnncctcgggccgccggccgcccactcgctcagcgaagagatggngctggagtnccgaagcggagcccctacantacctgcaggtcgctacttcagatcnacaagttggacgaaagctgttgctgcagcacacaccttcttcgtgggcaatcctgagcacatggaaatggcagcagaaccctagactattaccaaaaccatgtcttggagttgaaggaggccgacttcaagggatctttaaggactcaacccccattattgcaaagaatttcggacttggggaattgcgactctacctcagaggacacagccaacaggaaagctgttgccccaaccttagaaggcgtgcgcttgcaagaatactttgtgggctatgaggaattgcgtgccct

SEQ ID NO: 541799 - DNA, 435 bp, Homo sapiens
tccactagtgtaggcataggataaacaccccatgtccagtggtgccaaggtctgaaccgcgtggaagcgcgagatcaccccaggaatcaccccgcccggcgactggaatgtcctgacccgggttagctacggcctgatgccgacctacaactcggaagagaacaacgaaattggcgtagaccgtatggctcagggtacagcccagaccacggttgacgtcggcggccacgttgaaacaaagctccgctacggcgcgctggatgaattcatggcctcttgctttggcaaggattgggtcggcaacgttctgaccatgggcaatgaccggatttcgttctcgattggctcatacgccaacgacgttggcattgcggcgattgctcgaggcgctcaagtggctacgatgaacttcgagatcccgagcgacaacgagat

SEQ ID NO: 541800 - DNA, 712 bp, Homo sapiens
ggggcttcattgtaattactgtgcctgtcgtcgtacaattacatcattgagctgtaatgtaggataaacaatattgtgaagaatatagttggagtcaagttctgtcctgatgtagtcacctttcttctgtcagatacctccatggcccacatctagtcatccattacccaggatgactgattccaagcttgtggaggttgtttggtgggaggaaatgtgtctgtgtgtgaggggggtgttttcttacattaaaatactaagttttataaacataattttattggcccttctcagtgcctagcaaggaaggtaggttaggtatatgctcctttttacgttgaggaaactgagactcaatgttttagtgtgtagtactccttctattctgtttgtaaagtaagtaatgagatgggcagcctttgctgaccaggctggaagtgcagtggtacaatctacggctcactgcaacctccacctcccggggtcaagcagttctcctgcctcagcctctaagtagctgggattacaggggcctgctacaacccagctaatttgtattcaattctaattttattattcatgatatttttgacatggactcttgctctgtgccaggctgagtgcaggagcctctggtcaatgaactaactccggtcagtgatctctgctcactccgatataggacaaggctgccatcccaatcggtttacaa

SEQ ID NO: 541801 - DNA, 100 bp, Homo sapiens
  misc_feature (51)..(51): n is a, c, g, or t
  misc_feature (78)..(78): n is a, c, g, or t
gacaatatgaatgcatgtgacttttgaacatatttgcagcaataaaaaggnactaggcaaatcaaaactgcattttgncatttaaaagttggattatatt

SEQ ID NO: 541802 - DNA, 923 bp, Homo sapiens
gctgccggtctgatgtgcagagctgctgtcatggcgtgccgctctgtgctggcttctttcccgtcctgtctgctgctgctgtatctgggggatgtccacgagccgtcgcgaggtgcccggtgctgctgtctgagtggatcttgggagggtagtgggtgtctgggataggagtatctgcttctagaggattgaggggcgtgcagttgttcgaggggtgaagcctcaggaatggatctcggcggccggagtgctggtagacggagaagagcacgttggtttccttaagtagagatgggtagttgtgtggttcagtgatataccttcgtgtggatcttatgtaggtggaagtagtatctccagcttcaacggatttgatcccggtggagtggatatcacttcgaaaggataaatgagagcaagatatgtgaattagagtcgatcacatctagaggttgtcagactgatcctatcctctaccaaatgagtatcttcatgtccaacttcttactttagtaaaagggaatcgtgtgggtgtagagaacttctaatgaaccgaatgtttatgctgatggttcttccttcagggatattggtgcgtctggctaaagtggtcaaagaagtggtcctgtaactgagacggaagatggggctgtcgtgaatatgtgtgttctaacatgaagtgctgaagttgctgagttcatgacaggatctgcgctcaaatctctggaattagggggaggtaaaggaagggggctgggagaggttcggcgccaagtgggttggcaaggggcgggggtcacgtggacgcgtggagttaaggacccaggaatcctcaggtgataagttgttggggaaaacatttggtgcgaatcaaatgcaaaattataaaaaaagggacacgggtgatgtaataaatagctctg

SEQ ID NO: 541803 - DNA, 443 bp, Homo sapiens
attcttgtcatacatttccatacttgcattatataaatagtacggggatctctgatatcagatgtgcaggtatgtaacgctatggtatagatgtggccgatgttagaatggcttgactcgatcaacctgtcacctacattaggtatttctctaaatgctgggtcaaatggtatttctggttctagatccttgaggaattgccacactgtcttccacaatggttgaactaatttaccctcccgccaacagtgtacaagtgtttctgtttctccacatcctctctagcatttgttgttacctggctattttaatgatcaccattctaactggcatgagatggtatctcattgtggtttagatttccataatgaccagtgatgatggagctttacatcatatgtgagttggctacataaaacgtgttccttttgagaagtgtctgt

SEQ ID NO: 541804 - DNA, 599 bp, Homo sapiens
aggtacagaaggaatatacctcaacatagtaaaggatatatatgacaaactatgccaaattatactacaggaggaaaagttggaagctttcctgtaagattgaaggagacaaggatacccattttattcaccttttaagagtctcgcactgttacccaggctgagtgcagtggtgcaatctcgatcgctgagctccgttctgtgggttcaggcgattctcgtgcctcaggccccaagtagctgggactacaggtgtgcacaccacgctggctagttctgtgttcctggtgagacggggtttcaccatgttacccaggctgctctcgaacttctgagctcaagtaatcttcctaccttggcctttctgtctaagcgacagagcgagacttgtgtctcaaaaaaaaaagagaaacccaacaagttaattcctgtggaggatgcagacacttgggaaacttcttatccctttgaatggtgggcaaagcctaactaggtacaggcattacggacaaccagcgtggaaggtggctcacacaattttcaacaatagaatatcatacctgggcataccgttccagcagtcttgcactgagtttccc

SEQ ID NO: 541805 - DNA, 170 bp, Homo sapiens
agatatttagaaaccataaaatccacctatttgaggtgtacacttgagtgattttctgtatagtcacagatctgtggagtcatccacaccctctaactccaggatatttacctcacccccgagaagaaacctcccttaaccattagcagtcactcctcatttgctctccc

SEQ ID NO: 541806 - DNA, 267 bp, Homo sapiens
  misc_feature (9)..(9): n is a, c, g, or t
  misc_feature (11)..(11): n is a, c, g, or t
  misc_feature (13)..(13): n is a, c, g, or t
  misc_feature (129)..(129): n is a, c, g, or t
  misc_feature (168)..(168): n is a, c, g, or t
  misc_feature (171)..(171): n is a, c, g, or t
acggaaggngnanggggaggagcgtgcacccctcctggccttggtgcgcgccgcccgctaaggtactttggaagggacgcgcgggccagacgccgcaggacggccgcgatgggctggttggccggcggntctccagagggctgggctcccacccggccgccgcaggancgncggtcgtcttcgtgtggcttctgcttagcacctggtcaacagctcctgccagggccatccaggtgaccgtgtccaacccctaccacgtggtgatcc

SEQ ID NO: 541807 - DNA, 250 bp, Homo sapiens
gtagtaatgaccgcacggaagtggattctgggtcccccgtactcatggctcaaagtaccactcctcagtcgctatattaaagcttatatttagctggattactgctaaaaaaaaaagaacacggagcactatgagtgtgagtatactggaaggcatgtcataccagtttccggggcagcatgctaaacagttagaattcctacacggggtgctaatcaagtcattaaagtagttcacgttttaggcccct

SEQ ID NO: 541808 - DNA, 960 bp, Homo sapiens
gtgcagtgactcggataccttccctagtggccataaagctccagacgaatctcagtgcaggacgccatcctcgcaatattcaagagtcacccttctaaggaggacccctagactgctcgctagtggaacacgacagaggcgaaatcctgccccgtctcccgtggacctggctggatatggtttttgccaatccacagagccatcctgccctgacagctagcaagaggccaagacccacagaacaaccactacagcccctctgtcagcaggaagcagttaaagaagactgaccttcgtccattttcccagataattgggtcttggactcttgagggggggaaatgttggagcaggtagctagtcagacatgagcagggcaggggagggccccctcaccaggaatgtcaggcaaccatcaggtgatggtgaggcagttgttaagctgtgtctctaacataataatgagtggcagctggcgccagggaacgatggcctcccaatagataggaaacacctgaagctggtgatcagccacttcctgataagatctcaggagttgggtgcgcaggctcaagcatgcaccctaagaggcaaaatagtggcatttaactcatatatgaccttcctttaggaaggcttgactggtaagggaaaaactcctccagtgaacacgtgcacaacttcagtaaaaacactgcacatgcgtcccctcccaagtgctggcaggccactgtgcatgcagacagcccgccccaaagaaaaatcagaggaggagaaatggaaaccccggaacaatgccaatgtataaaacccaagtcaagggcctaccaaggcaattggatctctcaagtcacccgcttggctctcttcaagtgcactttgcttccttttgttcttgctctaaaactttttactcctgctataaaacttgccttggactatcatgctacttacgcctcc

SEQ ID NO: 541809 - DNA, 251 bp, Homo sapiens
  misc_feature (117)..(117): n is a, c, g, or t
  misc_feature (185)..(185): n is a, c, g, or t
  misc_feature (237)..(237): n is a, c, g, or t
gagctgctagatatcttctgaactcttctacttcttctctccccttccgttccgtcttcaacacactcgcgagactaagtatacttgtttgcctctcctgccgctcggtttctagtntcagcattcaacagtttggaggtacagagagaaaatgcagaagtatctttacttatccccctccaggnattgtatcttgaggtagaatatgttccttcctctcttctagtagtctagtanatcgactgtctctt

SEQ ID NO: 541810 - DNA, 111 bp, Homo sapiens
ttattcgttactggctatacttcgtataccatggagaaaataagtgtataatcccaagtgtctgaaacaaacaaatttattatcatagtctttgctggtggtgaaaggtgc

SEQ ID NO: 541811 - DNA, 269 bp, Homo sapiens
  misc_feature (43)..(43): n is a, c, g, or t
ggggtttttttttttggggggggggaaatttttttttttcctnaccttacaccatgtacaaaaattaacttgaaagggatcaaagacctaaatgtaggagctaacactaaaaaactcttagaagaaattttagatgtaaatctttatgaccttggatttggcaatggtttcctagaagtgacaccaaaagcaaaagcaaccaaggacaaaaatagataagctggatttcatcaaaatggaaaactcttgtgcttcaacaggcactgtga

SEQ ID NO: 541812 - DNA, 249 bp, Homo sapiens
tgctgcttcctctctcgcccaaagacatgtgagcaactgctaatgaaaagcagctaaacagccgcttaggctatagcagtttcaactccactctgagtgtgaagattccaattacattcgacgaccttaagttctttcaattttctcctaacacaagttcctgagtccagtatttaccatattacagcacctagcagatcacgctgtctaccacacctcactctttcttctgcctgctatcactccttc

SEQ ID NO: 541813 - DNA, 246 bp, Homo sapiens
  misc_feature (230)..(230): n is a, c, g, or t
tcggtgtggcgttcagaggatcccctctggatgcataggtcaggatacaaaatcagtgcaaaaatcacaagcattcctatacaccaataacagacaaacagccaaatcatgagtgaactcccattcacaatggcttcaaagcagaataaaatacctcaggaatccacacttacaaggagatgtgacaggacctcgttcaaggcagaactacaaaccactgcatcaacganaataaaacgaggacac

SEQ ID NO: 541814 - DNA, 298 bp, Homo sapiens
gctcgactcaactcaaaatggcctgtaaaaacctgaagtgagccagacgtcatggctcatgcctgtaatcccagcactttggttggccaaggcgggccaccgtgacttcaggagttcaagaccggcctggccaatgtagtgaaaccccatctgtacagaaatacgataaaattagccaggcatggtggtgcacgctgtagtcccaactactcaagaagctgaggggggaagatcgctagagcccaggggcgagaggctgcagtgaactgagattgtgccactgcactccagcctgggc

SEQ ID NO: 541815 - DNA, 288 bp, Homo sapiens
  misc_feature (237)..(237): n is a, c, g, or t
gctgatctagaggatcccttaaaagtgcactcttctatatctacttttttttaaaaaaagactcaccttgttttgagtctagtttttggcagttatagagtaaggctgctaaaaacgtctgtgggaggacttttgtgtaggacatacagttttccagttcatattggggtcaatatattgtaggatatgagacttacttgaattacagtaggaccagtgctatatatttctatcagnacctaccgcaggactggtctttccgaaattgggctgtaagattataggaaa

SEQ ID NO: 541816 - DNA, 102 bp, Homo sapiens
ccccagattgcctggagtgaaggtccctgagcagacatcattacaatcctgtctgttctgcacaggtcaatgaaccattgagccagtgcttatgttactggt

SEQ ID NO: 541817 - DNA, 868 bp, Homo sapiens
ttcccgggcgcctggttccttggcgcctttgtgggcccctatgagagcgtgggtccgcagaccgaggtggttgcgtcggccgcggatttccgcggggtgttttgttcaccaccagcgggcgcgtggtagtcgaccagcagggggttttttttcgaccggcgcgccggcccgcaacagtggggggttaagagaggtttgagccccgcgtgttgtttttccccggggggccccccacccattggggggattattgtttgttttcgccccgctgtctccggagcattgtgtggtcagacgaacccctctttgtggtgcgcacaccaccctcgggggccctctttggtagagcgcccccaacgatggttgtcgcctcctcactgctgggggggaaccccgcttccaataattttcagcgggggcgtggttcttccccaaggggggccacccactctttcctccttattgtggctggttgttttttgataggcgccggaccacccacgcgggggggtgtgtagatcgccccgcgccccttgtttgtgttcctctaacgaggtttttctcgcgcctttcgcggtggggggacggctttgttctcccccccgcggggtatccacttgtggggcgcgcgcgggcacgggggcacaccctatcttgtgtgcggggtgttcttttttttccgccctctgccgcctatttttgtgatgttgttcggcttttttcttctggacccccttttttttcctggctccaccaagagggttttttctcccctaaaaaaaaggttcccctttccccgccccttttttccaagagggggggtttttcctttttccccccctccccctttttttgggtgacccccaca

SEQ ID NO: 541818 - DNA, 903 bp, Homo sapiens
tccctctgcggtgcactgtagtgtctgtagggctatgggtttctgggcccaggcccgctgtgccgagcgtaacaccaggatgttgctgtgcccgcacaaattgttggtcccacgccgtcttgacgccgggcttcggggtaacgcccctgtgggcctcccgcccacctggggttcctggataatcccacgaacggtgtccccggggcgcattgtgtgtcccgcggtaccgcagggtcttttcttacggctttaacccttgtaggcggtctccaaggaacatttttctttgacgcaccactcacgctggggccacctctgggtgtggaaaacaatctactttttggccgccagcggcgccaaaataacttcttttggacaatccccgatggaatgtcactgttcattcacagcttagtttcttcgaggttcttaacaaaaaacctctccagcggccgtcctgaacaccattcaaattcccccccctagtcataacaaattttttccctcggcgagcattaaaacaaccaccaattttactattcatctgttcccccacacggggaataaatggttcaaacccccttgttcaaacccccgcacattctataagaatgttctataacggttgttgcacccaaacgcgaaaataaaattgaaattcttgtcatgttcgccctcaccccatgtcccattcggttgcgttccgccccctcccaaatacttgtagggtatccacgactgagtttatacccctttgtttacatcttaactcagcaagaatatatatcggcgtctcagaataaagagtttttcatcgtctattattctattaagcagtcccatcaatcttaagtggtcttgcaacccgccgaattgaagaatcagcgcccccccaaaataaca

SEQ ID NO: 541819 - DNA, 139 bp, Homo sapiens
aagcatgtgaaagcagaatgtcaaatactcagaaaaccattagatctcatgagaactcactcactatcacgagaatagcatggaggcaaactgcccccatgtatcccatcaccacccacgagttccctccacaacctct

SEQ ID NO: 541820 - DNA, 1377 bp, Homo sapiens
  misc_feature (813)..(813): n is a, c, g, or t
  misc_feature (965)..(965): n is a, c, g, or t
ctcccccctattccactcccccgccgtgtagtgatttggtggtaaatactgtgtgatagctgtttataatattcttttgggatatttttctgtgtctataagagtgttgtccgccctattatcccagtcttatgagttggggcttctcggtatattatatcctctttggggccactgtatttcgatgtgtcgcacacaggctacatgcgttggccccaacttgggaaattgatgaatattttgttggggcgggggggaaaaccaacatgtgggccaggaaactttgctctatcatagtgtggtggtgaacttcgtttgtttgtggtgattgtttggttcgtttgggaaatattgtttggggcccaccgcggatgttgttgtttttgtcttctcccacggggaggagtttgtgtgaagatcctcaccacaaagatatgtggggagatactgtgtagcacccacagtgtatgatgttagttgtagtacaaactttgtggggagatagggaaaacaatgtggctaactagagaagatatttgggtgtgggtgtttgaaaaatagtgcgcgcctctattagagagagattgtcgactcccgctaaagcgttgttattataaagggagtagagtatacaccacaacactcgggggggcgtcaatatgtggggagatgttataaatgtgtggtggggctcgtggattgtcttctgtattgtgcggaaatacacccatagtgtgtgtgaaaagtagtggtgaatactccaagaggattttcctcatgctcccccgggtgtctcacacacacaaaaggcgntcttaaagagggggatagtgttagtagcgccgcactttgtgagagatatagtgatagatctgtgtctctctgtgagcgcactgtctctcactaggtgatactccgtctcaaatagtcctccgcgggtgatatgttaacaccacgcggtgttntatctctacacactcacatgatagagcttataatagagtgagtagagatagtgagagagttgtcgctctctagacctctctcagaatatatagagtcgcccacgagtatacccacctgttggggtacacatactccagagaagagtgacccttataaagaacctcgtggaactaagtggagactttataggctcgtgaagagaaattttaaaaactaccacactagggagataaacttcgagacctcttgaagtgttttcacatccacaggaacactcggagtgcacccacgttggctttgatttttttcacagaaagggaaattgggctcaccagaatccaaccctatgcttgggttaaagcttgccatttgagctttgtggaccaattaattactattggtaaggtgtta

SEQ ID NO: 541821 - DNA, 1306 bp, Homo sapiens
  misc_feature (175)..(175): n is a, c, g, or t
  misc_feature (902)..(902): n is a, c, g, or t
caactctcgtcgctggtgtggtgtggtggtctgccccgccgctcccctcgtccttgtattgtatgtggggcgcgcccctcacccttcatacatgtggctgtgtgcgccccttcctccgactgtcttactcgttgcgtggtggggtgtgcgtctccctctccagcccccccgtacngggtgtgtgcgggggtcggcttcgctccttctgtttataagttcgtatggtctgctcggccccatcgcgtgcgcctagtgtggggctgtgggcgagattatattaccaggtgtccgcccccgttcgttcgtggctgcgatgcgttcgtcgcggagaaatgagctatccttctccccccccggccatttaccaaccaacagccgtgtgtgtgggggttgcttcacaactacttcctcgccaagatatatttctgttcctttcttgtgggcgacaaacatcaatctgtccctggccgccctcgacatccttgtgtctcctcgttgggagataagatgtcgccacgtgccacacactcacatataccatgcctacgctctctgtcctgtaagtacgatatataatatctatacgccgccccgctcttttacattctattcgttacctattctattaagtaagagcattacttacactcccctcgcatatacatagacgcactcccaccactctccctctgtctgagaggagacagtatcatagtgttggctggtgagcgcacactcgctctgcggaccaatacttacatactgcaagtgaggtggagcacactctcactgctatttgctgcaacaattccattatactcaatgattattatcgcttggttattcctctcaccaccacctctattgtgtgtgggggcgacacccaccacactacccttggngctgatataacaatatcgtcttcgattctgttcttcttatatagaacgcacacacattcattttgatcacacgtacatggcagcttctcttttctctctagaaaaaaaaaatagagctctcccctctattatactccctgcgccgtctgttacacactccctttcttgttcacccataattattcttctagagatacaccccctccatacttcggatggtcaatacatacaggatacaaacaattctccgcccgtgtttgataataatcattttctactccactcctgcggcggcggaacctaaccaacaacacaaatttattttcgcgcggtgtgcaattttttttttccgttttttttttcggctttttttttgggaaaaaaaaaaaaaaaacccccccgga

SEQ ID NO: 541822 - DNA, 354 bp, Homo sapiens
caccatggctatcagagttagcttctcacagtgtggcagttcgcgtgggaaacaaagagcatgatcctgtacgtcataatggtgaataaccccagatattcagcctggcacagtctcttcacaagttgtctaccgcctgtctaggatgggttccatcaatggtgatgcaccagcctgaatgcagaagcgctccagtatctccaagggtaccttcaggcagccagtgtgacactgctttacacctacatttttctaatgggctaaacccagatggtttcctaggaaatcacaggcttctgagcacagctgcattaaaacaaaggaagttttccttttgaacccgtcacgacttga

SEQ ID NO: 541823 - DNA, 882 bp, Homo sapiens
  misc_feature (769)..(769): n is a, c, g, or t
tgccctcagatcatgctctcttaggacatggggaactctgtctcaaaccagcgttctaatcggtgtcggcagctatactcctttctgccgaggaggttttctgggtacaccgtcaccccccctggtgctctaagagcacgctgtgccccgtgtaaagcgcgccgctcccgtgaattttcgcgcccctttttctcctattaaggctattttgggccccataccgcactggttagttcaaaagtcccctccgtctttgttgagcggaaaaataggccgctattcttgtccggccctatcgaatttccgccgcggtctgttgataactcgtccctcctctagtactaccttggcgcagaatttgtcccccgtgaccacccgccccgaatcctttccccctggtggccccccctcattgagtctaatttctcgcgcccctaacggggtagccattatgtcgattgctgtcacaagcattcccgacaagtggtggataggcccacccgctgttgtgaacaggtcggagtgcccccaccgagttaaaagcgtacaagcttcacaaggcccaggtaacagagtgtcggccccacccccctgaagaagctcttggtcaatgcctcctggagtaagtttctctgacgaactagcccttcatctcctgcgctgtaaggcggcaccccatccccaacttgcgtatgcatctgtgggcccaggatgtttactccacatatatggggaccccacagctggagtgaagtcttaacagatcttntcaccacagccccacagtgatcgatagcccatgaacgtgtcgttcctcgttagagcatcccccgtgctttagggccccgggtctttcattggatttaccccacacccataaca

SEQ ID NO: 541824 - DNA, 943 bp, Homo sapiens
  misc_feature (7)..(7): n is a, c, g, or t
  misc_feature (77)..(77): n is a, c, g, or t
  misc_feature (79)..(79): n is a, c, g, or t
  misc_feature (94)..(94): n is a, c, g, or t
  misc_feature (96)..(96): n is a, c, g, or t
  misc_feature (98)..(99): n is a, c, g, or t
  misc_feature (102)..(103): n is a, c, g, or t
  misc_feature (106)..(106): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (139)..(139): n is a, c, g, or t
  misc_feature (150)..(150): n is a, c, g, or t
  misc_feature (241)..(241): n is a, c, g, or t
  misc_feature (307)..(307): n is a, c, g, or t
  misc_feature (391)..(391): n is a, c, g, or t
gtaccgngtccggaattcccgggatggaagatggcggcgtccgttgtctgtcgggccggctagcgcggcgcgggggnanaagtggctagtgtgngngnncgnnggngcggcgcgggcgcgcgtgggngnggggcgngcnggcgctgtggnggagtagcgggcaagcgcttcgctcaggcgctccagttcgtgccggaaacgcaggttagcctgctggacaacggcctgcgttttgcctccnaacaatcctctcaacccactttcacggtgggaatttggatttattttggcagccgtttttaaactnaaaaaaataatagggcaagctacttttttgagcatcttgctttcaaaggaacaaaaaatcggcctggcagttccctggaaaaanaggtggagagcatgggggcccatcttaattcctacaacacccgggaacacacagcttactacatcaaggcgctgtccaaagatcttccgaaaactgttgagctcctgggttacatttttcagaactttagtctggaagactcacagattaaaaaggaacgtgatgtgatcctgcgggaaatgcaggaaaataatgcatctattcgaaatgtggtctttaactacctgcatgccacaacattccagggcacacctctagcccaggctgtggaggggcccagtgagaatgtcaggaagctgtctcgtgcagacttgaccgagtacctcagcacacattacaaggcccctcgaatggtgctggcagcagctgggaggagtggagcaccagcaactgttagacctcgcccagaagcacctcggtggcatcccatggacatatgcagaggacgctgtgcccactcttactccatgccgcttcactggcagtgagatccgccaccgtgatgatgctctaccttttgcccacgtggccattgcagtagagggtcctggc

SEQ ID NO: 541825 - DNA, 1088 bp, Homo sapiens
  misc_feature (685)..(685): n is a, c, g, or t
gagtgctgacactacaaggctcggatctccggcgcactcagtacaatcatgcaggttggtcctgtttgacccccggaacttgtaattctgctactctcgtagtgcttcatctgtcatttcttcgtcttcaagcactgatgatatcagtactgattgcctatcagcagaaggaagttgcatgcatctgacatgtaaatgaatccggtatgttatagtccaagctacctgtggcccttgcagatttcctgtgctacttcattcaaacgcaacagtaagcacaaggatctactagttctttcgtgagagacatcttaacactcagacgtctgaaatatgtagaaacattcacgaacgtcataacatgttgtagtacgatatgcacatccgatacttgcgactttagtacatcccttgagtgtaaatcaatcgaacagaccgaaagagtcattgcactaaggaccgtctaggcttagctttgtgcaaagatccccaggcaataaatggtcttagcaaggtaaaagtgtcatcgcacacattccattgagaagcatcggatgtgttgaagcacaattgacgtcgaagcttattccgagttcatttggcgatgtgcacaattactatcagatctcgatgatacatccacaagaggactctggttcaacgcataggaagagcagcataggtnagccctagcttgcaagcgacgagtggcccagcgaacccttgccaacaggaccacggtgccaatttccgatgatatcacttgcggcaaacgaattgtgcaatgaccattgcccaaattacagggggagcttaaccagggagctggcgcttcaacgtgttatttaaaaccgtctggaaaaggcgtaaaccccagcaaacttgcttcagtcttacctgtgtaaattccgatggcgtcctgggaccagtcgcactgggcccctggtggttactccacgcacggaagactccggattgggccattggtcaacatttccaggacccacactgggttcccgtgcttgagcaagggatctgggacattctgggctcctaactgggcaaacccaatctttggtgggaaatgg

SEQ ID NO: 541826 - DNA, 531 bp, Homo sapiens
  misc_feature (257)..(257): n is a, c, g, or t
  misc_feature (260)..(260): n is a, c, g, or t
  misc_feature (288)..(288): n is a, c, g, or t
  misc_feature (300)..(301): n is a, c, g, or t
  misc_feature (304)..(304): n is a, c, g, or t
  misc_feature (322)..(322): n is a, c, g, or t
  misc_feature (361)..(361): n is a, c, g, or t
tcatataacttatatcgtacagacgagggtggccctaattaacctaaactaagcgcttcatagttcttcaaactaacctccaattggtttatggctcacacctgttgtctttacaaattcctctacacactaaaacctcgcccctgaaccaccttcccccctttaatcaaggccattacggaggggcccacccactgccccaccgcatttggtcttcgaggctccccccttttgggaccggtccctaactccctcgnaancacttccctcattttacaacaattcagncatctcccccgnngcngggactcccccccccccncctcccccccccctgcaactttttccccccctcctctcncccaccttctcaattcccccctcctttcttcccctctcttttctcttccacccccctccatcttttttctcctcttactacccatcttatacacatctcccccttacattccctccctcttttctcacctacctttcctttcactctttctccttctccactcctctctt

SEQ ID NO: 541827 - DNA, 913 bp, Homo sapiens
  misc_feature (913)..(913): n is a, c, g, or t
tactttaaacctaacgactattcattgtatcatagcttgtgatgtattctgctcatggcttttaaggtaaatgtgccatgatccactgccattctaattgctttaacaagtcattaccacactactgttacatcttaattatgcatacagacaggtagacttgttttacatatgtgaactaactagttgtcaaagcaaatgcagatgtattctgcaagtaaagtctttttctctctgaaatttctagggatgttctttaagtgaaattcatattaaaactgaagattttagttacaagaactgagtgcagattaaagtctttgtgtgattcaaacatagtcaagagtacaactgtgatatttcatggaagttatgcaataaaatgtctctaacctgcgaacaaatctatcaagcagacggcacagtactgaatttgaaaccagaaatactaggtttttatataaatgcttcgtagatttgttttatgataaagggcacataactctcctaaacctcaacacctcttgaataggtataataagtccacatcaatgctgatgccttagtattattaaactcttacagtatgatgtcaggtggacacgtacaatgttacgatcattcccttagggccaactttgaccagtttatacagaaacatgtggccacttttctggtcgcaaggtaatatctcaagcaacccagaaagttttcttttgtgccttttcaaatcttaccttttttccaccccgaccatgtggttttctcgaaaataaattcccccttcttggcgaagccatttccctttggcgccacttttagggagggctcgctgctggtaacacccctggtgttaaaaaaaaaaaggggggcgtgaatcgggggggaggagtggtagcgggagcacaccagn

SEQ ID NO: 541828 - DNA, 340 bp, Homo sapiens
gaccacaacctggtcgacatggtgaaaccccatctctactactaatacgaaaaacattagctgggcatggtgacaggtgcctgtaatctcagctacttgggaggctgaggcagagagaatcacttgaacccgggaggcggaggttgcagggagctgaggtcatgccactgtactccagcctgggggacagagcaagactctgtctcaaaacaaacaaacaaaaaataataatacgataatgctatttgacgtgttttgtggttaatagtgattttaaatgcagttaactttcagtacactgaatatttccccagaaaattggaaacttcatatacttggc

SEQ ID NO: 541829 - DNA, 169 bp, Homo sapiens
ggtacttaaatacaaataaaagtatctagacatggtggcatatgcctgtgatcctagctgcttgtgaggctgacgcactgagaatcatttgaacccaggaggtagagtttgcactgagttgagattgcaccactgcactgcagcctgggtgacaaagcaagactgtttc

SEQ ID NO: 541830 - DNA, 400 bp, Homo sapiens
  misc_feature (10)..(10): n is a, c, g, or t
  misc_feature (67)..(67): n is a, c, g, or t
  misc_feature (135)..(135): n is a, c, g, or t
  misc_feature (165)..(165): n is a, c, g, or t
  misc_feature (195)..(195): n is a, c, g, or t
  misc_feature (231)..(231): n is a, c, g, or t
tggtcgtgtngaccttttaagtattttctggagtctttcttctttactttgtcttagaatcttttantttattatctttacttccagcttcttacttcgtaaatggagtggtctgtaaagcctttgggaatttantgtggtatctccttttgccagtggccttgntgggtaacccttctcatgatggttgggttncaggggagaatcagaagctttgagagtttaaatganttgcctgggctgggttggtgggtccattagagagagccagaccccagcacctgtccttactcccttccccaggcccccttgcttggctgcctgtctttgctcagcctcctcactcggggtgttcactggttctgccgtcgacgcggccgcgaatttagtagtagtaggc

SEQ ID NO: 541831 - DNA, 262 bp, Homo sapiens
cagtatatgtttaaaatgttactacaccttccatgtaactcagcactgaccactagacattatgattaaaaatcgaattcatattaaagtttaaacaatgaggtataaatttggtgtattttcatgttactagtcccttttgtataatttggcttaaagtgtatcatggatttttaacttcaaactcccccccacactcactaattgaggctaatcaaaaagcactttcgttgaaaagttgcaccaaagaaaggagaatttt

SEQ ID NO: 541832 - DNA, 101 bp, Homo sapiens
ccgggctctacgcacgaggggtctctgtaagcctccaggctgggcagcactcagcgtggacgtggagggggactgtttggagctcgggaggacgtcttcca

SEQ ID NO: 541833 - DNA, 311 bp, Homo sapiens
  misc_feature (68)..(68): n is a, c, g, or t
aattaaagggcaggctgggcatggtggatcacacctgtaatcccggctttgggaggctgaaatggganaatcacttgaggcggggaagttcgagaccagcctgtgcaatataacaagacccccatctctccaaaaaaaaaaaaaaaaaaaaaaaaagccgggcgtgatggcgtgtgcctgtggtcctagctgctcgggaggctgggatgggatgattgcttgagcccgggagtttgaggccgcagtgggctatgattgcactattgcactctagcctgggtaacagtgtgagaacgagaccctgtctcaga

SEQ ID NO: 541834 - DNA, 515 bp, Homo sapiens
aggggtttttcccaaacccccggaaaggtgtcaagagacccctttaatttccggcccccccccccttttcaaaagagggggttttggggccccccccaaggtctttgttcaggggactcttgggcttttgggggtgttaccgccccccctttcgggaaagttcccaggtttgttgcccaccgctccccttttaaacaagttggggtttttaaaatgcggggccccccgggggccccaaatagcccgggtcctatgggaggggggggggccccaaagtttttttcctggggggccccccggggcccccaggaaaccccccggaaaaacctcccccgggtttggtccttgggctccggggggtttaaaattaagggggggaaaaaaaaaaattcccccccccccaaaaaaccccccccccacccccccaaagaaattaacctgggaaaaacaactcccccaggttttttttaaaaggggggggccgagccgaataaattgggggggccccccttttt

SEQ ID NO: 541835 - DNA, 749 bp, Homo sapiens
gctggtccggtccggagtttagggataggttcaggagattctcctgcctcagcctctggagtggctgggaatacaggcacgtaccaccgggtttcactgtgttagccatggtggtctggatgtcctgacctcttatccacccaccttggcctcccaaagtgctgagatggcaggtgtgagccaccgcgcccagcaggactgattagttggtgtttttttttttggaaacggaatctctggttgctcaggctggagtgcaggggcgcagactcttggcttgacgtgcaaccttcttgccctcccgggtttcaagtgattcctccgtgcctcagccctcctgagttgctgggacttacggggcacaccgccaccatgcccaatttaatttttggtattttttagatagaagacgggggtttcaccagtttggccaggcggggtctcgaaattccgtgaccctcgagggtgatccaccgtgcctgggtttcccaagatgtgcgtggggattcacggcggcgttgagcccaccgcgcccggcctggggtgttcacccacttttaagaaggggcttcgaggcgaaacccacctttaagaatagttgagagttcttgccgtgccccataattattatcagatcctttcaaagtcccttcaaataaaccattaacagcgcgttgtggaaaaaacaaatatcaaagcaaaataaacaaaataactaaacaaataataataaacaaaccaagatgctg

SEQ ID NO: 541836 - DNA, 196 bp, Homo sapiens
gaaaataagtctggttaatatagaaggtgtccggagttcccgtcgtggcgcagtggttaacaaatccagactagcaaccctgaggtcgcaggttcgatccctggccttgctcagtgcgtgaaggatcgggcgttgccatgagctgtggtgtaggtcgcagacgcggctcggatctggtgttgcagttcacggagag

SEQ ID NO: 541837 - DNA, 145 bp, Homo sapiens
ccaagtagtaggatgaggaacgtcactgggatgaggaacgtcactgggatgaggaacgtcactgggatgaggaacgtcactgggatgaggaacgtcactgggatgaggaacgtcacttaatgcttatagtccggtctcaaatgct

SEQ ID NO: 541838 - DNA, 226 bp, Homo sapiens
gatcaccctgttcgggcttcctttacctggggggcttataacccaaaattacccaacctagggcggccgacttacaccttaaccttattgggttaattttatggtactccacccatcctaattaatatacattagttttccctcccggcagggttcctgggcaattgttggatccctttggacttaatttttccgcgttccaccaccaggctcccttcctccattt

SEQ ID NO: 541839 - DNA, 293 bp, Homo sapiens
ctaatatgtagctcgagcccatcataacatttgatggttattagtccagctacccattatgacagatgagacaaacccaggcactgaagtgttgaggcttcgcgcctggtcacttgttcttatatctaatacggatactggatccccatctcctcattatccagtgcagagctcattctactttgccctgcttcctctcatactttgtggatagctagatataaatcacatgtgtacatttggaatcttggaacaagtgcctttaataggccagtcctatggtagaaccgact

SEQ ID NO: 541840 - DNA, 443 bp, Homo sapiens
tggcctgagacgtgatcacgatgagtcggaagcaaaacgactcctgagctaatgtataagacacgaagtcataacaaacagtctcttacaccacagcacaatcaaattagaactcaagatttaaacattcactgaaacccacataactatatggaaatagaacaaccggggtccgtgaatgagcgtctggttaaataatgaaagtaaggtagaaatcaagaattgatttgaaacgtaatgagaagtaagagataacatatcagaagtcgtgggatgcagctaaagcatggttaagagggaaatttatagtactaaatgcccacatcaaaaagctagaaagatctcaggttaacaacctaacatctcaactaaaagaactaaaaaatcaagagcaaacaaaccccaaagctagcagaagacaagaaatagccaagatcagagct

SEQ ID NO: 541841 - DNA, 549 bp, Homo sapiens
  misc_feature (76)..(76): n is a, c, g, or t
  misc_feature (79)..(79): n is a, c, g, or t
  misc_feature (105)..(105): n is a, c, g, or t
  misc_feature (240)..(240): n is a, c, g, or t
  misc_feature (413)..(413): n is a, c, g, or t
  misc_feature (549)..(549): n is a, c, g, or t
tgagccggtaccgttagttgatactacagtgcacccaacttagtgatctgagttcttctgctcatgagccccctcnctnccagtctccctaagtcttgaaaggangtccttgagagcttccagccttcagccccacatgacccacattatggcagagggagcttcctgggttggtggttcctcctatgggagcttacctgggctccacagaaaggtgcctagggctgcctcaagaagggnaacaggagagtcttcatgctctagctttgtgtgaccttcgctgccttgtttctttcagatggatgtcgttttgaagggcgacaatcttcctcagtatagaggggtgaacattcggagattgctgtgagtatattggggggcaggtttatagatgtggggaaatcctccttgtncctgctttcctgcctcctcctatcatgaatggctagaatatcaatactgggtgggtcagagagtcctgcagccgctagggaacactgggggctgtgacacctttcattcttcattcattcatccactcaacacacn

SEQ ID NO: 541842 - DNA, 919 bp, Homo sapiens
  misc_feature (504)..(504): n is a, c, g, or t
cggacgcgtgtgggctgcgctttctcagccctgggaggaggcgcctgaacccagaactattttgcctaaccccaacctggtatgactcagccacttcttcacgaagttgcaatcttattggacgggattttaggtttccctcccttcccctatccatacagttgagaagtaattcagaagtaggccagtaagcagactttttattccgttattactatatgggagcaaaacagtgcccagtgccgacggtctttgtgttaatagtgcatatgtgtagctgcaattgagatgcagtggactagggctgcggagtgggagtcgaccggacgggctggacgggccgattgcattatcagctcaagttagtcacgtagacgaacctcgcgagcactcctacggttccccatggtgcaggcgctgtgagcattggttcttcactcccgtaaggagctggcataggtgcatggaagcaaccattaccaccaggtactctcgcattggatnacaacagcgtgaggtcacgaggaaggataaaaccaaacccataaggttcaagcaatcctcccgtcaggcaaagcgattatgggaaactttcacgacctatcaatgatacctgtcaacgggtccgcttcccagggtcttgtacgaaaacaaggaacctctgcatctcatgcactgacgtacgcccagtagaggtctcttcctgacccagacagctcctctctgagccatggtcctggcgggtatgggggctgccatggtgcgctcgagcccttctcctggggggcctgctgggcgaggctgacctgttgatccaccggtcactggtgtgttcagcccctctgctcggcccagctatttcccgcctccttttgagtgttccaggttttcaaattgcatttacctgcgcccgaaagtc

SEQ ID NO: 541843 - DNA, 95 bp, Homo sapiens
attcggcagaggggcctgtcccactgtgtgcacttgctgttttccctgtccacatccatgctgtacagacaccaccattaaagcattttcatagt

SEQ ID NO: 541844 - DNA, 666 bp, Homo sapiens
taaaaaccttaattaatcccaataataaaattttcggtttggttttttaaaaaaaaaaaaaaggggggggggcccccgggggggttggcccgaatgggcgatcttaaacccggggagggggggtgtgccgggggagcatcacacctcggagaccacaagtgttgactggggaaaaacgttgtcaaagagggccccttcaaaagtggcccaaaagagccaagtgctcttggggggcctgaaatgagacggcatacccccgtaagagtgaccgctggccagtggcgtagaaaaaaaattcgcaagaagactgaaaaaacaacaccttctggggcgaacgggtgtattaccacaagctgcacacagtaaggccccagaatggacaccgggggtgaaatatccccggttgggaccaaaaggtgctgcgctacaaaaagagggagtgctctcacgaagaagtcgcgtggtctcttaaaaagcgcagaggccccgaatgggtgcgccaaggctcatgtcttgggaaagaaggaatatccaagcaacaggtggctcaacaaaccgaaggtggcttcctccccgaaaagcggctggggggtgaaaacacgtccttgtcgtcgcgggcacaccttcacaatcaattcttgtcgggaaaccaaccacgattacgac

SEQ ID NO: 541845 - DNA, 230 bp, Homo sapiens
gcaccggactgtctgtcccaatgtctaacaaagtccggaggcgactcttcctgcgatgtctcagagcgctgtgtaaccgcccaaggggttcaccttgcctgctgtctagacaaagccgattcattaagacaggggaattgcaatagagaaagagtaattcacacagagctggctgtgcgggagaccggagttttatgttttattattactcaaatcgatctctttgagca

SEQ ID NO: 541846 - DNA, 212 bp, Homo sapiens
catgaagagttgtgaagagtacaggaggaggagcggaagaagcgctaatgaagagcaggaggagacaacaaagaggatactaagcgaggctaagaccgaggagaccagggcagaagaagattaagaagaagaggaagccaaggaggctaaagatgcccatggaggagaccaacccaagcccggtcaatctcccacttgtccaccagtaccat

SEQ ID NO: 541847 - DNA, 341 bp, Homo sapiens
  misc_feature (36)..(36): n is a, c, g, or t
  misc_feature (174)..(174): n is a, c, g, or t
  misc_feature (196)..(196): n is a, c, g, or t
  misc_feature (220)..(220): n is a, c, g, or t
  misc_feature (303)..(303): n is a, c, g, or t
cctcgtgcattattttttttaagagactgggttttnctctgtcacccaggttggagtacagcagcaccgtcatagctcactgcagcctcgaactcctggacacaagcaatcttcccacctcagcctcctgaataactggaactacaggtgcatgccagcagtcagagctagggngagtgagatggagtctcactcngtctcctaggctggagcgcagtgncagtggtgtgatttcagctcactgcaacctccacctaccgtgttcaagtgattctcctgcctcagcctcccaagtagctgggnttacaggggtgcaccaccacatacagctaatttttgta

SEQ ID NO: 541848 - DNA, 317 bp, Homo sapiens
accattgctctgatgctcgccatgacaatgcgaagcgttctttccaagttgtgagggctgcgcagacaacaggttggactgtgtcctgcgacgtcgatatgtgtttttgcggcgtttataaagagaaatatggctggcgttcacatctagtccttttggtgtgttgagacattcaaatgtgactattattactgctaacatttcacaaaaaaaaagctaagccagcaggctggtcgaattgcggcgtcggctctgtgcaacccttaacccggtcaattccagtgggagcgcttgtgtgccgccttaacggttgacgg

SEQ ID NO: 541849 - DNA, 835 bp, Homo sapiens
  misc_feature (192)..(192): n is a, c, g, or t
ggaagaaccaagcttgaatctgttacgcatgggatgataacctgaggacccccatcgggacatctcccatcttttgaaaaacctggaagtgaggagatgtgcacggatggctgaatgtttgggaatgagaggatgagatgagtgaggcttgaataacacgccagcattgaatatccatgcgctacaggcagncgagccagcaggccgccgaatcagacaagcgcatgttagatgagcgtgatggtagagcgagctgacgttcgatagaaaaccactaacatcgagtgcatcgttgggagaaagatgaaagagagccaatggtagttacttcatttaagaaaaacacagagaacgaacagtatatcgtcttccgcaggagaggttcagaagatagcttgttctgatctttttggccatgatgccagtaggtggatatgcctggattaggagagggaggaggagggactaggtgttcagctgtgggtgcgtatggattggatagagacaggcaagccatggtcctattgctactgcggcagaaatatggagcctgggtctcaaagcccagcttcgctgtacctttgccgaattggtcagtgtatgtcttggcgcaggtaagaaagggagggtcatggggagttagattacaaggtcgtgacgaatgagtgtggtgtcgagatgaaggctggtatgcacatgctcaaaagttctagggatcatttgagggtcctgttatcccaagagaaacgagggggtaagatgtggcattcgataaaagtaatgagaagtgtctgtctactggatgcggggaagcagatgtaggagaaacaaaaaa

SEQ ID NO: 541850 - DNA, 105 bp, Homo sapiens
tgaggacccactaagttttgatgatgaacttcatatgctgagtcatgtcggaattctgcatccatcttcacttcagagatgtcctacgtcgtgatgacactcttg

SEQ ID NO: 541851 - DNA, 1010 bp, Homo sapiens
  misc_feature (31)..(32): n is a, c, g, or t
  misc_feature (36)..(37): n is a, c, g, or t
  misc_feature (100)..(100): n is a, c, g, or t
  misc_feature (115)..(115): n is a, c, g, or t
  misc_feature (161)..(161): n is a, c, g, or t
  misc_feature (171)..(171): n is a, c, g, or t
  misc_feature (183)..(183): n is a, c, g, or t
  misc_feature (193)..(193): n is a, c, g, or t
  misc_feature (196)..(198): n is a, c, g, or t
  misc_feature (202)..(202): n is a, c, g, or t
  misc_feature (204)..(204): n is a, c, g, or t
  misc_feature (206)..(206): n is a, c, g, or t
  misc_feature (208)..(208): n is a, c, g, or t
  misc_feature (211)..(211): n is a, c, g, or t
  misc_feature (220)..(221): n is a, c, g, or t
  misc_feature (225)..(226): n is a, c, g, or t
  misc_feature (277)..(277): n is a, c, g, or t
  misc_feature (287)..(288): n is a, c, g, or t
  misc_feature (294)..(294): n is a, c, g, or t
  misc_feature (297)..(297): n is a, c, g, or t
  misc_feature (304)..(304): n is a, c, g, or t
  misc_feature (334)..(334): n is a, c, g, or t
gcgaatctcaacgctgcgccgtctgcgggcnnttcnngggccaccagtttctctgctttccaccctggcgccccccagccctggctcccagctgcgctgncccgggcgtcacgcntgcgggcttagcgggttcagtgggctcaatctgcgcaggccactcnatgttgaccnagcctctacagnggcctcccgngcnnnccgngncncncangccgccgcnngagnnaaggatcgggaagcgttcgaggccgagtatcgactcggcccctcctgggtnaggggggctnnggcacntcntcgcagnacaccgcctcacagatcgactccaggtggncatcaaagtgattccccggaatcgtgtgctgcggctggtccccccttgtcagactcagtacacatgcccactacgaagtacgcactgctatggaaagtgggtgcaggtggtgtggcacccttggcgtgatccgactgctatgactggctacgagacaccaggcagggcattcactcgctggctccctcgcagcggcgcataatgcaccgcccaggcactcctctcagcacgtatactcagcagagcaagcggccccacctgcgcgctcgaacggcccaacgaacagacatgacaacccatcatgagcacaaatgtacgatgcgcacgcctactacctatcaacctgcaccatatcccacgttgcaatgtatcgtcgccactacggatagaacccttcacaatcgcattcgacacaaacagcatatcccttggattcagaacattaacagtcccaggtggggcactcgctgcccccatagaccttcacattcggaacgctacctagcggttcctatgcggctagcctcccttgatctatccaattgactaggcaacgccctcttagcgtctttaggccccttttctgacaatggggcactcaaggcggcctgcataccctgtactccttatcaagaaaatgtgggcaatacctactcacgagacaacccatgtaaca

SEQ ID NO: 541852 - DNA, 1553 bp, Homo sapiens
  misc_feature (294)..(294): n is a, c, g, or t
gatgtcggctaacggaggcgatgtgagggcctgcgtgcgaatcctcctccgtgcgttccacgaggcggctagggcgcctgcggtggcccatgccgcggctgtaggtgcagcgtgcttgcagtgccttccacaggccccagaggcggaccggccttgagtaagggacttactgacgacgcgtggaagttcgatggtcctcatgcggtagtctagcttcggcgctgcttgcgtgctcgaagtacgacgcgttggacggcagtgctgtacagtgacggtgactctcgagctttcganaccctagtctagctggtcgtatcggcgttgctagcatgctctcgtaggtcctttgaatcgtgccctcttgggtagcgctacgataaatctggcagcatggctataggggccagacacagggcacagcttggggcaatagggcgaaagcatacgtagaacgagtaccctcgggggttggtcctacccacttccctagcgttatttctagcttctagagccacaaggttcggacgggtcggtagccgtgccttacgaacgccccagcggcaaattccggggcgctccttggcccacaagccactagagggtcgattcggtcggtatagagcctcctcgtcagctttatagggagaagctcacgtctgccactcgggtaatatagccgcgcataatgtccctagcctagaaactttaacacaagaggtaacgcgcgtcccgcgccattcgaggagaacttgcaccggctgataagacagcaggacccgcttagcaggaacgtcggcacgggttccgctaaactcatcccagttgggtggcatattcctccaattcacattattcccgcaaaggcgtattacgcagtcgcagcacagcaacaaagtgcgtcattccgggcttgcactttaggggaggcacatagcgcggtcgcgagataccactataggcggccatcaacgtaatccagctatcacgcgcgttctggagtcccgtagagacgcggacaacccgcgttacccaggtcttggtgtgcacatctcagctcaacgtgaggtccacagtgtaggtatttatgactgataagtaatcgtgctgccacgcgcggttcctacttatccccccgtaatacgaatcccgttttagcggatgatcggcaattcacatcaaagctgtagtctccatacgactatcccgggtgcacgctggaaagacaaccagcatgggcggacagttgcaacttggcgagcgtgtaacaatcgtcctaggtgcaatatacatgctttggtaagcggtcgttagtgctcatccgcgctacagaagaagtgtcgtgcgggctccctgtgcgtgaaaacagatcccccggtgcgcagctatctggtcccatgtgcgtgcgagcatcaccgtatcacccactgccgacctatcaccgcggctcgagtgacttcccctctcacgattgcgttcgtgtaatcggtgagattccgagctcctttttttgacaccggataaagtgcctacatcaaggtagattataacgcgct

SEQ ID NO: 541853 - DNA, 144 bp, Homo sapiens
catgagccagcacgcccagcagagtcctgttcagttctggagaatgtagtatattagactagcacttagctatgaatgtccaacaaatatttattgctgtttctcaactttaaaattttaaataaatctgtgtcccatcaaaca

SEQ ID NO: 541854 - DNA, 872 bp, Homo sapiens
gctcaaagtaagcgtgagcggagaggatctggtacgccgcttcagtcgctccctgaagaataagaagagtcggggacctcctatcccagttacattccagaggatgagggcgtctgatagctgtcggagagtggacgcgtttagcttgttgccgaatctgcccccagtcgatcggtactggtacgacccctgtggccatgctggacatgcccactcgtgcgagagcgaagaagacatctgtccagcttgcagctttgcatatggcgaagaaagcagccgggaaaggagagaataggcgatgaagtccaacatacgatcagcacatgaattgaggaagggaagaaaaccaaggctgaggctcctctgcttaactcagacgcgacttatcacccagagtgctctgcaatcgagagctccccactataacaggttgctgctcagccggaagtacagaccagtaagcccctggtccctctgtctccctttcccctatgccagcctcagaggtcgaaactccaaagtgggaagatcagtagggaacctgaagctgcggctggccacgaggccgaggagtcagcaactgtcatcagcccctgaacgcatgagcgcccacaaagaagacgagcccgtggaccattatctcagccattcgaagctctggatggatcccagatggacgaggtccgaatgggctacaagatgaaaatgttgagtttgactctgatgaggaggaacacgtggatatccccgtgggcttgatacccttttccagtcattccacctaattacaagggtgttgaaacttacaacaccacaaaggggggctcgtaaaactcctgagggccaattaggggcccccgtttggcaagggc

SEQ ID NO: 541855 - DNA, 236 bp, Homo sapiens
gcgtggatatctgcactcacgacatgcgtaactcagacactcacccaagtctaggtccaaataccttggtcttataagatttatttctcacattttatcaaatgtccaaaatcgtggaccaaaagtgactttcgaaggtaagatctgcattagagtggtatttccgttctaaatacctgaatggtacttatttttatttaaaaggacagagttccgtgccaagtaggcgtgtgaga

SEQ ID NO: 541856 - DNA, 556 bp, Homo sapiens
agtgccacacatatacacaatggaatattattcagggctgggcacagtggctcatgcctttaatcccagcactttaggaggccaaggcaggaaagtcacttgagctcaggagttcgagatgagcctgggcaacatagtgagccctcacctctgcaaaaaataaaacaaaaaattagccaggccgggtggcgcatgtctgtagtcccagctactcaggaggatgaggtggcaggatcgcttgagcctaggaggttgaggctgcagtgagccaagattgtaccactacacctcttggtaacagagcaacgactccgtcttgaacaacaacaataacaatggaatactattcggccactacaaataatgaaatcctgccattcgtggccaacacggttggtactggcaggacatcatgtcaagcaaaataagccaggaacagaaattcacacacactgccatgtttcttactcatcatgtggcagctcacccaaccctgacactcatggacgatcagagaaccaatcacgacttatcagatcactgcacaggacagcgc

SEQ ID NO: 541857 - DNA, 350 bp, Homo sapiens
  misc_feature (34)..(34): n is a, c, g, or t
gcccctgccccccagcctggggggcagagcgagnctccctctccaaaaaaaaaaaaaaaaaaaaaaatttttcccattgagcctgggggcctggtccccgcctctaatcccagccctttgggaggctgagatggagggattccttgagctcaggagttcccaacgagtttggcccacatggtgaaaacccctcttttctaaaaatacaaaaattagctgggggtagtggcgggcgcctgtggtcctagctacttgggaggatcccttgagccctgaaggcaaaggttgctgtgagccgagattgcccccctgccctccagcctgggggactgagggagactccctttcca

SEQ ID NO: 541858 - DNA, 243 bp, Homo sapiens
tcacaactgcacatgattgttgtaatcatgaatgtatatgttcatgtaaataaatgtcctcaattacaactcaaaaaaaaaaaaaaaaaaaaaaaaaaaaaaaaaaaaaaaaaaaaaaaaaaaaaaaaaaaacctcttccccccccacccccccccaccaaaaaaggggggggggcaaaagggggggggtttagggggggaaacaactttctctaagcgccaaaaaaacacccccccaaatat

SEQ ID NO: 541859 - DNA, 111 bp, Homo sapiens
cggtgctgtactctatcagcatgttcatatagtcatcttagcactggggataaatacacaataagacatgcttacttgttagttttatttttttgagactgagtctctctc

SEQ ID NO: 541860 - DNA, 306 bp, Homo sapiens
  misc_feature (217)..(217): n is a, c, g, or t
  misc_feature (225)..(225): n is a, c, g, or t
gaattctggatcctcggggggggtacgaggaagattccaggaggaggtgaatctcagcagcatctctgagctggagcaagagcccacttccacaggccaggagtccctttcccagcccggcctgtcttgactcaggggtctgcaggctgtgctcacggctcctccaacatggccctctcctggctcctctgcatgaaaaagaacccacagggctgtngctggaanccttctgaggtcagaaactgagcatccttgcccctccacccttcctggcccaggaatgcatgcacacggatggatccagaa

SEQ ID NO: 541861 - DNA, 824 bp, Homo sapiens
  misc_feature (312)..(312): n is a, c, g, or t
  misc_feature (451)..(451): n is a, c, g, or t
ccaggcagcaaggaccccccagccgcctcgatgtggtcccaccaaagggagaatgctggaagggtgtgagagaccctggcacaggtacaccagccaggacgccctgggcgccatgcaccagacgaaagaggaaggccaagagccagtgcccacagttagcccacccaggagggccaacccggtgtgtacccccgagggcgccatttgtaaggaggcgtgcttgcccaagttacttccgatggcccattgcctgtccgtccaagagaccctggccagatgtaaggacaccacgcctggggtctcccctgaatnggatcccagctcggaccacgccagatctcacacgcgccgcgtgcttgctctcaacatgaccgtgcccagatgccaaggctggtggtcgaaggagatactatcagaggtgctgtgacaccacatgctctgtcgccatccntccgaccaagtgacgacgaccaacagtccaggcctacattccaaccggggcaagagccccacagcggcccgtgtggaatagccccgagaggccccggctgactttgcccaaagtgctggagctggaccccaaccctggcgcctgtggtgaaccgagaactgcgggccctggaggcacggatccggccagaaggacgaagaggaccaagacccggttcccggggatcttctccccttgaccggagcacttggccctgccttacctgcccagccccctgctgccgctgcccagcccccctgcccgtgctgcgtcatgcttctgtgtatataaagccctttatttatctcttacgcgaagaagaaaacacttcgag

SEQ ID NO: 541862 - DNA, 826 bp, Homo sapiens
ctctcctataagtggcttcccctttgggcccccctattgtcttgttattgcgctgctatcgtagtacgctggtgcaacgccgcccgcagtagggtaattctgctcgtctcgggccggccgcgggtatatgccgtcctgtgtgtaataatcgtggtccgccgtattgctgtgtgcgttctgttgcgccggcaccgtacggtgtgcggtcgtggttaagataacaccgaggggcgggtgaagaggtccccctcgcctggtgcttgcagaaatccattggggcccccccatgggttcgtgagacccttccgggtggttcccccgtttttcggcgggataatttttgttcccacggctcgaacatattggtcccccccccgttgtgtcctcgtggaccaccggcggagcacgtggagtctcctctgagcgcgtgacgccactggcgggttgtttctccccccgcgttgtgtgcccccctctcgggtataatatagtccctctcgccccagaacgcttcttggcaccttcactgggccgtgcccccaccacattagggctttaaaacacgcaggccatgtgcccgcgagcgtttttaaccccaacccctgttgtcccccgcgcaacaccgccccgcgggggtatatactaccgcgtcacaagcgtctctcgaaaattctggtgggcccaaccccacctttctaatcccctctcttccttaaagattatatttctcccctaaaaattcttttaaaatatgggccccgtatttttccccttatatgcccccccctttatccccctctttatagagagccctctataaaaaaaa

SEQ ID NO: 541863 - DNA, 692 bp, Homo sapiens
  misc_feature (67)..(67): n is a, c, g, or t
  misc_feature (70)..(70): n is a, c, g, or t
  misc_feature (74)..(75): n is a, c, g, or t
  misc_feature (77)..(77): n is a, c, g, or t
  misc_feature (83)..(83): n is a, c, g, or t
  misc_feature (91)..(91): n is a, c, g, or t
gtcgtgcgtgcgtgcggtcggttgcgtcgggctgcaggagaagatggcggtctccacaggagttaangtncctnntnaatttncgcttgtnggaagaacttgaagagggacaaaagggagtaggcgacggtacagatagtctggggctctgagagatgatgaagatatgagatcttacaaggtggaacaggccgtgacttattgcgtccacgcaaggagcaaattatgaaaaccagaatatatggccggaaagtagaatgtgggacctaaattaccgctagaagctcatcggtcagttcagattgtgtagaccaataagattaatatgaacgtgaatagaataattccatgtgggatggttggagtgcccggagcatacgatgtgttagcaaaaatggccaaagattgcatatagcattaaagtgtgtgacttcaatgagctaagactgtctaatgatgtcgcaaagaaagatatgagaggttccatagtgcagagaatggagcaaactatacgacaattaatttaaagtggatctcaaactgtgtcttaacatgaaaaaaccttctactcatgttaatgtctgtgattgaaatatcactaattgcaaatacacgttaagtggaagaattccaggtggtaaacatgacctggcatttgggaggactatatttatatatgtgccccaatgtgg

SEQ ID NO: 541864 - DNA, 918 bp, Homo sapiens
acatgtggtcttgcacactttagcggacatgagtttttgttaaggctctttaacgcctctataatccacgcttccctgccaactttttacacgcctttctgaaaattttcccatacacgctgggtatctgtaaacgcgtgtgcctaacacggggttttcaattctcccaagggaaaatattaaatttcccccactacagcagtgtgtgcgaacatgtaaaggctgaacactcgtgtaaagttccgccccctcaaacacgatggcgatgccctcctagctaactacaatatctgggcttctaaccactaaatcttcagcaatactatgggttctagtccgacaaaaattaggccctaattacaggcgagattggcaaattagctttcctaaattctgaatgactgcccaatgccgatccccctctgcttaaactctacagaacccccgtctttgttacgccctatagcgtccgagattatccccttctataaattaatcgccacttacccctttgtcgacccgtggttcgcatcaatcaatcccccctacccgtttatagcgtctattccaaagactctgtcactaggatcagacacatgaatgccccacatctattcctcaatggctccaaaaaaggcgttctccaactcacttagccttttcacgacacgttattaatacttttatgagcaatttattagtcgtcactattcaccggtgtcttcgaaggagctaaccccccgccttattaacatgtccccatgcgccccatttaatatcacacagcatgaggaataatatctttgagtacaaagtaatacaaaatgaacggattctcgccaaatagtagtaattcactaggcatatcaattattttcggttacaaaaacccgttttgctgggacataaaaacaccac

SEQ ID NO: 541865 - DNA, 299 bp, Homo sapiens
tcaattcagttttcatgagctgcctctagtaatttttatacacggattttggtctcttggcgaattttttactcacctttagttgcttttagtatttacatttctctagcttaatttatatttgcatgacatgaaagatagggaagaaagttgtcagctaatggcacttgagttttttatctaaaaaaaactatgataaaatgttgcgatcgctgctgtcaagatgactgaaaagtctttgagattgccgaataaaaacagtaagacaccattgatatctacttgagaaaaacatgtca

SEQ ID NO: 541866 - DNA, 906 bp, Homo sapiens
  misc_feature (906)..(906): n is a, c, g, or t
gatgacacagctgatgtttacaagattgaaagagtctcgctccgaaaatcatggtaaagaatactgagacaatgaaaaaaaatcatcaaaatatgctttgctggtagaactgtaccttttatggtttgcttgcagatctagtatgtttctgcatgaaggtgctgtcataatgatagagatttccagagagttttgtgttctccatgattagaacgtggtaggccaggatattaaatattggtataagaaataaaaagaactggaaccggattcgaggaatcgtgaaaacaatatttttagcaagcaacaaaaagaactatattaaacatgggtttacgggaaattataactgaactatgagaagtacaatttgttatatgtatatgtatcaatatttctatagtaggattttatagcctctagtggggaaaaataactgattccaatgacattcattttgtgtttcatctgtgatgagtcatggatgcttttattttccttggtggtgtgaaattgagctgaaaaaagaaaggtgtttgaatatagttttaatttctctctacagttttgtggttggttgtgggtgtggaagtgtgtgtgatggcttctccatgtgggatcttggcatgtgtgatctcagtgagccaatgggatgtttcgggcccctcgggtcactgggttcgattgctgtgcgccccccaaatttcctccctttgattctccttgacctacgtgttgtggatacccgattctgcgtgttccccattgttccgccaatcgtcttggttgtcctcacaagccgcacgaattggggtcgggacacaccgggcgggcggccccacgctccgggtatacgggccggccgggcgaaaaagccgccggggcgtttggcactgctgccccgcn

SEQ ID NO: 541867 - DNA, 291 bp, Homo sapiens
aggttattttggcagcagtgccatacctgcgtttgcagtctacgtcgagcgctcccccgttgctcgtgagtgttctgtctggcgtagttgagctgggtactctcgtccattactgccccatcgacgtgtttaccgaacgctgttttatgatgctcttcttatatctgtccccttgtgtaaaacagtggctgtccatctccacctcattgctggtctccggagaggaagcacctgtttctagctggtatgtctgcggaccaccctcagcgggagcttcttgcaacctgctcg

SEQ ID NO: 541868 - DNA, 171 bp, Homo sapiens
tcctgtgcctaattttcgttacattattttatttgcataaatatgcatgcgagaaggtagaggaaaatgtggttgcatcttgtagtggtctaacagaaaaaacagatgtcctgagaactacaaacaaatcagacaaagcccacatgacatcttagtggactggaagatcat

SEQ ID NO: 541869 - DNA, 257 bp, Homo sapiens
ccctaagccccggggaccactggttgatgatggcgttcaccaggatcctgcatgagggtatctcgcctgctgagcaggtagtatgatctcgaaggcctgcttgcacgatgcgcgcagtcatgagcttcttgccgttgttgcggccgtgcgtcatcatggagttagtgacggcgctccacaatagtgatcactgaggctgttgcggaagcgtgaggcggcaataccgctcctgcacggtgaggaaggtacttggaata

SEQ ID NO: 541870 - DNA, 303 bp, Homo sapiens
cagacactgaccaccattgctgctgagaaaaactcaacaattgtcttccctctgcccatagatatgctgcaaggaatcataggggcaaacacagccatctaggctagtgtagagatgagcgctagctttccaagcatgagtcggggacaaattagcctttaactcataaagagagggtagggctttcttttccatatgtcatgtgggttccagatgtatagcagttataaaataggtgaagattgtagctgtaatctgagagattggatttataaggaatcgtagctaactagtaaagttgat

SEQ ID NO: 541871 - DNA, 290 bp, Homo sapiens
agacaatgaagttcatccatgttaagaaatatacagactcctatgcaattctttgcacctaacagcttactataaataattaactttaggggaaaatatttttaataaaacacacatacaatatacacacagatatcaatcttaaatagaattattactacaaggagtggtgtgtcaattgtgttaaagactgttacactggaccacgctttccatattcaggaacttgtgtcaatgctcccctcccacagaaactgggcttgcccttgtgacttgtttagattaacagg

SEQ ID NO: 541872 - DNA, 907 bp, Homo sapiens
gggcgttcccggcgctcggcaggccgcaggatgtgcctggtcccgggccgggatgcccatgcatggccgggagctggtctgaggccacagccccgcgggccgggccgcttccctccggtgaatcatcgctcggcagcggcggctgcccgccagtgtgcctgttagcagtcgcgccgggccctaggctcgtgggccccagccggagcggctagctgctggagtcggaccccggacctttctacttgctgctagttactggcctgcacgggaccagcagtgcatggccgaggcatccgctgtgccaaagcttggcgaagggacccggtgagtcgcgtggcacgatggggagcttggagctacaccaacggaagatggggccattcaagggatagcgcattccatagcccacgaggcacctaacgcgaagggctggcttggcagggaagagcggcagttgtccctggtgagggcccagggtgaatcagcttcacttttcccaaggggaacccacggttgcagttttcaccccgtggcctaattgcgcgctccactttcgagtggcccacttgtgtgaggaccttttccctagagggggcaacggctatttgggggtgatacaccatgtaagcttttccccaatggtcgcaaaaaaaaaaaacctgcgcccggaagacagggagatagaaatatccgggacaaggcggtggcacacaaggcggcaggccccaccccgccaaaggcgtgggcagagagggaaactatccggtggggaacgggggacgcctttagggaaaacgaaccaacccccacacaaaaaaggagtgatagtagcaaacattcgcccacatacatcatgtggaggaaaacggcggggcaaacaggagacccaccaaaaaacgacacacag

SEQ ID NO: 541873 - DNA, 159 bp, Homo sapiens
agtatgggcatggtgccaccaccaggtctgataatgtgtcctgggagccatgcccatcctcataggtctgtctcattgcccaccatcaggacacccttgtaggctgtggatagcgggaaagcatctccgggccatgggttggctggggatgaggacagc

SEQ ID NO: 541874 - DNA, 1083 bp, Homo sapiens
ggcgtgctggctgaggtgacgggccggactgccctctcgtgacggctgcggcggagggcaaaatggcggagtgcttcggcgtgccggggcggactcgggcgccgctagtagccgaccaccggttatttcttgccacttttgcaagggcgaggtcagccccaaactaccggaatatatatgtcccagatgtgaatcaggcttatattgaagacgtgacagatgattccagagagagcgagagtgagagcgagagagtgagtgcatgagcttgcacaagagagggcacgcacgcactgcggagaggacaagcgactacgacaacacatgggcacacatttcgccacacgtgatactcatcacccacatgctgcgtgactccgccactgactcctcgatctgtctgtcgccattccaatgctccactctgtaccgcatgtcagagctaccctctggtccacacacgtgttggtgtgcgcgccagcgacggggatacgaaacaagtaagcgacagaaaaaggaaagttgatggcagacgccaaagcgggaccagagatattgggacatcgacagcgcactgaccccgctcaaacgcatcgaagaacccctagaactaaagtcccggcatgtcgcaaactggcgaacccacggaataacgaagacgccccacatgcaacaaggggagatcaaacaacgaagaatcagaagaggagacatcactggggcgaagcaaagacccaaccaccgcagctggcccaatggaaacgaggcaaaccagcacgaatcaccgaaaggaaagctacccgggcaaacgaacaagaagtctccccaactataagaaaaaaaaaactaaccaaaacaaaattcataaaacaaaagaaacaataggacacaaaagcatgacagtgcaaggcaaacacacgaaaagcgcattaagaacctggagagggggacacccatggacaaaaaaagacactgcggaaacacaagaacaggaggaaacggaaaagggctcaaacacaagaaaacgcaccagaaataaggacacacaggcaaaaaacgagcacaaacaaagagaaacaaaca

SEQ ID NO: 541875 - DNA, 765 bp, Homo sapiens
caagcgccttctccgcacacggaaggcccacccaccagaagccgaagatgtcagcaggcgggccaagagccaagaccaccaggaagcggccacagcgggccacatccaatgtcgttcgcaatgtttgaccagtcccagatccaggagtataaggaggcttacaacatgattgaccagaaccgtgatggcttcattgacaaggaggacctgcacgacatgctggcctcagcgtggggaagaaccccatagagcagaatacctggagggcatgatgagcgaggacccgggtgcccatcaacttcaaccatgttacctcaccatgtttggggagaagctgaacggcacggatccccgaggatgtgattcggcaacgcctattgcctgcttcgacgaggaagcctcaggtttcatccatggaggaccacctccgtggagctgtgtcactcaccagtgggtgaccgcttcacagatgaggaagtggacggaagaatagtaccgggaggcacccaattgatccgaaaggcaagttcgagtacgtggagttcacccgcgatcctcaaagcatggtcgccaaggatgacgacgactaggccaggcgaggagctgaagaacgccgaggaccacaacgacacagagtacacgtggaaccagaccgctcgcagaatcgatgtccatgtcaccacctgcacaagagggacaatgcgtgaggacgaaccggcccaactcctcaacccatagttggacacgatgggcctcagacggcag

SEQ ID NO: 541876 - DNA, 146 bp, Homo sapiens
ccccgttctggagagagacagcagagtgctgatgcatgaatggaagtggggggtgggctgtgtaagtggccggatgggcagtgcagtgaaatgctggaacctcactaagtgggtgaaatgccccgtgcacgcaaaccctactgggt

SEQ ID NO: 541877 - DNA, 599 bp, Homo sapiens
cgttacgaacagcatactaacaccaagctgccagagtcctggatagtgcaattgtgtttaaagtgtcactgttctagtgaacacagcttgtcaggaacaaacactagaacgatttgacgtagaggctgctggtcaccttttgtgacctgaggaatcccaggcctgtgtgaaaagcaaatcttcacattgcagcacatgatgccagaaatagcactgaatcaagaaaatagccattgcggagctgccctctgtgagtcttgctgtccatcccattctattctgtactgtgacttcagttcaggaagtgtggtgtggtgtttaaaataagaggaaggagcaatgttgctcagtcaagtgatcagatcccgaatcttagatccccagttctaaggccttatcacctcccctgcccataggccaacaaccatagtccctcacattagtgattagcagactctttgtggacgagtgaatttcacaaacagcacaatttcagaagaaatcgagggcacaggccctcacttttcttcttttgacgcatcatcctgtgatgttgaactgtcgattgcaggatgctgatgttgtgcacgtcaatcacc

SEQ ID NO: 541878 - DNA, 257 bp, Homo sapiens
gaagggacaccatcaggcctctggctgaggcagtaccataaatgatccatttctacctgcatttcccagaggactagcaggaggccgccttgagaaaccggaccttcccaagccatcgcctgcctggtctctcattgtcactgccctctgcacaacctctcctctatcccactagagattgcctgtagactgcctcttgactgcttgagaatgcaggtctggccctcaataaatgcttcctgcattcttctgcctcc

SEQ ID NO: 541879 - DNA, 297 bp, Homo sapiens
agtaaagggcatacatttcctgctttcaccaattaaccactgaattgctattttttccctttggccagatagttaggtttttggttcccccccagtaggggttttcgcccaagattagggtccttttggaaagaatagtttcagtgtttataggatagatgggggaagaatctagttaaatttgcatttgggtagttggtccgcccgccctggttatatactcagggaaaatagatttggagtttctgtagccatttctgttaatagcaacctttccttaaaaaagtctgtttatca

SEQ ID NO: 541880 - DNA, 1166 bp, Homo sapiens
tttgatgttgtcgtcgtcgggttttgtttgctgggtgcttgctctccttgctcgtttgtatctgtagcacaccgcttgtgggaatctttttggtaggtcgcgttggggtcgtgtgttgccaacattctgtttcttggtcccctggttggtactgcctcggtcgttttgtgcttatacgcccccgtttttatttcccggtggctgcttccgcttcgtggtatcctcctttgggggtgtgctcttagttccgcgttagtttcccccgattggtttgtagaagaaaattcttatagggtccattggttcttcctagtgttaccgtgtgtgccaatacatgccttattaccgttgccccttaaggtaaaagtgtgttggggattagtgaggtcacaccgcatgaccatataccccaaggccacagggtcacatcctgtagtcaatattttaaagttttgggaattgtttttgtttgcctcctatatcactggaataaatggtaaagaggctgaatgttattactctaaggtggatttcttatgcaccgtaatatcagacatatagaatgtactttgttttactatttgtaagataccaaggtatatcaactgacatacatcagcttgaaacctgagataatgctaaaatgttctaattattttaaatgtttaaagaggacaaccatgtaatgttgctaaacatgaaaaatgtcatcaagtggaataaagaatagctgaaggtaacatttgggggaaattgagctgaaaaccaaaatatgagtattttgataccttttctttaccatgagactcttgactatgaagtcaaatttatgctaaaggggaaaaccacggaatttctgggaggaacctcgtggtaaaacgcacgagctatatatgcttccctcaatggtggagagtgactaaaattaaaaatacggttaaatgacgttttcctcaatgtaaaagcacttgaagtaaaatgtgttcttttaatgttgcacgagaaacactagtgtgcgttctagagaggagtcaccctttttctttaatgcacattgtgaaatacgcacgtctcgcatcctaagtttaaaatatttgagaatcctctatgggactctctgtaaatgttttaaataactgttgttttccaataaatattttatacta

SEQ ID NO: 541881 - DNA, 373 bp, Homo sapiens
tcgaaacagacagtggcacaaagcgggcacaggctggtgctacagcaaaacacattccctactttgagacccagtggccatgagggccatcaacgtgagcaggcgtcccgacgattgccgggatgcacatagcaggaaacgggaggtggagctgtacacgaattcctgaaacctatcagactggacaagaatgaccggggccaagggctcggcagaaagctgcagttgctgagggggcagtgagagttgagcacagagtccttcacaaaccaagaacacacgtaggccttcaacacaaattcccctctcctcttccaaacaaaacatacattgatctctcacatccagctgccaaaagaaaaccccatcaaac

SEQ ID NO: 541882 - DNA, 704 bp, Homo sapiens
gacctgatatgtgccatacccattacctgatttatgtgaaggctagttcgctcagactatcaacctagtctaaacataaggatgaagctcgtgaaggtaaagagcaatccgagtgtacctatgaacatcacagttctgatcatcacccgtgaatatcggtggagtcaatgagtaatcgcctgtcatccagctcgtctcagaacagcgcccttcagttatatctaaatccacttgtcacttcgtgactgacctcacaagatacggactgaacagaacatctcttggatggctgcggtgactccatcaataaacacttaatttgacaaacagatagtgtcagagttatctgctgacgataatacctgagcgtcttatctgctaggaaagatattgcgtatgtccattgataagactgaatagtaggcaggaataaactggttcaggctgctgaatgaggtatgttcgcaggttaggatgaaggaattctagtctcttattcccataagctgaaaagaaactccctgacatggctaatggagtatagcataggtgaactatataatacaggcatggttaagaatcaggacttgagaagtgatacgatcaataaagtcacggatactggctcattgaatccattggagggacgtcttggtccgggatttgcctaagcacttcctgacatattggacgataatggtagg

SEQ ID NO: 541883 - DNA, 1588 bp, Homo sapiens
  misc_feature (365)..(365): n is a, c, g, or t
  misc_feature (813)..(813): n is a, c, g, or t
  misc_feature (1588)..(1588): n is a, c, g, or t
tcggtcctggaatacctttttggcgaggtcacatataattctggggttataaaccttggaccgcgcacaccggggagggttccaagacgctggtaaaataaccaaccggtggggctcatttacccttatttggagtgtttaagaaaactcttctacaagtgtccggggaccattatggtgttaatgtgcccactttaaacatgagacacgcgtgtgagagacagaacagagatattttatcacagagcgcctactcttatctccaagagaggagtagttttacacatatgtggcgggtggtgcctttcacctgcgaattcacacacaatattctcaaacacccatcttctcccacacctgtgagnggcccttgagagaggcgagagtgtttctctctctttctccgctgtgggacactgtgagacacttcactccacagagagcacactctcagaggagggtgtctatacagccaaccagcggtgagagtttctccactgtgagaaagagccactatagacacagacacagagctcctcacagagtgcgtgcgcgtgtggacagacaaacaaacccgagacagagggcgcacagaaagtgtgcgctgttggggctgcaaaaaaaaagacacacacacctctcacacacacacgcccgtgcgggcgtgcgttgcgagacaccccacaagacgcagagcaccaaattttttctctctgtggggtgtgtgtgcacatttctcgaaggatgtgtgtctttttctcccccagcagaggtgtgcgggggggccccccggggtgtgtgtgtctgtctccnctctctctctgtgtgtggaggggagagcgcgagggtgccccccacacccgaggtgtggcgagccgggggggagccccacttcttctgtaacaacgaagagtaatagacaagaacgagagtcgcggaatcaatagatgccccaagcgtgcgccgcggagtaccaccctcaaaagagggggaaacaagctggctaccctcttgctgggcggggcgcgccaccccccaaaagtatccgccgatgatgaaaagctgcggggcggtctcgcgtgggggtggaaaccccccccgagagggaaacaacctctttccgtggggcccaactaaacaacaaggcttccaccgaagaacaaccgaccagggtagctcagaggggcgcagtatgagcggcacacaacgatccactcgcggcggagaagctctgcgtagaaaaccagcccgctgtggcgcccacacaaacaaagagagtgcggctgcccccgtgggcagacagggcaggggtggggcccacactgagagaagagcacatccttttctgggcggcccaacggaggtgtgagaccagctggtggagcagacggagtgtgtaacacaccagagcgaaacgagggggccggcctacaagagaaaagcccccggccagggagcacccacaggagagccccacgcaacacgtgcagcttgaagaagtcagcgcgggcaaacacgagcactccgaaacagaagaaacaccaacagcttcggagagaagagaccactcaggcacacgacatattan

SEQ ID NO: 541884 - DNA, 483 bp, Homo sapiens
atagtgagctagtcgtcacggtttgctggctgcgctgcggagtgagctggtgtgtccctgattctggccaccactgtgcagatacctggtccagcccagcgagggggcaaaagagcccatcctgacacagggcccctggaaggggcagccacccaggcacaatggctttgggctggggcttctgttaggaaagaccctgtgccagctgcctttcctctagctatgagtacgagagggtcccgcacccttccgagctctacttccccaaatttgcgtcctaatttctctcctctatccctcaggccagctctctccctgccccaacaactcacaccttgtttagttccctatagtatctgctctcccgggctcgccaaagggctgcccagctgctggagtgtccatgtggccaagactcggggcctagctgtagatgcccttcctggggtgggggcaggggggtgagagtgcctgcctgtcgca

SEQ ID NO: 541885 - DNA, 947 bp, Homo sapiens
gttgtcgcccgtgctgtgtgtcctgtgctgttctccttgtctggtcgttggtgccggttctccttcgtcctgcttgctggttcattgtcccttttcgtcgctgcggccctttttttgtcgtgcttgggggtttgccctgtgcggacctcctctgtctttatcctctgcatcatgctgtacgcatcctcagatctcctttgttgttctacgtcctgctcctcttcgcccgtactctggttctggtctttcaggctcccgcttcgttctgtttgccacctttctgtttgcttcgccggcgtcatggtcgttctgtgagctcatgtccctcctttcttccgtggtatctctatcgtgctttgcttctcccctttctgtccggccttcgtccagccccacggtctcggctgccatctgcatgtggctcagatatccgatggagctgcttttaccccccataggggctcatgttgtctgtgttcctgccagcctcatgtgtctcgcttctgccagctcgcttcccctaggacgggaagggtgcggctgtgcatctgggctacaatgccagctccacttcgtgcttccttgcgctatcccccaccccctgaccctccagctcctcctggccctctcacggtgcccacttctgttgggcctttatgcctctagaacctgcaggtggtgggtggctggctactcaagaaggaacagaggtctcttggggaggagtctgggtggtccagccctgatgattgtgccccacctcctgctgccccataaccctctcttcatgtcggctcttttcatttaccctcatttagagccattatcgcagatgactttagaaagatttacagtaacgaatggattcctatataaagatgattttgtataatcttcttgcagcaaagaaatgaatattaaccgtgttacaggattaaactgctctt

SEQ ID NO: 541886 - DNA, 187 bp, Homo sapiens
gtcagtctacgatagcagtctaggcaggtctctctggatgacacccaaatggcacatggggcaacacttacttgactctctgagccattctgctcgctctgtgaggacacgagggaaaaaatgtgttttcctagctcttggaagtcagcactgctggagcctcctccctgctggagggggccgcgcg

SEQ ID NO: 541887 - DNA, 141 bp, Homo sapiens
tgggcatggtggacatgggggtggggtggtctggaggcctttctctcttttcgagatggagcacccgcgaggcaatcttcatcttgatggtgctgtttggacccgagttactgagctggaagcgctggcctacagcacatg

SEQ ID NO: 541888 - DNA, 446 bp, Homo sapiens
ggctttgcaagatcccttgtcagttgcttctctgtccctccggacacgcagacatgctgtgaagcaactgccgacactctgcaagtccctgagcgaggatccacgctgggagacatgaacgcgctggcaaatggcaagtcgtgtctccagcccatgatgcagagacacatacaccccacagcacgcatcactcatggacacccagaccctcaaagtcagcgtggaccccactctcttcaacctcccagacccatcccagcccaaagccttctccctccaacattccttgaatcagatgaacgtgcctccatgcacagcagtctacacctgaagctgccctaaacgtggactcatccattcctcccataagcctctcccgggcccgggcccaactaccccttgcgcatgacatagccatagaaggagtccaggatgcacttgtgggc

SEQ ID NO: 541889 - DNA, 174 bp, Homo sapiens
gtacagatactaccggtctcaggcagtctgatgcttgatcaagccagttagataatattcattacactagtccagaatcttctgtttgtcctcatctgttaatctctgccttgcaagtttctcatcgttcaaccagttgcttacatgttgacaggcataggactcaagtgaatt

SEQ ID NO: 541890 - DNA, 802 bp, Homo sapiens
  misc_feature (18)..(18): n is a, c, g, or t
gcaggcttggtaccgccntgggataatgggatcgcagctgtgaggcccggagcgcctgcgggggctggccagagtgctttttgagtgttgctgtggtaggaatgggcggactgcgcgcgccccctgcgtcccgcgcacctcgagggccggtccatgctcccgacggctgcgggcttcagcatctgggtgccaggttggtgggcgtgctgggtgtccagtggctgcaggtgggtgctggactgatgcgcctggtgcctggaggctgatgtgcctgcgctgcggtggcttggtgacagcactggcatctccagagcagtgcccgtgtggccagcaaagggagtgccggcccgacgatgccagacagaaaatatactatcctgtaactgtagccacaaccgtcatcggttaatagcccggatttgtctatcgaccgatcatatacattatctacattcatagcccatgaatgcacaccctcaaatggaacatccatccattactaacactgctacaagagagcacatgctaggaaaagcataaacaagagatgaggacaacagcctaggaaatcagacaggcataccaataataatcaaaaagggaaacaccccagggaatatatagagaggagcccagatgcactagagaacaagatagcgattgaacagggagcccggcattgcatacaccaaaacaatatagtggccataaggatatgggggtcaaaacaccgttgtgcccccatggagatgaaacacccacattggaatagacccaaacagacaatggtcacatttcacag

SEQ ID NO: 541891 - DNA, 337 bp, Homo sapiens
  misc_feature (90)..(90): n is a, c, g, or t
  misc_feature (186)..(186): n is a, c, g, or t
  misc_feature (198)..(198): n is a, c, g, or t
  misc_feature (219)..(219): n is a, c, g, or t
  misc_feature (241)..(241): n is a, c, g, or t
  misc_feature (264)..(264): n is a, c, g, or t
tcagtgtccatgtgtcaatttagggaagaactcaggtactgtttgggtcatatatatagccctggccagttgctcttgccggggtatggnaaactgattagccagcttctgtcatctgtagtgacataaaagtagtgacccttgatagctttctagtccatgtggattctagagaagggaatattncagaggaaacanggggcaccaaaacaacaaatntcaagtatccatgttaagacangggttttttctttcccctatggnttaagggccagtaagaaggtctttttaaggacagtcagttgtgaattgaaggggtaatcccggttttcagctt

SEQ ID NO: 541892 - DNA, 270 bp, Homo sapiens
  misc_feature (93)..(93): n is a, c, g, or t
  misc_feature (120)..(120): n is a, c, g, or t
cgtctgcaagctgaggcacaaggaagccaggggtggatcagtccgagtccccaaacctcaaaagtcgggaagccgacagcacagccgtcagtntgtggccaaaggccgagagcccctggncaactgctggtgtaagcccaagagtccaaaagctgaagaacttggagtctgatgttcgagggcaggaggcacccagcatgggagaaagatgaaggcctgtagactcagccagtccagtccttccacgttcctctgcctgtttttatcctg

SEQ ID NO: 541893 - DNA, 783 bp, Homo sapiens
aacaacctatttagctgttccccaagcttttcctccgaccccctaagaatccccctcctaatactaactacctgatctcctaccgccatcacatatcatggtcaagccaagcgccacattatccagtgaaccactatcatcgaagaaacactctagcctcgtctatactaatcgtccctacaaagtctccttagattataacatgcgacagccacaggaactacatcatataatatatcattcttcgaaaacgacagcatgatcgcacctaccttgagctgatcatcagcccgatggaggcaaccgaggcgagaagcgcctgaagcgcaggcgacatacgttcctgatgctaacaccgctagtaggctcgcttcccctactcatcgctactaattgacactcacagacggcctaggctcactaaagcattcatactaactcagcatctcagtgcccacgaactagtcgagacctcctgagccacacaagctgactatgactaggcgtccaccatagcttcgatagctaaagatacctctttagcgagactccgctgtagtgagtccactaatagcgcaatgtggaagcccccatcagctgggtcactaagtacatggcccgcaggacctcttgagaactagggcggcacatggtataatgacggctcaggactcattctcaaacccatgaacaagacacattagccaacacccttcctatggacatcccgatgaggcctacataccaccaagcttactctagctacgaaaaacggactaacag

SEQ ID NO: 541894 - DNA, 382 bp, Homo sapiens
tccataaggtgtgccaggcactagcagcacacctggctagtttttatatttttagtagagacaggtttcaccatgtttgtcaggctggtctcaaactcctgacctcgtgatccgccagacctggcctcccaaggtgctgggattacaggcatgagccaccgtgccccgcctctttttttttttggagatggagtttggctctggtggttcgggcgggagtgcatgggtgcgatcgggtgtcgctgcagcgtctggctccggggttcgaggcattctcctgcctcagaataccgagtagtggggataacgggtgccctccaccactccgggctaatttttggcatggtaagtagagacggggttttaccatgtgggcacacat

SEQ ID NO: 541895 - DNA, 175 bp, Homo sapiens
gacggcgacttactggctcatttgctttcaataaaaggatcaaagcagccaaaatcaatgtttcacccgccgtcgagtttgaatatccagaatcttttgtacttcttgttggttaatttgtttatttttgtaaaaaataaaataaaattagttaataaaatgatgtttcacagca

SEQ ID NO: 541896 - DNA, 304 bp, Homo sapiens
ggacgaatcacggcggtgtaagggcgatatagtaccaggggtgaacggaggacggtggaagggagtcatcagagtcaccgagcggtcgcagcgctacatcgatcacccacggtggccttcctccaggggttcggcggctacgggagccagtaattctccggctaaaatatctggtagcatgcaagttaaggaatactgagcccaagcaccaccccaagatatatctcctctatggaagtcagttccaaccaaaagtaacagcagtctttccagctggggttcgttcacaatctcacacagatga

SEQ ID NO: 541897 - DNA, 1228 bp, Homo sapiens
gggacaagttagagtagaataatttttcagacgccaagtgcagtacagagtttctgcaaatacagacaacaaactgcattgtcagggcaatggatttgaccagtggggctccaggggtcagtccattggtaactaatggcaccttactggcaggactggttgtgactgcagcgggacgcattgcccacatttgacgcttttccttttttcaccaggggacttgcacgaccccgctgttcggggcgacctggttttggtgggcactaacactgtaccacctggcctaccttcctcttctctctcttctctgcctccttcgttccggcgcccctgcgcgccgttctcccccctgcgcggcccgtgggtctgcccttggcggtcgcccctgcttctgcgcgcgttccccctggggcggaaccctgcgtgcgccttcccccgggtgttctcaccgtgcgggccattcctgtcgcctgtcgtcctcccgcctgcctctcgggtcttgccgtttctccgtcggggctctttgtccgcactcgcaggcgacacacgcggtgggttttcattaccctcgtcgtcgtatgtgctgtctttgcttacctgctggtctcccgtctatccgcccttgttgtggtcttgtgtccctatttgcgttctctctccgcttcagtagtcttccctgagcctcctttttcgcccgcggggttggttccctcgccacacctccggcgtcacctctgtagccctgtgtctccctcctgctacgcctgcctttctccccgccccgcgccggccactgttgcgcgccctctcaggcgcgctggcctcgtcgcttgttccttgtggttttgcacccctttttctcctccacccccccccagtcgggcgctcctacctccctgtcctcgttgtcgtctcttgcgtgtagtccgctcctctgcgtcgttgctgactacccctggctgtcatagtctcccggcgacactcctcttgtggtggccctccctccgcgcgccgcgactcttttctcgtacctctctcgtcgtcgccgcacctttcttgttctgtgtgctacgacgtactctctcgtctgcttgttctgtccacccacagtgagtgtgtgtgctctcatctgcgcgctcttttgtctatcgttgggtgttcctccttcctctactgacgcttgtacagtgtatttggttcgtggcggctcagtcttcttcgtattatg

SEQ ID NO: 541898 - DNA, 149 bp, Homo sapiens
gccactaaactccccacagtcagccaacattacaaaaaagataggtccatcatcctcattgaatttccacaaacctccccaatcacaagtattctcagtggacgtacgaactcacatttcacagatctcaaacttgtcttcaacatcta

SEQ ID NO: 541899 - DNA, 258 bp, Homo sapiens
ttagaatcgagctcggtaccgccaccttatgccgggtgtgttggggacattaggtatggctggtgggcggggtatctcaaagaacatcggagatgtcagagagactaggaaggcgagaaccttcgggaatttcacagcggctgggaatttcaggaaggttgggcacgtcaggaattttggtaaggcagggaatgctgggcatttcagctgcaatggaactttcgagcccttccaggacgtggagtggggaaggccccc

SEQ ID NO: 541900 - DNA, 217 bp, Homo sapiens
gtacagtattcgaacttgagctcggtaccagtatctattccgtgatctcattgcgtggcacaagtcttggttcttagacgcgggactcgcgcatattatgaacgtttctacatggcactagaaccttggagagcattatcgtgccatgttaataggaaatctgagatgatttattagaggaaagttaaatgggctgagtggaaaatgatgaatgaag

SEQ ID NO: 541901 - DNA, 304 bp, Homo sapiens
cttgctgttgaattctacagatgacacaaatgaagtttactgtgcccttaataccaggttgggctaccaaacgctacatggctcccgttaattgctggacgatagcctgaacaaataccacttccagccctacttcatggctgacatctacagcttcggcctaatcatttgggagcatggctcgtcgcttgtatcacatgagggatcgtggtagaataccatttgccttattacaatcttggctaccgagttgattcctgtctttacgaatgatatgcgtcaggttgtgtgtttctacgtttgc

SEQ ID NO: 541902 - DNA, 683 bp, Homo sapiens
caagatatggggctatttcaggtctttaaaatacttaggttcaaaaggaatggttgttttattgaaggactaaaaaaggggaaccaaagttcaccaattcgacaaagctaggtggatttgaaaaaggattcaattcgaccttttagaccaatatactagtcactgccattggaacctcaaaggacgagttatgggcccgtttaaatgcagttaaaaggagattcagcaccttagttaaattcagtacgttagaaggtttatgattaaggagaagtgccccaaaattggttaaaagcagatcctttcttgggataaaggaatccatcttttggggtaatatggacctggaggaccttcattctttagggggactttaatccattacggttctgatccgtgctatataataaagtcagcctggcttgaaggttttggaacatgggtatgtggaggcccttaactgcaattgtcatatatcgttgccttgggaaatctcatttgcgggggatctaagaggagcaggatatcaatttggatccagaaagtccttgtcggccgcttggacccagccacttttgaactcggccaggtttagcatgccgcccgaattcggcttactgtgccaatcggcctaaggtggagcggttaccaattctgcccgcctttttacacgtcgggcttgg

SEQ ID NO: 541903 - DNA, 140 bp, Homo sapiens
cacccaggcgcacttctggtaccccatctaccgtcgacctctgctcatgacatcatccccaaaaaacagcccagaaacccaaaccatctcaacactagctgactcattgtttctcctattttctcctttgctcaaccgga

SEQ ID NO: 541904 - DNA, 110 bp, Homo sapiens
ggaggcgaacccctgaccccagcggacgccgcgcccagccttgatcccccaaccccgggggctggcatgagcggccctcggcggcaccgtggggggtggagtcgcctccg

SEQ ID NO: 541905 - DNA, 884 bp, Homo sapiens
agcggctggagctctctcggcccggcaggtttcgctcccgcccctccggccttccacagctgtcctggccgtcagggtgttcaaggcgggacacaccaggcgtagagatccagcgatcgggccccgccgtcaggtactagcgctccaggcctaggcggagcgcgggagcccgtaagcagctcagcatcccgagccaggcgggctgtccaggggcacttccccgtaggctgcattcccaaaggtctcccgagggcgagggctcatgatgtcacatccgccatggcactggtgacgctcctcgataagtgctggggcattgcgacggggtgacatcacatgctatccggcgcccgtgatgtcataatagcctgtaagttgctatattacatggagcgatggcgttatttgcaagttggcaatgattgattaatatgtgtcagaacccgtaaagcgtgaggaaattaagttgggaatttatgtaaggcacatggcagatagatggttgttccagtcctagtagattgaatgtgtctcagattcatggcagagaaccatagggtccttggactgtcagagaagggtgggggacagttactcttctatctgatgagtgaatgaacaagatgcattgggtgcttagaacatgtgagctgccagagccttaaacgtaacgggtgattattcatgtaatatcgaccactgacttgtcacttggtaggactgggccctgtgcgaaggctaaatgagacaccaggagaacacaatacacttctcattcttcatgactagccttatgagggcgcattataaggcattccagtcatacccatttgcacaaatcggagaaacctggggggctgggtgcttattccttggaattaaga

SEQ ID NO: 541906 - DNA, 117 bp, Homo sapiens
cccgagccgacaggaaggagcagagctgtcgaatacctggatgcggctgttgccccagtcagccacaatgatgtttccattggagtccgacagctactcctgtcgggctagtcgggg

SEQ ID NO: 541907 - DNA, 304 bp, Homo sapiens
  misc_feature (194)..(194): n is a, c, g, or t
  misc_feature (286)..(286): n is a, c, g, or t
  misc_feature (295)..(295): n is a, c, g, or t
agaggatcccctcgaatcgacggtttctcctaagttcgagataggaactcagtcagccaggccctaaactctttcctgtgctgctatggtgccgtctctagagcagagctgtctctagagagtcacagcgacaccttcataataaaatctgtgtttacaggccccgggagcagcggctcacaccttctaatccnttagctctttgggagcacccaggcgcggtggattcacttgacagccatggagttttgagaccgagccggggcaaaacccatgtctctacaanaaaatacanaatattagc

SEQ ID NO: 541908 - DNA, 330 bp, Homo sapiens
gcacacccgggctttcttctctacccatctagggactacagcccagaagaatgcataccacagcacacatgcatgagtaagtcacgactactctcgctccccatgatatccagagcatcacctcaatcatttctatgattctgattaccttaaaactgttacacatgtagtcccagcactttgggagactgaggtgggaggattgcttgagcccaggagttcaggaccatcctgggcaacgtagcatgacccgtccctactaaaaaaaaaatttaaaaattacctgggtgtggtggcatatgcctgttgtcccagaagtgcgcctgggtg

SEQ ID NO: 541909 - DNA, 201 bp, Homo sapiens
gagctcgcgcgccgacattttaattggaaccatgtatctctgggtagctacaaaattcgtcagggatttcatttggcaggcatgtgtctgagcttctataccgactcagggtcagtgtcatctttgtgtttagttcatccaagggtgttaccgtggtttcaatggaacctaacctcattatttgtgtcttcagtgttggct

SEQ ID NO: 541910 - DNA, 167 bp, Homo sapiens
cactctagaggaccccgctactagtccacggtgctcttttttttttccacggccttcccttaacggggaggtgtttcaaaggtggtctatcaaaaggttcagggtttcccttttttctgcaatagcttggacatcggttctggaattctagccaaccggggactagg

SEQ ID NO: 541911 - DNA, 479 bp, Homo sapiens
cccccctagaaaggcctagacggaagtagtgtagtagaatatactaacctatttgtgtagtaatataaaaggtggtaagtcatattttaggctaatactagtgtcatgtaaaatataaacattatgaaggctaactatgatatggtacataattccaggaaaacctgctactggatattactatgaaatatacttacctgcttgtatggctataatatggcttgacttctatatagactcctttctccatctgttttgtaagaggcacaagaggtcgtttgaggggcatacttgtacctttttgtttattttattaatctttttgagacagggtctccctctgtcacccaggtaagagtgcagcgttgtgatctcggctacactgcagccttgacttcctgggttcaagcaatcctctaccctcagcctcctgagtaactgagactgcaggcatagcgccaccatagcctggctaataa

SEQ ID NO: 541912 - DNA, 293 bp, Homo sapiens
gggtcgtaggctgagatttgccagggagcagaggagctgcgagaatggcgggtataggccctgccgggttatgcggctccttcaggtatctccgtcacagcggcagactcagataattctgtgcgccagattacctcctagtagaaccaccacatcatatggtccctcttttttggcatcttcaaggctggcgtcaggacaaatgaccacatcacggctagactgtactgggtctattccagccaggccgtgcaacggtgaccttaatcccaggtcgcctcatgtcatacatg

SEQ ID NO: 541913 - DNA, 210 bp, Homo sapiens
cggcggcccgtgttgtgttttgtgctggggccccgcgctaaggcgaccccctcccccggactgacttttcctataagcgcttctcttcgcatagtcacgtagctcccccccccccctcttcctgggtctcccgcaagttttatactctaatatttatatggctttttttcttcgccaaaaaaataataaaacgttttttctgaaaagcca

SEQ ID NO: 541914 - DNA, 263 bp, Homo sapiens
  misc_feature (75)..(75): n is a, c, g, or t
cgagcgcctagcacttcccaccccggaggaagacaccaagtgtccgccacggcgatgactgcaatcacttggtcnaagggtgacttcaactcctcaggctgacagtgaaagggaggcaagccctctggggagttctgtggaaccaggcaccgaagaaaaaagtttaatcagtgataaaacagctgaatggattgcagaggatgatgatgacgtgtttgtggcttcacgcacaactgaagatttatttactgtgatacacaggt

SEQ ID NO: 541915 - DNA, 762 bp, Homo sapiens
ggtcttctcgggttagattctctcaggttgaggcgagaaagggatacccccccccgaaggaagtccttggactctgtgtgtttttgcctcgcgctggatcccgcttggtcccggagtgtttctgtggaaaacccctaaagattagcctttaagaaaaggaattagaagccatgtttcggaagaccctgtattaccggtacttcctccctttgtaagacactgagtccgaaaccactacccgtttggtttcttgaaagatcccctgaatcgtgtggcacacttaacttgggcgaatgggtcacggaccccgttcttgagacccgcgtggaaggaaaaaatcccagtccccataattttctcttacccaactaatgagaatttggccgatccggggataatgaagtttacccaactgggtgatctccagtccaaaagacccaccatggccccagaatatccgtattccggcccggcctcagagacctggcataatccaataatagtgaaaaaggggtctcgaatttatttggaagggaaaattagacttatggtgaaaacctggataaaaataatgtgaggcgacaagcaacccccaatcatagctgataatattatatttctgagtgacccagacgaaagagaaggagtagaaaggatgattctttcttttggcccatccatttggtcaccagtcttccatttcccagtcatgtataatctttatggcttcccaggaccagaacctcaatacttttttacgta

SEQ ID NO: 541916 - DNA, 159 bp, Homo sapiens
ctgataagacgacagaagggacagactccagatgctgcaccttaagagctgtaacactcactgtgagggtccgcagcttcattcttgaagtcagtgagaccaagaacccaccaattcctggacacaataggactctggtttctaaggggtgataattgc

SEQ ID NO: 541917 - DNA, 145 bp, Homo sapiens
  misc_feature (9)..(9): n is a, c, g, or t
tccctaagngcgagcaaaaaacaaaacaacaacaacaactaaaaatacatgttatagaaagaattcagagtctcggggacagtttctatctacttttcctttcgccaatatagaatagggctatggtataattcaaatatattac

SEQ ID NO: 541918 - DNA, 125 bp, Homo sapiens
gcaagggaggcagaggcacacggaagggcaggctaggcccaggcctcagcttctgaatgatgggctgatgccagccttggctttgggtgaggcctgtcccgggccttgtcctgctgtggcctggg

SEQ ID NO: 541919 - DNA, 90 bp, Homo sapiens
actcacgtgttggctcagtaaagatattaatattcagtgaagtattatgtctgtcttatcctttgagtaacaagatgctaacacactttc

SEQ ID NO: 541920 - DNA, 532 bp, Homo sapiens
gccgggcgcggtggctcacgcctgtaatcccagctctcagggaggctaagaggcgggaggatagcttgagcccaggagttcgagacctgcctgggcaatatagcgagaccccgttctccacaaaaaaaaaaaaaaaaaaaaaaaaaaaaaaagtgtgtggggcgcgcgcccgcgggcccccgcgagagagagacctttcagaaacccatgcgcgggggggcgcgcggggccccagaggagggataagaggagacaacagtgggcgccaaagagcgggtgttcccagagaggagaacaccggcgggcccagaggaacagagagggcgcgggggatctctctctcacaccacaatataaaaaggccccggggggggggcacaaccgagagagcggttccgtgagagaacaaaactccccagagagagggggagttcacggagaggggcgcaaaacgaggggggagacctctaatacaaacgagggggagtccacacagaggggaagaccccgagaaataccaaaaattaaaggc

SEQ ID NO: 541921 - DNA, 155 bp, Homo sapiens
  misc_feature (23)..(23): n is a, c, g, or t
  misc_feature (115)..(115): n is a, c, g, or t
  misc_feature (120)..(120): n is a, c, g, or t
gtgaacatgtaaatataaatctntcagccactacagccatcaaacgagagcatctggaagaccagccagcttggaagttttacagcaataatgttgcagtggaatattatttgtngttanggtcatcctcctcccctttctgtttttttaaatca

SEQ ID NO: 541922 - DNA, 130 bp, Homo sapiens
gaaagattggggtcatccaaggacacaggttcagaagcatatcatggtggcagtgatccaaacccaggtatgtcatttcttcctcaaaatcccattggctgctctgggctgggcagtgaatatggctgaa

SEQ ID NO: 541923 - DNA, 772 bp, Homo sapiens
gccgaggtgggcggatcacctgaggtcaggagttcgagaccagtctggccaacgtggtgaaaccctgtctctactaaaaatacataaatttagccgggcatggtggcgcactcctgtaatccaactgtacttgggaggctgagggcaggagaattgcttgaagtctgggaggcgaggagattgcagtgagccgagatcggcgaccacatgctactcctagaccgtgggcggacaggagtgagactcctgtccccgtccaaaaaaaaaaagaaatcaagaaggaattccactctcctaataaacggcctaatggtgattcaccgcagatgattatttgtaaggaccctggtggttaatgatttccgagttccagaagggttgacgtttgacccggagtatactttccatacttggcggggctaaagaagaaaaccgcccaggggtgtgttatggaccccgccgtgggacttgggcgcctcaggtgtgcattgtgttgaatttgttcttgttctccatctggtcccgcctctgtaacacgggggttcgtactcttgggtcaattcgcgcttcttagacgcgtggtctatgggtttacatcacaagaaataatggtgggatgacgtgggtcggccagataagatcttctggcttttgcccaactccacaggaaatgcgttcaaggttaatgggacgggagagtatcccgtttgggtagaagcttcgaataagggagggacaaagcaaaggggaacattcttggctcaagaaggcg

SEQ ID NO: 541924 - DNA, 193 bp, Homo sapiens
ggatctctacacggatccccaatcatgggggtctggagagccaggtgtttctcagagaggttagagaatacctctctttagtctccagcgtgcatgcctcctgtaagcactattactgttggggagaggtgagtttgactgccatcttgtgctagttatgactccgacaggtatgtgtaggagcttcgttctg

SEQ ID NO: 541925 - DNA, 819 bp, Homo sapiens
  misc_feature (54)..(54): n is a, c, g, or t
  misc_feature (82)..(82): n is a, c, g, or t
  misc_feature (88)..(88): n is a, c, g, or t
  misc_feature (92)..(93): n is a, c, g, or t
  misc_feature (97)..(97): n is a, c, g, or t
  misc_feature (109)..(109): n is a, c, g, or t
  misc_feature (143)..(143): n is a, c, g, or t
  misc_feature (148)..(149): n is a, c, g, or t
  misc_feature (162)..(162): n is a, c, g, or t
  misc_feature (172)..(173): n is a, c, g, or t
  misc_feature (213)..(213): n is a, c, g, or t
  misc_feature (215)..(215): n is a, c, g, or t
  misc_feature (230)..(230): n is a, c, g, or t
  misc_feature (234)..(234): n is a, c, g, or t
  misc_feature (242)..(242): n is a, c, g, or t
  misc_feature (248)..(248): n is a, c, g, or t
  misc_feature (253)..(253): n is a, c, g, or t
  misc_feature (269)..(269): n is a, c, g, or t
  misc_feature (280)..(280): n is a, c, g, or t
  misc_feature (284)..(284): n is a, c, g, or t
  misc_feature (286)..(286): n is a, c, g, or t
  misc_feature (289)..(289): n is a, c, g, or t
  misc_feature (310)..(310): n is a, c, g, or t
  misc_feature (324)..(325): n is a, c, g, or t
  misc_feature (375)..(375): n is a, c, g, or t
  misc_feature (482)..(482): n is a, c, g, or t
  misc_feature (500)..(502): n is a, c, g, or t
cagcagagcgacaccctagaccgggccgtagaggcgccgatgggcctcctgagngccgatgtggtcagccaactcgtcacantccggnttgnnctcncacatcctcccncctgggccccaggggatccgggtaggggactggngcccnnagacacccgacgnggtggcatcnncccccgtgcaaaacccccatcccccccctccctacacatngngctccaggccgcccnccangccaggcngcctgnccctncaccacaacccagacncgccactcccngccncngcncccccacagaccatcccgganacgcagggccttgnncagctctgccttttctctcaccccagccattgatacaggtagcgcctggntctcttcactacctcgctgccctcctgcttggacacaaaggctgcacctttgctggactctgcaccgctgggcttcgcacctgcaaaggaaaggaagcctggttcancccagctcatccccaggnnnctcatcctccttcccctgcgtctcgggcagcttgctcttccctcctctccctctgcaagggcagagctggggcaaatggattgagcctgcaacaaggtggttagactgcaaagggactgccagccaaaggggtgagaagaggtgggccatggtgcttcctcctctcagcccccactgcaatgcggcctggggggaggtgggggcactcacctgcctggccagcgatgcaaagtgcggccagggccaatagggcgaggagtgtgagggctctcatggtgtctcggtggctgcgctgggctgctgctcaggactcagct

SEQ ID NO: 541926 - DNA, 308 bp, Homo sapiens
  misc_feature (45)..(46): n is a, c, g, or t
  misc_feature (133)..(133): n is a, c, g, or t
ctacacgatcttatgcttgggggcgaactgcaggcagcgacgtanntccaggtctccgtgcagcccaacttccagcatgacaagttcctggggcgcctggttcagcgcggggcctcgccttccaactcgagcntggctccgggagcaagaaggcggcgttgtccaatgtgcaagctctgtggtggcccctgccacgggattggtggccctcaaccctgaccctccacctttcctcagggaaacacccagtgtgaggacccgaaaccaatgctggctgaagcccgggggggctcccctcgggctccaaa

SEQ ID NO: 541927 - DNA, 327 bp, Homo sapiens
cctggcttgctcaggtctcccaaagtgctgggattacaggcaagagccagcacatctggccatgtccacgcacagttttgttggtaccagaagtgcagaggggtactcggagcctctaaggccctccctcttaggagtgcctggccctttcctaaacaggagggtccacttccaggagccttatgtcttgggcaatgctcctcggcgctgttggaatctagcgccctctccagtctgacattggccctgaagggggcctgataattgaagagcacttaacttttcctggctctaagtggcactgcatggcctcacctcatcagtcac

SEQ ID NO: 541928 - DNA, 288 bp, Homo sapiens
gacctaagttgaggaacaactaatgaacaattattgtattgaactattgttagatacagctaatcacacatacaagctgacgtgcacaatgtacctcattcgcacacgtagcatccttcaacaggaccctataaaactttcctccagcccttgcctctttgcaggtagccccttctctgctgagctgcccactgcaacatattttcacaatttctctaataaatctgcccttctttacctacaactatcttggtaaatggctttaccacctgcaaaactgaccctagg

SEQ ID NO: 541929 - DNA, 714 bp, Homo sapiens
cggtcgcgaagacgcattagtatgatatggctgtgggcttgtcatagatagctcttattatttgaaatacgtcccatcaatacctaatttactgagagtttttagcatggagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgtcagtattttattgaggatttttgcatcaatgttcatcaaagatattggtctaaaattctctttttttggctgtgtctctgcctggcttgggtatcagaatgatgctggcctcataaaatgagttagggaggattccctctttttctattgatgggaatagtttcagaaggaatggtactagttcctccttgtacctctggtagaattcggctgtgaatccatctggtcctggactctttttggttggtaagctattgattattgccacaatttcagctcctgttatgggtctattcagagattcaacttcttcctggtttagtcttcagagagggtatgtgtccaggaatttatccatttcttctagattttctagttatttgcctagggatgttggagtattcctgatgg

SEQ ID NO: 541930 - DNA, 952 bp, Homo sapiens
ggagtgccatccacctgcccaagaaaatgcaggaggtggtgaaagactggtagccaggatgccgaccactagccagtggagatgctgagcccggccatgagaggcgagacctgcccatccagtggtcaaatgccatgtgagtgccctggcgagcgggagggcaccgccatgggtgccctggtcgtacactcgcatgtcacagggccagtggctaatacagacgaggcaatggcgcctagactgacgaaacgagagctctgaagacaaaagcatgctccctggacattgacgagggacctgttgacatcagccatcaatggacttgtcaaggtccaatgctgaaatgctcacagaagcagtgtgcagtggatgcccagtggctgcgtgcaggaagaacggtcaggttcatgccacagcccaagacgcacttcttggagcagctgggcgggcctccggagagactggaaagacaggggcccgacagtgctgaacgagctgcctctcctaagtacaagagacgacagtggcgaggtgtcctgtggaagaaaccccccagtgtctttggcatagcacggcagagaggatgaggcacggtagcggtgccagcagagccagtgaacgcgatgacccttgatccataccgtggtgcagtgaagaaccgtactccgaacatctgcacattccgacagcgggacaatacaattccaccatggaaggtcccaagagaccaaagctcactagacccgagatcacatgatcatgtatgacccgcccaggttacagctggtacacggtcgacgacagtgcatctaaaacgggatgcttcacgcaaattttagggcgggcacgcggccagggtactccgtgcagcacgtctagaacgcttcatggcacagggcccccaccgaactagaaaactgtggccaccccaggccaagagagcgcatgggac

SEQ ID NO: 541931 - DNA, 111 bp, Homo sapiens
ttgttctaatgtagaggaatggctcctaattgcattattttttaatctctatagttggatactcccaagacaaaattctttccagaactagtaagaatgaagcaagtaaaa

SEQ ID NO: 541932 - DNA, 303 bp, Homo sapiens
  misc_feature (10)..(10): n is a, c, g, or t
gttttcattnaggaggtgcgtttatcataagggaggtgtatgcacttggttgtgtctgactgtctttttttttgttttttggagagacaagagtctcgcttcgatgcccaggctagagtgcaatggtctgatcttgactcactgcaacctctgctttctggcttcaagcgattctcctgcctcagcctcccaagtagctgggattacaggtgcataccaccaagccagactaatttttctatttttagtagagacagagtttcaccatattggctggtctcaaactcctgacctcaagtgatc

SEQ ID NO: 541933 - DNA, 247 bp, Homo sapiens
tttttttaaaaaggggggggtttttttttttaggttttatgaaacccagaaaggcttttttttaccccgcggttaaaaaaacgggtccccaaacccttggggaggggaaaaatttttaaaggaaaaaggggttagggggccccaaggcgggtttttttttaaaaggccaagctattttgttgggaaagttccttttaatgcccgtttttaaagaggggccccttccaaggggtttttttccccccca

SEQ ID NO: 541934 - DNA, 1785 bp, Homo sapiens
  misc_feature (1496)..(1496): n is a, c, g, or t
cttcagagaagaaaatcttcattggcctcatcccccatgaccaggtcaactttgtcaacggcatccggctgtgtcattgacaaccagtcagcgaggtcctgcatcggaacctgtgagcatggcgcagatgttccttgaacacgcggcacgtacgcgttggtcaggagtaaagagtgagggatgacctatgcatagtacatggattccatttagtcacattggtctgagtccatcatgtaactttcccccttggattcacatgatagacagtatgagacttgagcatgctaccatcattagcaaactgaagtagtattgggcctcaaaggtcataggaagcctcctaggcgactccacatgacatccattgtcgcaactgtcaggatgcaatacaatctgtgtatcgtctgaaatggtgacatctttgcgagacgataggagcccgatgtctgggttggaacgataccagtgcgaagttgatcgcggcagcgttggtgcagtggacattatgatcaggtgaacttggggtggacctagtaaccgcttgacaccgtggatagttgggatgaaagtttgaggtacgataatagcaccttcctttcgatggggatcatggactacaatgtgctgtaaatcggacgtagacccacgaggtagagagcgaaattgcgtttaggatgtcaataatgggagacgggacgcttatcaagacagagtcccagatttgaatgtacgaacaggccggtacaggaaagatcaagacaactttgggctgcgaagtcaatctgactagcggaggggaaaaccaatgtataataagactagatgggatgcaggcaaataatattgcgcggaatataattacccgcgagatatgaacttggtgagtgcagagagaaacaccgcgcgcagtgtagtgaccgacccgacatgtgtctgttgccagatagtcaggtaggattggatactagtagctatgcacaagggctttgagaaatacacgtatgaaatagtccgcgaaatagcgatgtggtaagcaataggagattcaccccggtgtcaacacaactcaacgtaggtgttggtagcgacacaccaatagctgagagattgacgtatactacagatcataagacaattgtagttagtaggagcgaaaaatcgaacgacatatgtgcaagatgaacattcagtagatgcttttacattgcatcggagcccaagaaattggtcatcagggaaatcatatacagaatagtagtatttcgatccaggacactatatcgatggatcacagactaacttatagagtaaatttggtgccacagagtcgccaaaaagatagactataccacgtagaatatacaaagcagttatcgcatgcggaaaggagcctaggacaagagtaacactagcaaggatacaaccagaggatcttatgcaagagctatgtcactctcacttgtgcactaaaaagttcccgtaagagtttattntgctcgtagatgtgactatcatagagatggtgtatgaactatagattaggtggctcgtcatgagacaagatgtgatccactatagaaattcagattaagtacatagagtgaaaacgctcggaaatggagatttcgaagacccacgtgagtaatacaagtgacagtgaatgacgcgagggtgtgtagacccaacaaggtgtgtgcacgaggaaaatggtaagcgaggagatgagagacgactacacatattgccaacggagtgagacatacaacagagggtaggcgcgca

SEQ ID NO: 541935 - DNA, 180 bp, Homo sapiens
aatcgcacgatgtctcagctactccggaggctgaggcaggagagttgcttgactgggaggcggagattgcatgtgagctgagattgccccactgcactccagcgtgggcaacagactgagactctgcctcaaaaaaaaaaatcaaaatttgtatcaaaagtcagctgaggaccatcgttg

SEQ ID NO: 541936 - DNA, 177 bp, Homo sapiens
ctcaggatcctatgcaccattccgatagtaataggaaggatggtggaagtagtcagaaacttatgttgtttatacgtggaaatggctatatcgtggagctccgattattagcggtacgagtcagttaccaaaacccccaatcataatgggtattactataaagaagattattacaaa

SEQ ID NO: 541937 - DNA, 131 bp, Homo sapiens
agcctaaccctaatgtagcgctcttcaggttctaaagggattctccgtttaggttccatattgtacacgtatggaaaataatctgcagaaacgagctgtgcttgcaaagactttcatagttcccaagaatt

SEQ ID NO: 541938 - DNA, 276 bp, Homo sapiens
tggcccaagcgcaaactatctctatacattatcacactaatccgagacgcgtgctgttgactatagagcttggatcccagaactctctgagacctagggccctggtagcacacaccgcgcctatgctctgcgccaccatgtgagtgcgaatatttcaggctgactgtaccacctgttgaccatgccctgagaatggtccaaagcgctctgttggcttcgctaaatcgaataaatgctcttctacacgtaccctgtcagagagtgacacttgggtcc

SEQ ID NO: 541939 - DNA, 147 bp, Homo sapiens
accttctctaaaaatgaaacacggtattcacctgtagaacatcttttcaaaatattaagccacatcagctatgttccacttcatttctgagattttttgagaagaatttttgaaccagaatcaattagttgattaaccatttattct

SEQ ID NO: 541940 - DNA, 269 bp, Homo sapiens
cactaaggccgtgctcgcctgccgcaggctacgagacgtgcgacaaggcgcccgtagctcatcagctgctgtggacgctcggagccatccatgcgggccatctctgctctctagagctgccctgcgagacaaccataccgactctgacatccaggagaaactctttgtggtccccgcggatgaggcccaggctcgaatcccatatgcccgtgtcaaccacaacaagtacatggtgactgaacgcgccacctacatcggaacctccaact

SEQ ID NO: 541941 - DNA, 116 bp, Homo sapiens
gcgccgcagctgggcttggtgttctagatcgtgtacggggtgctggtatttgttgttgggtggggtgcgattcgcgtcctcctctggcgtttaagacttagtggtattcacgtaga

SEQ ID NO: 541942 - DNA, 103 bp, Homo sapiens
gaggtttgagtccagtctgggcaacacaggaaaaactctgcctgtgtcttgcacaaagtgcacactgggaggcaagagcctgtctctgcagtaagaagggctg

SEQ ID NO: 541943 - DNA, 212 bp, Homo sapiens
gcaaattgctccatgttcttctctccctttatgttaacatctccttgaagggtggtttagtttgcattggctggtttcagaaaggtattaaggcttaggccaaatcctaccttgagtatggttaaaaaaaaaaaatgctgctggcctttctcggagcacagtgcgctcggcactggcccagttgtgtttttaataatacaatattggaattt

SEQ ID NO: 541944 - DNA, 1171 bp, Homo sapiens
  misc_feature (650)..(650): n is a, c, g, or t
  misc_feature (919)..(919): n is a, c, g, or t
cgggctccgtgcggctcctgtcagcaggcgggctgcgagcggatcccatggtgcagccttctgggcggctggcggctgcctgtgtgctgtctgctggctgtgtgtcctcctgtgcgtgcttgtcctgtgtgtgctgtgtatgtgatgtttgtgcttgctgtggacttgttgcctccagtgcctgtgtgtgacgcttgccttgctgtgtggactgtgctgaccagtgctgtggtgcaacagctgacagactggaccagggggacagcagcttggctgcgacgctggagatgtgcatgtgcacgtggaccctgaagcttgcgcgactccccagagggccgaagccccagccggctgcgccgccggcacgaggcagtgcccgacaggcgaggatgccgagcgccaggggacttgtatagacaccgacctccacgaagaaaacccctaaacactgggtggttgaaggacctaggtatctgtggaccgaattcgcgcgctaacaacagcggcaaacaactgggtgcggaaccccacctactatactctcggagcttggaacacccctctggacagccacgacaagaaaacccatttataattccaaaactcgacttggtgctgcctttacaacgcagacgggcaccttagctacncttattatatctggcgcaccgaaacatccagcacacttaacgcttggagaaaaccactacaggagtacatgtaacagctccacacttctctctcacttattcacatgcggagagatatcacttaggctataggctcggagtttacgcacttatagggacaccttgaggcagaacgacgccgcttttgtgcgacaccagtaaaggcatattcggcttggttatcaccattcttatgggcccgcattggtgcatccacactactaactttncgtcaattggacatggccagaaatcgaagatcacacacacgaaaccacacttgcggctccctggacagcaacttttgggcacacactttcgggtctctctcggaacccaacttacaaggagcgataaggcccccaggctcaatttacttgggctacaacagtttggcatcacaggcaacacgggtttacatcacgttactcttgatccccaccgcttctgtctgtcggagaacccgtaacccctggaacaaa

SEQ ID NO: 541945 - DNA, 91 bp, Homo sapiens
  misc_feature (30)..(30): n is a, c, g, or t
  misc_feature (47)..(47): n is a, c, g, or t
gcagcacctaggatggggcagagacttgtnacatctttgtccccagnaaaggctacatgttacctccttcagttgataataaacctttctg

SEQ ID NO: 541946 - DNA, 231 bp, Homo sapiens
gtggacccggtccatgcacagttcaaggtcctctttcctgactccaaagcatttttttttgagacacggcttcactctgtcacccaggcaggagtgcagtggtataatcacagctcactgcagactttacctcccagggctctggttatcctcccacctcagcctcttgagtagctgggaccacagcggggcaccaccatgcctgatatttgtcttctttttttttttttc

SEQ ID NO: 541947 - DNA, 680 bp, Homo sapiens
agcggggaggcggaaggggccctgcggcgacgacgtcgtcgacgggggtggccgtgggagctgagcacgggagaagactccctctctcgtgaagccggatcccgagccgggcaggatggatcaccaccagccggggactgggcgctaccaggtgcttcttaagtgaagaggataactcagaatcatcggcgtatagtagcagccacctacttcaagacccagtcaccgcagattgtgcaggctgcgtcttcagcaccagcacttgatactgactcttcccctccaccatatagtagtattactgtggaagtacctacaacttcagatcagaagtttacgggtgagttttagtcccgtgccagctccctataggcgatgctacctctcttcctacgtacgatgaagctgagaaggctaaagctgctgcaatggcagctgcagcaggggaaacatctcagagaattcaggaggaagagtgtccaccaagcagatgcacttcagtgactgcagaccagctcagactggcggaatgctggctgttcgtgctggcatttgtcatggcattctagtttgcatgctggcttggattccgtgtactccttctgtatcaccaagtaccagtagctggcaggtatggtgctatctgcggatttgggctatccttgatccaatggtcctta

SEQ ID NO: 541948 - DNA, 400 bp, Homo sapiens
gtgaccctcagaagcttgcccctaagagactgcccgaggggattcccatttggaggctccgggcctagagaggccacgccttcccgtaaccttgcagggtggtatgtgctatggttcaaaccagagttaagggcccatcccagggcaaattccaactcccgccatctgactgacctggattcctgccttctagcaggaatggacctcatgatttattgcaccccaggaaagcgccacgggcagagaaatagaatttccaactccaagatccctcccaactcccatactgccgcctcttcttgtctcaccacactgagaaaagaatcttacactaaggtctcaagtaaaccaccacccaggcccaacctcccttcaggaccttgcaggcctggcctggccg

SEQ ID NO: 541949 - DNA, 104 bp, Homo sapiens
tgccgggaccagaggcgtgaaccaccgtgcccagccaacttcttctcttttcatgttgaatacaagcattattcttgaaggacatgggcaacaatgacactatt

SEQ ID NO: 541950 - DNA, 183 bp, Homo sapiens
gtatcagagacagagtcgcaccctgagcagctatgtactactcccctccagtctgaaaagaacagccggagagcacctgaaattcatctgaattctcctgaaggtgtgcagcacacactgacacggcaaatcgaaacatgcacaggctccataacaaagtggagagcagcagggaggaggcaa

SEQ ID NO: 541951 - DNA, 124 bp, Homo sapiens
cctgtactatgtaacaacaaccaacaacaataacaacaaaatcaaacaaactaaaaaccaaaccaaaagatatgcttgcacatattgactagataccagatgataggactgctatctactggta

SEQ ID NO: 541952 - DNA, 118 bp, Homo sapiens
  misc_feature (28)..(28): n is a, c, g, or t
gggggtatctatcagggaggcttgtggnatagtatggggacctgacttggcaccaagcggtgaagacattcaattggaacgccaccgtcattcagtccccactcctgggaaaggaaaa

SEQ ID NO: 541953 - DNA, 259 bp, Homo sapiens
gcaggatacgggtacgggagtggtaagacggcggggagccatcaggtcctggcatcagtcacaccggagtcgctggaacatgcagtgtgcccggtagcaacgcggcggctaatttataggtagtagagatggggtatcagtggtagccaggatggtcttgatctcctgacctcgtgatccacctgcctcgacctcccaaagggctgggataacaggtgtgaggcaccgtgcctgtccactaattcatattttaaaagag

SEQ ID NO: 541954 - DNA, 245 bp, Homo sapiens
gtaatatcaagacagagtctggtctccaggcccgggactggcagcggggacctcaggcaggcaggcaggcgggccgaaggcctccagggaagatcagtgggtgtggctgagacagtcagtgtgcacaaaactggccagtcacgagcacccagcgaaagttcatccatgctctggcaggacaggagagcacgcggcccctcgggaatatagaagtatttgccatattctctttgcttgttccgatg

SEQ ID NO: 541955 - DNA, 310 bp, Homo sapiens
tgggagcctgggggagctcttggaccccctccggtgcccacttgcgcttgcttattgtagtactcctcccaagccgtcgtgtagtcctgctgtgggggcgctccgggatgctggggctgctggccgatattgttgtaatactattcccaggccttagtgtagtccgattgaccggtgggtgggggctgagggggctcaccctgagccggtgggtccgcagaggccgttgcgggtccggggacggggcccggggtctgctggtagtagtgtgagtagtaggcggcccacgcggcgttggggtctgcggccg

SEQ ID NO: 541956 - DNA, 369 bp, Homo sapiens
cattagttggtaggctatgtcctcatcatggatcctgtagaggatgatgtcgatttctcaggacttgaaaatgactggctgtatctaaatggtatagatagatgccaagtcctctgtcacttattacctaggactccgtaggcacagctagtggagtcttagcacagtgcccataccctaagaaattaataatgaaaaccaaacctcaagaacctagagcagctgctctacttgccaccatggactccagtggtcagcataagaaaagcagatagttgcattctatttagtttatagctgctttgttcctttgtgtttcactaagcagaggctcaaaaattcccttgataacttcagctgcccctggag

SEQ ID NO: 541957 - DNA, 586 bp, Homo sapiens
gccaactgggttcgagttcgtgggagtgggggaaatcaacccattcaaaactactctagaaattgtcttttggcagaatagcaggtatccaagttaaaaataagagggtcatttaagaccagcctggcaacgtggtgaaaccccgtctctaataaaactaaaaaattagccgggtctggtggcgggcacctataaacccagctacttgggaggctgaggcaggagaatgcttgaacctaggaggcagaggttgtagtgagctgaggttgcaccattgcactctagcctgggcaacagagcgagactccatctcaaaaaaaagagaaaagaaaagacaaaagttgggcagaggatttaaatagccatttcttcaatgaagatatataaatggcccataagcacatgaaaagatgctcaccttcattagttattgaagaaatgcgaatcagaaccacacctaattgaatggcaataataataaggaaaaggaaaataagtattggcacagattgcaattagaaccctaatgcattgctggtaggaatggcaaatggcacagctgctgtggaaaagtttggtggctcct

SEQ ID NO: 541958 - DNA, 126 bp, Homo sapiens
ctctttgcgacccaggggcggtgcggcttcttatttgcgcccgggtgaggcggggtttcccagccccacccccctcaggcaaaaaagcttaagcccatgtttctcgttgtctaaaaaacgtgtaaa

SEQ ID NO: 541959 - DNA, 306 bp, Homo sapiens
  misc_feature (38)..(38): n is a, c, g, or t
gcgcgcggggagagagagagagatctcttgtcgcgagntattggagcaagatttctggtcggtgttcaggggtgtattttcttaacagagacctgtgcggaaatttccttctcttccttttgatagggtggttcacttttggctattggtgggattggtccctttattaaggtttattccttaaggttttggaggttaccagactgtgcatttatttaccttttgggggcgttttatttcgggctctttttttcacggttttgtgttcctttttccacccacatttcatgtggacctttggggctt

SEQ ID NO: 541960 - DNA, 1173 bp, Homo sapiens
tgtggtggctcatgcctataatcccagcactttgggatgtgctgaggcgggtgtgatcgaccttggaggtccaggatgttcggagaccatgcctgggcaactgtggtgagggctctgacctcgtaccaaacaatacaaaaactagcttggtgctctgagtgtacactccccaagctgtacatcccatgctactcagtgaggcttgacatgcctgatgaattgcttgaagccctgggagggcaggcacgcttgacatgtgagcctgcgatcgtgcccagtgacacttcccatgccctgatgtgatcgacggggctctcataactcttgctctcacaacctcaaccactccagagtacacataagcaacataagacaactacacactacaatctgctggctacgacttcgtgcctagaacccacaacctacacttgggctccaactcagcctgggcactctgcttgcactcacgctgtgcttatcccaccaaatctttgctcttggccattgctcgctccacacaatacttccacaggcacacctggctgcttccccaataacaacgcagcactttctccttggccattgtacaatagcccacttatacattacatctctcctgggctggctacacgggcaccccattaccccatctcacactgcccggcgcggccctcgaggcatatctacaaacagggtgttaatcatcgcatcgtgaatacatagacctataaacgaacgtctagcgcagctagacataacaaccacacaccataacacaaacaacaactcctgatcgccccccgagaacaacttccatgcagccagcctctcctccacaacccccagtgtgaagactcgacactgcgaggcactatcaactcttgtctcgtcgacattcgacacgactcgacgaccgtttctgacaacaagaggctgtatgcggcagcagatcgcgagcaccgctgtcgagacattagtatgctgccgtgcaaggctcgtcgatcgagcgacgggcgtgcctgaggagcgcagtgacatcatcggatcctacgagactgctcgggctgctgcatcgacaccgacacatcattggcacacggtgcagaagacggcgcggagaaagagcaacgagcgcgagtgacacatagatgatttaatgcgtgattcgta

SEQ ID NO: 541961 - DNA, 776 bp, Homo sapiens
gcaagcaaagaaccaaattatgaatgaactcacattcatgattgctacaaagagaataaaatacctaggaatacagcgaacaagagacataaaaaacctcttcaaggagaactacaaatcactgctcaaagaaatcagagagaacacgaaaaaatggaaaaacattccaggctcatagataggaagaatcaatattgtgaaaatggatatactgcccaaagatatttatagattctatgatattcctattaaactaccatgaacattcttcacagaagtagaagaaactattttaaaattcatatgggaccagaaaagaaccagaatagccaagaaaatcccaaactatttagattagcttaatctaatctaaagattaaagaacaaagctgtagatatcaatctaactgtcttcacactattccacaaggctacagaaaccaaaacaacatggtactggtacaagaacagacacatagaccaatggaacagagtagagaacacagaagtaggacctcacacttacaaccatatgatctttgacaaatctgagaaaaaaaatgggaaaaagattccctatttaataaatgatgctgggagagatgggtagccatatgcggaaaaatgaaactagacccctttcctttacaccttaaataaaattaactcaagatggattaatcacttagatgtaaacccaaaaatttataaactctagaggaaaatgttggcaatgccttcaggacctaggtagggggcaagatctgtgaggaaaa

SEQ ID NO: 541962 - DNA, 110 bp, Homo sapiens
acgctccagcccaacaccgtgttcataacagattcagagaggaaaacacgtcgaaatctccagatagtggtgacattatacagcattgataatggtaacatgatcgtaga

SEQ ID NO: 541963 - DNA, 403 bp, Homo sapiens
agaaaaggtacatttatttttcaagcagaaaattttcctgaaaaattttttgtaacggtattaaaagaatcataatggaaagtactatatttgattagttgacatggaggaaatggtactcccactttataccaatattttcttaaaaggttgacttctgtattattttaatgagttcttacactcgagctagaacactttcaatgaaatcaaatgtgaaaagagctgaatgcatgacctgcactgcctataaaacgtgatgacattaacgctgcctttaatgcgaaacaattcacatcattgttaagattccagctggaggttgcttaagaatatttaagaccaggtacagtggttcgcacctgtaattcctgtgctacgggaggctgagctgagctcgtgc

SEQ ID NO: 541964 - DNA, 631 bp, Homo sapiens
  misc_feature (610)..(610): n is a, c, g, or t
tcgaagatggcggtggggcctgccgagcgggcatggtcccgtcctagcctcctggtcagtcagcctcctcccggctgcctttcccacagccttgatcgcatggctcattgctccactcccttcctcagcaacaccctcagctcctttgcatctcctttggtccacaccaggagactcccagcagatccgtagccctcgatcagccacatggggtttaccacccctgctggagaaaatcacctgtcatcagactgcggtccccttcatggtccccaagaaaaaaaaaaaacaaaaaaagagacacacagaaaaaaaaaaaaaaaagctgtgggaggccctcggagccacaccacagccttatttttctttctctctgtcccctcacacgctcattccatcctgtgtcctctttactctctgcgggcacttcactgagaaagtagactcagcattcctgagtcggtctacagttttctgtcctcttaccccaagcctgacctcctcagagcccacctcctcctgtgctcagagtgtagtgtccttcctctgcctctcgtctgctctgcgtctaccctgcccctcttgtccctttgtcccatgattacgaggngacggcggggggattcgtatg

SEQ ID NO: 541965 - DNA, 396 bp, Homo sapiens
  misc_feature (340)..(340): n is a, c, g, or t
  misc_feature (348)..(349): n is a, c, g, or t
  misc_feature (375)..(375): n is a, c, g, or t
tcgtacttgtcgctgatttacctgcttcaacccattgccaatccccataaggttcatcattgggatgatggtcgattttaataatttctaatccgtttagccatctttgatcatcgattcgtggcgcattggcggtgtccaccacaaggaccaacgcatcacgatacattttatcgggcacgtcatccataaaggtgtcatcttcactcatccaagctaagccttggacagccttcccaactgcataaatctgcttgtctggaaaactagcttctaaaatcgcctttaagcccaattgcgcaccgtacgcatcaggatctggacgttggtggcgatgaanataatggnntcatatcgctttattctgctaatatngttctcaattgctgacatatc

SEQ ID NO: 541966 - DNA, 420 bp, Homo sapiens
cggtggtcgtccaaggtctccaacaactccgggtcttccagcgacttcaagtcttccaataactctcagcctccagataatcctgagctccagaaaatccacatcttccagacaatccatgcccttccgagacaactccatgtcttccaacgaagactccaagctcttccagctaaagtcaagctcttccagacacactccagatcttccagcaacttactggatcttccacacaaagtccagactcttccagcgaaaactctacgctcttccaacaaaagccatgtcttccagaaaatccacatcttccactggcctccaggtcttccagactatccatgtcttccagaaaatccttgtcttcccttacatctatagcttccaaaacatccgggtcctccaggaaatccgtgtcttcca

SEQ ID NO: 541967 - DNA, 174 bp, Homo sapiens
cactacgggacttgggtcagcctcggcgcttcccagcatgctcccaattgccagtccggcacccctctgcatccggtttccccttctgttctagtggctgacacatggcatcccagcttttgggcttggttgctgacgctccccaggtgtgccaggagccactgggacacggtt

SEQ ID NO: 541968 - DNA, 1144 bp, Homo sapiens
tggaaatgtacagcagaaactcttgagcagagaggctaaacagcaactctgttctcccccttcccctagcacttttcttacgaaaagtcaataattaacgcaaattgcttaacacttggttccagttcctgcctatctggagtttaaatgcgtaatacaccattaatttccacgctgcagtttttattttaaagaaagtaacaagatgtctttacactgacactgaaaattcatccattttagagccaggaattcccatgttacacaggaaaccacatagaagtctacgtgcaacttaacttttcttacacaacgcacaacagagcactcagcattaacactactttcttctgtctttctccttttggaacacttttatgctataacttctttctgccctgcctacttttctgcacaacaactgacgactgtaccagacttctcggcttcccctgctactgcacaagctgactgctgcgtagcacacttctactaccactgctctgcctcttctgacttctcctatcagcagctgacgaacacccttcacaacctacttggacttttgcaaacgtaagtaaaaccaccttccactatctccgacttttcccccctccatttctctagtctcaactacttaatttcgccaacttaacattgctcccttattccgccgccccgctcccccttcaaaagccatattccaccttccggaccacttgcgtccctcctaacctcccctggctccctctactcgtccgcgcactcccctcccggcaccctccctccccgcggccctcccccgaccggtcccgccacttcgggccctcatacctcgctccgctcacccccgactccccccccccgctccccccaccccccccctcccccccctccttgccccctgcccgcccccttcgcacccgcccgcccctcccccctgcccttccccacccctggcccatctcacccacccgctggcccccgcgcacgaccgcgccccaccccgccgccgtcccaccccgcgcccccacaactgcccggccactctcccccaccccgccgccccgcctcccaccacacccccgcacacaacgacctccaaaaaacacgccccttcccgacgcgcccctaccccccctcc

SEQ ID NO: 541969 - DNA, 382 bp, Homo sapiens
cgctggtttggcgtttgttcctgtcccggcattgccttttgttgccgcggtgtttcagcacggtgggcgatagaccgcgtcactgtgattggcaggggcgattgggccgaaacaacgtaggtttgccactcggtcagcagtcccgtgttaagctcgggtggtcgtgtgccccactcacgtggtgcggcagtggtgcacaagtctgttgcctgtgccgccacgatggggggtggtggagatgtcaccgccttgacaattcggccgctcgtctgtaggatgccgggggctcttagtcacccaccttgtgcgggaccctattcttacaaatacggctgccatcttaaagccatcattgaacaagaaaaaaacggagacatagata

SEQ ID NO: 541970 - DNA, 503 bp, Homo sapiens
agagacagggtctcactctgtcacccacagtggagtgagtgatgcaatcatggctcactgcagccttgaactcctgggctcaagcgatcttcccatctgtctcctgaatagttagaactacaggtgtgtcccaccacgcctagctaatgtaaaaaatatacatttgtagagatggggtctcactgtgttgcccagactggctcaaactcctggcctcaagtgagtcttctgccttggcccctcaaagtgttggtattataggcgtgagccagtgcacctggcctcacatgacttttattgcattatactgttataactgttctcttttattattagttgttaatctcttaccgtgcctattttataaattaaattttatcatatgtatatatgcataggaaaaaacatagcatatataaggttcagtagtatacagtttcaagcatccccttgggggttttggaatgtaccccacacaggtaagggggggattactgtaaata

SEQ ID NO: 541971 - DNA, 650 bp, Homo sapiens
tgatcgaggtggatgatgtaatggagtgatgattctctgtcgtattcggtcccaacggaggatcggtatttggcatggaggtactatgccaataattcgtgactgggctgagagaactgtcttggccatgtagaggacgactatatccttagtggatcgtccacggtcagatatgagttgtacactcacctgcctgtgagtgataacagctggtccagagcagctcgcagcagctgggatgttccgagatcgtgtggagcttgctctcaggtagaattcctcacgatgcactgggtggagctcatttcacaggtatgacttgccgtgggcactcgttgcgagaagcccctggaggtgccactgagtcgtctctagacaattttccgtcacaggtcaagcattcatgcacacatagactgggccatcctgccttgaggtacaagaaaacgcaacaggacacggaaaggtcgacgacagatactcttagcgatgtccatagaccactgttacattccttgttaacttacgaccagtacttcttagcgatacggtgatcgttagaggaacgcgaaaaacacaatgttcgagggacaatacctggtaccttacgtggccttactacctggtaggcactcgaattctggacgcgg

SEQ ID NO: 541972 - DNA, 269 bp, Homo sapiens
tattggctcactcgttcacagttccacctgcatcttctcatcaaagccatccaggatacacaggaagcttctttcctcttagacctgtgatcggcctgtgatgatctctgatagcaaaaggtttatcttatttgagagctgccatactgccactgtcgaggtggagactgagcaaaggaagtcctggagctgtgccagctcccagaagcttcagacagaaagagcagctactctcacctggcgaacccattaagagaattctcgttgag

SEQ ID NO: 541973 - DNA, 469 bp, Homo sapiens
atatttattatatatattatatatataatatatattataaatataatatataaatatatttataaatatatataaatattaaatttatacattaaatttatatacatattatatatacatttttatatattatatatatataaatataatatacatatattttttaaaataaaagagtttctaggccgagtgtggtggctcacacctgtggtcccagcactttggaaggctgaggcaggcacatcaccagaggtcaggaggtcgagaccagcctggccaacagaacaaaactccgtctctaaaaaattacaaaagttagccgggcgtggtgacgggcatctgtagtcccagccactcaggaggctgaagcagaggaatcgcttcaacccaggaggcagaggttgtttgcagtccagcctgggtgacagaggcaagactccgtctcaaaaaaaaaaaagaagggcggccg

SEQ ID NO: 541974 - DNA, 308 bp, Homo sapiens
  misc_feature (11)..(11): n is a, c, g, or t
  misc_feature (19)..(19): n is a, c, g, or t
  misc_feature (30)..(30): n is a, c, g, or t
  misc_feature (63)..(63): n is a, c, g, or t
  misc_feature (65)..(65): n is a, c, g, or t
  misc_feature (85)..(85): n is a, c, g, or t
  misc_feature (98)..(98): n is a, c, g, or t
  misc_feature (120)..(120): n is a, c, g, or t
  misc_feature (148)..(148): n is a, c, g, or t
  misc_feature (152)..(152): n is a, c, g, or t
  misc_feature (160)..(160): n is a, c, g, or t
  misc_feature (163)..(163): n is a, c, g, or t
  misc_feature (180)..(180): n is a, c, g, or t
  misc_feature (189)..(189): n is a, c, g, or t
  misc_feature (199)..(199): n is a, c, g, or t
  misc_feature (202)..(202): n is a, c, g, or t
  misc_feature (243)..(243): n is a, c, g, or t
  misc_feature (260)..(260): n is a, c, g, or t
  misc_feature (267)..(267): n is a, c, g, or t
  misc_feature (271)..(272): n is a, c, g, or t
  misc_feature (287)..(287): n is a, c, g, or t
ttttgttaaantttgttgnttttttttacnctgtgctgtttttattggcatatttagtattgncnttttttttttgagacggagnttcactcttgttncccaggctggagtgaaatggcncaatctcagctcgctgcaacctctgccncccnggttcaancgnttctcctgcctcagccncccgagtanctgggatttnagncgtgtgccaccatgccaggctaattttgtatttttagtagngatgggatttccccatngttgttnaggnnccccagcctgtgtgncagtgagatcctggccctttg

SEQ ID NO: 541975 - DNA, 172 bp, Homo sapiens
cctcgcgaaattggaagtagagagcttcttaagaccgagagagcggaccacttggtggagattaacatgcacgacagctggcgcttcaagtacaaggggtggcgtcgtgcgggaacggttaacgatgggactgtcgcagtcaggagaaatgaagcatacttggagttcggac

SEQ ID NO: 541976 - DNA, 591 bp, Homo sapiens
ttgccaggtaccccaactcatagtattatacttttactatatactggatggacttgctaaaattgtcgttaggacttttaaaatatatgtcactcaataacttggcgttcttactcgttatgttaaatgagaaacagaatacaagaacaaaaacacatagtaagaatatctacacaaaatacatacacttgtagacaacaaccagaaggaactatgtcaaaattaaaagagcatagtgaaatcaggaggcacattccaaaatgtctgatgctattactatattatcatttcactaactaaaattctaaataattcccttcctagttgtcaatcctagcaaattaccatacttttcactagaaacacccaaccatactatctctaccatccggtgccctaatacaaagataaaacaattttaaaatgaaaacagctagcaacaactacgttcaaggataagcacttcacatgtgtgctcgggtggctaagagtaaaatcttcctaagaacaaccttgtaaccaatattctagttctaatggttggagccagataactcacatacctgtatgtcaccgacacgcgtgctaggt

SEQ ID NO: 541977 - DNA, 1069 bp, Homo sapiens
taaagctagggggagctcaggaatctactagttgaatttcttcattatcccaaaaaaggccctgaaggccgggagagggcaagcagcctaacgtgaggctgcacagctaggtaatatctgcttgggggtcagtggataaggggcaaaggggctgcagggagcaatacaatgcagggtgaaccttgtgcacagccacatgtgggtagagtttacatttcagacccccctgtgcaaattgaaaacttcccaccccgtgggctgtttcccgttgattggtcacagaagtggacaggctccgtggactgagcttgtccatgggcttccctcaggaggggaggaggaatgcaggagtctcttaacattcccagttcgggaggccatctggatggcttggatccactctgggcgcacctagggggtggctgcttgcaagaaatagtgcacttcatctgctgggaagatctcaaaaaggttctcttcctcactcttcctgccatttgagttgctctccactgaagtcaccacacagcctctcaagtgaatgggtcccaggggactcttctgccccaggagggtcatagtagtgcaggtaggcagggtactctctcaagatgaacttcctgcacttaccagtattcccttctattgcccctgattcagtaaacatccctgcttgataatgacccctttgaattctacttgacagaattactcttatcatcacctgggaactcttttcacagaaagaacccacggttggaaacgtcgaaaaaagcgacaagggatgtacccgaaaaaggggtatacacaggtcacataccaggggaatctggagcacttctccaccgacggggttgaaagaaaccccccatttgacacaaggggataaacaacacaacaggggccccgaggggaagcaaaacagaagggggggacacacgaacaagatcaagagctgggagccgaggtaacaaacctcagaggacacgaaaagactgaacataggtcaagaggagaatcacagacccagcggagagaataggacgaggaatcgcgaaaaggaaagata

SEQ ID NO: 541978 - DNA, 168 bp, Homo sapiens
  misc_feature (1)..(1): n is a, c, g, or t
nctcccgcgacggagtaggggaagggagcctactagggtgtagaataggaagtatgtgcctagcgttcaggcgttctggctaggttgcctcactcgggtgactgatacgccaacggtgggcgactaacgtggtggtttcgacggaacgactataacacactatgactt

SEQ ID NO: 541979 - DNA, 209 bp, Homo sapiens
cctgtgtggttgttcctctggagaacctgactcctaaacatcccagaagagcatttcctgccacttttttgtgctcaaactgccctagcataattcccactgttcccagcagaacccacaaagcagatggggcttgactgggataaacagcacaaatactatcatttccatgtcattgctgataaggaatcgggtttgtgaagtttgaa

SEQ ID NO: 541980 - DNA, 766 bp, Homo sapiens
agatcttttccagcagctgctggctgccagagaggcgccttgcagggacccagcgcttacacaatacccaccatgtcccaggctggtgctcaggaggcccctatcaggaagaagcgcccccctgtgaaggaggaggacctgacagggggcccgaggaaacctgaacaatggtccaggaaatcaagtccaagacctaccaggtcatgcgagagtgtgagcaagctggctcggtcgcccgtcggtgttcagccgcaccgatcaggtactgagactgtctgtgagaagtgcaaagcctggaccctaccgagggagtgtctgtcggcgtgagaagtgtgcgccagtccctcttgcatgcggcgaatgctcggaagagtaggagccgttacccaggaactcttttttatgccagaatgcttccgtctcgccctggtgtctctgggggttgcagcctccttgcatagttcaggcccttcggccatgggtctgctccagctctttggaagcacccaataaagaaggattgcccacggtggccgccaggcaagcaagaaaagaaacctaaaaaataaaaacaatgttgggggcggcggcgccccaaaaggttttttaacccccttctgtggggccgcgccccaaatggtttagaccacgggccggggttcccacaaaaaaccggccggcctcggtggttccaccaaaaaaaggccggggggcgcgggtgtgtaaaccgggggtcggggctatgttccggggccgggtggatatg

SEQ ID NO: 541981 - DNA, 191 bp, Homo sapiens
  misc_feature (86)..(86): n is a, c, g, or t
gatggtagtctgtgaagctgtggttgacttgtccgaagtagtgtcaggaaggagttttcttttctggtgttcgatgaacgagtccntgcggtcgcttcgtgttctcgttcaggagcgttgtatccgtgggcgcggtctcccgcactcgccgctcctcttctctcggttccgctggcgctggcgaaagtcag

SEQ ID NO: 541982 - DNA, 121 bp, Homo sapiens
tcgcgaacgtgtatccctcgcggacgtgtatccctcgcgaacgtgttatcctcgcgaacgtgttatcctcgcttcattgaatttcttcactttgacaggataacacgttcgcgacggggta

SEQ ID NO: 541983 - DNA, 162 bp, Homo sapiens
caccaccggcacatgtaaatagctgggctgcggcagacccagcacctgttgcaggtacagctggcgcggcgtggagtcgagcaggtcggcgccgcgcacgatgtcggtgatgtgctgcgcgccatcgtcgaccaccacggccaactggtgggcccagtttcc

SEQ ID NO: 541984 - DNA, 400 bp, Homo sapiens
ctcctccttgtgttaaatccaggtagacttcctagcggcagcctgtgtccagcaggaaaagctatgcccttttgctaaggaggttgggaaggtccaaggaaagccatttgtttaggtggccttgacatgtgctgctgtggggtttatgtcattatgccaatacgacatcacgatttccagaagctcatctctagggctactgagtttttaaagtctgatgtgatggtcctagggaggctagaatcttcgcgcatctaaagtatttcacagcactctgataggtcattgccactcatgcggtgctgagaccattgtgtgaccgaggtcatgttccctatgtaagcaatccacagtccttgctccgatgtgtgatagatagatacacaatctcgttgccctc

SEQ ID NO: 541985 - DNA, 1400 bp, Homo sapiens
  misc_feature (204)..(204): n is a, c, g, or t
gggaacgcgggagagtacgccttgataggcctcgtgtgcacagctacgatgagtacaaggtagatggcgtctgctgcgctgccgctaagcctcgcacatgatgccaatcaccgtccctctaccgcatgcgaagtctctttgcgcctaagtctatggtcggtcagtcccaatgattccgccttctggttacctgtggctcaatcntctacgtctaccaggacatcatcgaagaagtctctcatggggcagtagttggtcctcactggtgcgtggtagggtggtgcagcagagatattgccccttgcggaggtgaagtgagacttgtcgcggtatctgtcctagacgtctgagtgaacgtcgcacgtgtaggctgtattacctcccattcacagtattgtgtatcacgggggagaataccgccgttgaaggcgtgcactcgagccggttcgaggtgacgcccttgtcaaacccagtgtgacattatcctgaggaaactagtggagttgcctcggacaacgcggttgacggcagaatgcctcaacttcgcatgtcaggaatctgtgaaagcgtgcgtacgcgcagtactctcgcgtgctcgatgcgaaatcggtgccaaggcactgtgagcgtcgttttggttctcatacgaaggtatttccaccagacgattcccaaagcgattcaagaggattccctcccgcattggtggctcgttaggcagcgcgatcctattgtagcgctcgtctctaagtggaactaaaggcccgaacgccttctccaataccaccgccagatggacggtgcgcaagtcacacccttttcgtttacgttaggaatggccagtgggagccccttgcgtcttgccgtgggttttgttggcttccccctgactggtgacatagactttcgatggaaaatctgcccgccgaattcgctcaatgtgggagaatccctgtggcctagagagactgagaacaacactggttggaatgattagagcgaaaactcggacctgttgtggcgcatccgcatcgattgaggggttctcaatggttgctaaagcaaccggaatgcaacattggatcttcctaacccgaagatatgggcgaagttccggcttccatagatgacttttttcatggagtaccgcagccacagtgatttgttgcccgaggggacccaaggcgattttaggtagtccgaacctcttcgatacggaaaattcggccatataaccatgcgttctttagcacgagcataagatcctgtgttaggtggggctcccctttgattcacatggcacctgtattaattgtgtttcacacacataaaccgggagttaccagaggagattgtatgttgccttgaccacacagaggcccccacgcacttaagatctt

SEQ ID NO: 541986 - DNA, 345 bp, Homo sapiens
tctctgtgtttctgcatccgttgatcagatcttatttgtgctctcattgtcaattctttgaattctttcttacctccagtagtttgtaactctcttggtctggtcaggtatggcagctcatgcctgtaatcccagcactttgggagaccacggtgggcaggttgcttgagcccaggagtttgagacccacctgggcaacacgaaaacaacctatactctaagaaaaatacaaaaattagccgggcgtgggtggcatgtttctgtagggccagccaactcaggaggctgaggtgggaggatcacctgagcctgggaggtccaggcccccgtgaaccgttgattacc

SEQ ID NO: 541987 - DNA, 382 bp, Homo sapiens
tgcttcctcatctaagagtcaattttcttcgctattctgaagcttcaatctgactgtgatatgaaacatatttcctctagagaataccaggaagctcccataagtagccagaaaacagctgtgtctggacagaggtgacagaaaccagtggcttgtgtctctcaaagagagagataggcacattacccagtgggaccccatttatagaatggaagagcttatcttggcttaattaatgtgtgaactcaactacaatgttgattgtggttatagtttcacagaggtatatgtatgtaaacatttattcagttctacactttaaatatgcatggtttactggatatccataaaactgtttcaaataaaaaacgatcggccgaac

SEQ ID NO: 541988 - DNA, 1168 bp, Homo sapiens
  misc_feature (125)..(125): n is a, c, g, or t
gcttggctccgggggctccgatcgcctgcccgcacgccgcccgacacccaggaccgtgccgccggtcctccgccgatagcaaacccttccgacgtgaccatcgctgcgcaagccgggcacgcacncgtcccctgcctccgtgccccgtccgcggaaagcttaagtttgacatgagtggggtgaagatgtgggaactatggatcattggagaggagagagtccgatcctggcatgctgacggagaccgagaccgccgggcaagacctgttcgataaccttggtcgtggagagaaccttgacgatatcataacatgatgtggatgacatactcgacgggctttaagcacgctgaactattggtgagagcttacgaagattccgtcaggtgtggaactaagagtagtatggcattgactctcaggtttcataattctcccgcaacgctgcgctaaattggaacaagaggcgttgacactcatgttgaacagactagaagtcattctggatggtcgtggagcgatgattaggctgaaacatacttccaaaatcgtcacagcagtctaaatcttaacgtggagaataaagctgaagaggatatcaggcacgcttggagacctttgaaagaagttagaatgtctgaaatagcctggagcatctttaactgtgaggttaccaacgctgaatgactaccgagagagtgtcttcaagctcctgtcccagcttacctacttggatgggtatgaccgagaggaccaggaagcatctgacttcagatggcgaggtggatggtgtggaatgaagaaggaggcaggatgaaagaaagagaagatgaaggaaaaagaagagatgatgatggtgaacaagaaggagttgaatgaaaagatgttgaaagatgaaacatgtcacagggggatcaggaaccactcgacttagagctcagatggaggaatgggaaagaaatgtacaatatgggacgtgtgggagaacagaacggtcaccatgaggatacgcgggtaacccggggtgagacagaaggcgtacgggtcatgtcgtgcacacaaaaacagagtacaagagcacagacgaatatacacaccctgctgagccgacaacacgagtatacatggatagacagacggcaaaaatttgttactagaacaagatgcgt

SEQ ID NO: 541989 - DNA, 1229 bp, Homo sapiens
cgcaaaattagcccccataataaaattaattaaccactcattcatcgacactccccaccccatccaacatctccgcatgatgaaacgttcggctcactccttggcgccatgcctgatcctccaacatcaccacaggacatattcactagcacatgcacatacatcaccagaacgccatcaaccgacacttttcatcaactcgacccacgatcacatctgacgacgataaaattacctggcaatgaacatcatcacgactcaccattccacgcccacagtgagacgcaccatcaagtaatctcgtatctagtcgctgccatcctatcacgtacaacaaatcgcagccgaatgagcccctactacgttcacgagcagtcccatctatcgtacctacatcacgcaccgaccccatgcaacaaaccacatcagcgcccactacacatccccttcacaagcccatctgccaaacccacaccctacgccaaacgccacggacaccccatgctccacacgacacgcagccccataacatgacaacaccggtccaccacagaccacgacagcagaccccccagacgcacagtccaactacgacaacgaccactacgacacgacgacgccgacccacgcgaccgcgacccaccagcgtcccaaaccaccacaagccaactcaccaccccgctacacacaccccccgaggccaccagacgctttcccacccacgcacaacacaccacccaactcacaggacgacgcacacaacccaaagcacaaaccccgccatcccgcaagacacaccacaagcagcagtgacaacaaacagccccacatggcacaacgaggccacagcggaacacagcacgcccgataccgcacgagacacgacccggaaacaccacagaggaaaagcgacacaagcgaaccccccacgcagtcgccaaaaccgacccaacacggggaaacagatcaacacacaacacacccacacacagcgaccacactagaataacaaaccaaacagagcacatcaggaagcacaagaaaccccagactcagatggagcagccacacgccggcaatgacgcaccacacacgaaagacacgataccagcggccgacacggcgacccgcacacgcgtagaggaagagcaaagtcacagaaccgaataaccaccgacgacgccgcacacaacaacaactacacagttaaccgcagtaacaggccccga

SEQ ID NO: 541990 - DNA, 532 bp, Homo sapiens
aaaagtggaaagcagagagagaggctcggctggcaagaggagaaaaggaagaggaggaggaataggatgaagagatcaacatctatgcattcacctaggaggagtccgactaggaacgcttccaggataaaggtggggacaacagccaacacaagttcattgctcacttccctgttccctctcatcaatagattgacgaggcactggtgctaatgatgaaaattgaactcctccataactatgcaatctaaaccctgcattccctttcacttctttcatcccccacttatacctcattaccctatgcttcacactcactcttgttcttcaatgactccttccccattctcatccttccttccctctcctaatctcatctttaccgtacgttatgtttctatccttaaccttcctgttagcctctctccacatatttctctactgtattcttctcatttattattaattgtcctattctctacaatcacttttctaactaaccttcctatttcctaatttattcttactcttg

SEQ ID NO: 541991 - DNA, 149 bp, Homo sapiens
gggctcatcgtgatctccccatctcagctcccaagtagctggaccagaggcatgcaccatcatgcccagctgatataagtattatttcgcagaggcaggttctcaccctgattgcccatactggtcttgaatttctgtgcccatttcaa

SEQ ID NO: 541992 - DNA, 90 bp, Homo sapiens
  misc_feature (27)..(27): n is a, c, g, or t
taccagctagcagaacaggcagaaatntaacacattaaagacaaatatgtagaaggtatatactgagctgctaaaataaaccgttaagag

SEQ ID NO: 541993 - DNA, 1571 bp, Homo sapiens
  misc_feature (387)..(387): n is a, c, g, or t
  misc_feature (509)..(509): n is a, c, g, or t
ttcctaaatgtcgcccttctgtgctatccttaattctccgtgtccctttatttgttggtgaatttctacacagcggaaccgcttgttcttgttgtgaaacttcttttgtaactaattgattgttcctctcctgttcactttgtgtcacgaagttcataggacaccaggtgttgttacctgcattttactgtccgtgcagatcgatcactatctgtgcatcatatctggtccagcaacctatcacgatttgtattgccgcataccatggtgtgtgctttacaggagagccaacataacatgttgcgtcttgtaagggactggcatgaggccctatgtgttatacgtgtgcgattccctaacgttctttgggactatttccagcttggnatggagcaactcttttaatgtatacatagcaactgcaaaggagccttctaattgtctgtgccaaatgtgtaactaatctcctttacttatcatcctcccggctttgggtggttacgctgctntaacgttttggtacggagctcaagtctatataggctctaatcttgtgttctctggaatgttatcggtaattttcatctctctaaaggcttttttctaacactcgcttctgcactgtaatgctcatttccttcaaggaagtgttccccaccttgaaggctcccctttggtgggggtgtgtaacatacgttctttaaatgaggtacccgcgcttttatgaagaccccccgggtttttcctaactcgccttgtttttctacaatagaacttgtggtgccccggaaatgtggttcagcctctttgtatcttgtagttggtaatccctgtagaattaagccgtctgtgtgtcaccgagttacttttcccttggttctgcgttaccgttagctacattgtcccctgggttctcttatatctccgtaacacttgtcggctcgtactcggaagactcggtgctcccgatagagagttttattgcccttgtgagaggatattctagagacaccattgtgtcaaatatttcactggttaaaattgccttctgtaatggcaattgaagccattggttgatttcctggatgtttagccagccaaagttttgtccaattctagctataagtggggtaatccagacgagttggcatcaggacctggctgaaggaagccccgttatgaccctagtaaacgatacagatagtggaaatcctgacagcatatgccagcgccgtaggtataggaaccagctcaggctgcacgccagagtgaggtcttacggaagattcttcactaatagtcatatttcactgtcaaaggacaatcagcagtgatagactgaacgggttcgcagcgagagtcccggacttgtctagaaatgagcaggttgtacaagtactgttctaaatgttcacacctgttgcagtttatattctttccattgtgtctatcatgtcagtgaatcgaccaggagtgctttcatttgcaacttgctgtaacattttctgttttttcaggttttactgatgaggcttgtgaggccaatcaaaatatactcggagctctactaa

SEQ ID NO: 541994 - DNA, 182 bp, Homo sapiens
gttctccccgagaaagcagagagagcagagcaacagtgagaagaattggggatgcttgcctcatccaggttataaaaaatagaaaaaaggcctccgagcctgtgggtgagggcaaggtggttggtggcggttacaatgtgcagcagtattttacattttggccctctttggcaagacctatt

SEQ ID NO: 541995 - DNA, 319 bp, Homo sapiens
tgaataaccgagtggtcgttatcctaatcgttaaaacttttctccatccgagaggaattctctcgttcggagacttagatccggctcctagtcccaaggatgactgttcccgtaattcacgtgtcggggacaccgtctcgggactagttgtggattgtggtgtccgacccgactcctcagccgacatccgtgtttctgtccgtactgtcttttgacgtagtgcccatcaaattggtttcggtgaaacccgaaaccattttcgttgaagactcctatagagccaccacaaacattctcagacgaacagtcacaatctcgg

SEQ ID NO: 541996 - DNA, 1150 bp, Homo sapiens
  misc_feature (368)..(368): n is a, c, g, or t
  misc_feature (868)..(868): n is a, c, g, or t
ggctagcgcgggtatcagcgacgggagccctacaagggacataggcaactacagcggcgccggcgggcggcgcccggaatgaggaggctaagtgcgggaagtaggggaggggaacgaaggaaaacataccatgagcgatagacactggcagagatgaaatcagaataagaacagatgagagaaaccgacagactacagacgaacataaagaaaaggatggcatcatacagtaccgactcgtattaatcaagataatacatagacagcagaatctacatgtactggaggggacgtggatgaactgccgaaacagaaggtagcgggaaggaatagcaacaagatccggctgtatagacttagacataggngatcatggcgatgagatgatgctatatgtacctatggcctatggtaagaaacgctcaacatgcaacgtacggactataatgctgcggaaaaagatatgccgacgctgtaaactgagagctgtctccaaggagtactcggaaaacgccgagaccaagatagattcaatggaggccctaggggcaataccaggttgaagaccgctagaaaggccacggcgaaagcagggcgattcgggggcgaagggatcagacgcaacaccgaggtgagaaagggagcaacaaaaggactgaaggaggccgaggaaggaacacgtcaaacaggggcacgagctcggaaatgcgagcgaacggcgtgggagcaaatggaggagggctgcgagcccgaaccagaaagcagagccgaagctcaaccgaaaaggcaagcagcccaagaggaggatccaaagccaagcgttaaggtgaaaagcggccgattaaaggccgtataataggccggctgnataaggggttcacaaaaaggcgggaaaaacgccaaggaagacaaaggactccgagagggataaataacgcccacttcctggtcagccttttcccttatcgaagatagaaggcctatcaaaagctaaaaccaaacaagaacaaagaggtgaagaagcacactaaaggccgcgggcgggcagagtcgtcgccagaataaacgtcggcggaggacagacgtaataccgacagattaaacaccggttaaatgtggtgccccagcgggcgagaacatgtaggtagac

SEQ ID NO: 541997 - DNA, 106 bp, Homo sapiens
tacatgattacgaaccgaggtgatacccctagttttagaagtttcaactagcttttataatcagaggtacattagcaggctcagcctaggggaataattgccaaca

SEQ ID NO: 541998 - DNA, 208 bp, Homo sapiens
tgttgtgttactgtactgaatactgtaggcattgtacacaatggatagacttgggtatctaaacataatctaaacatagaaaagacagtaaaaacatgccattataattttatgggaccaccatcatgtatgcagctacattgtagaccaataatgtcatcatgtaggtgcatgagtcgtacttcagtacaaagtgtgaggttgacac

SEQ ID NO: 541999 - DNA, 338 bp, Homo sapiens
gaaaaatccatgtatattttttgaacctaaaatactttaccgggcaagcagtggaacaggtcccagtagaaccctacaagatccccttgtctcaggctgaagtcaatccaggagggcagcgatgtgactctggttgcctggggcactcaggttcatgtcatccgggaggtggcttccatggcccaagaaaagcttggagtatcttgtgaagtcatcgatctgcggacaattgtgccttgggatgtggatacagtttgcaagtctgtgatcaaaaccgggcgactgttgatcagccacgaggctcccttaacaggcgctttgcctctgagatcagctcc

SEQ ID NO: 542000 - DNA, 519 bp, Homo sapiens
tctagagtgatcacgaagtccccgcgtacctgccgcctgaacgaagaccctcaacaaatttcggcgcttcaccggccgggctgaaggcatgtcgatcagtttcgaagcgcatctgctgggcgacaagattgagttcgacgaagccggcggcacgctgataatgcgcaatttgccaacccagctcgcagatcaactaaaacgtgcagttgcctgattagagttgtccgcgccacgaaatcgtgattaacgaaaacgtggcgcggctttttaagcaggattcgggaaattgcgcgagattcaggtgatgaagttatccgatccaccctgcttagatattagaacctaatgcatgatcgattctatccttcgccacttctctacccctatcaacagcggcctcataggaactgtattgcgctttctccacgatcgctaggcctttgtaattcgcatgatctatatggatggcgactccaaccggaatggtattcacgctatcccacgcggggggtaccgagc

SEQ ID NO: 542001 - DNA, 541 bp, Homo sapiens
gggcgctcgtggtgcgtgtggtgtgagcgggcgctggttgtttgttgtggatgtttatggcgggtgtgcgtttcgttggctggtgtgtgcggcttgagctggagtttggtcttgttgctagctgtgggacggggctcatcttgtgctcgtgcgaggtcgctctggtttgcggtcactttcgtgcgcgcctcgtggcagctgaatttcggcgcggcctcagccggctgatgtgttgtggttgcgcgtagagatggggtttcgtctcgttgtcctggctggtgtcgaacgtcgtgtcctcatgttgacccagagcggcttggcgtcgccaagtgctgggtccaccccgtatggagaccgagccgcgtgcccacatggtggacgtgtctcactctgcagactggggtacccccccttgtttgggacaccccaattcccggcctggggggggccccaagtttccttccagaggccgagagtatttaataggagcggggatcccgaccgagagggcccctccaccggggacaaaaagaaattatgc

SEQ ID NO: 542002 - DNA, 463 bp, Homo sapiens
cccacctttcctttcctggttccgacaggtttgggaagggccgtggacctgcatatggggtttgccctcttggccccgcccttttttttggtgcctggaaaccccttttttttaatgggaggaaaattaaaagggcttccccctttatcccccttcctttaaccttttatttttttaagggccaaaaaaccatcccaccccccgccggagctttttttgggcccttggttgcatcagggcagggggggccccaggagcccctttggtttccccccagggtacctgcccaggaaccccttcttttccctgggaagtcaaggggggaccattgccccccccccggggggttttgtttttttacctgggagggggggatttttttttttaaaggcctttaaatttcctttttaaaggttgggagccgccttttttttttattattaaaggagtgccccagccgcca

SEQ ID NO: 542003 - DNA, 809 bp, Homo sapiens
  misc_feature (489)..(489): n is a, c, g, or t
gagcggcgcgggccgtgtccccggggcctccatgatgtgaggagcgagcggccgcctgcggtctgccgccgccgcctcctcctgcctgtccgtctctggctcagtgctgcggtgccctgtgccccactggtggctggccctggtctcctgcacccatgccccctgtggccggtgccctggcatggtaagggatggcaggctgtgctggagtgcatgcccctggtgcccactggcagggcaccggatgccccatgaagcctgactggggatcctgcactttatccatgcactgatgtgggcgctgcttcgaaagccgagaaatgcccagctgtggaggccgagcgctgccgagttacaggctcacggtggccttccttcagggagagaggaaaagtggcaggagaatctaaagacggacctgttgcggcggatcaagatgctagagtatgcgctgaagcaggaaagggccaaatatcataaactgaagtntgggacagacctgaaccagggggagaagaaagcagatgtgtcagaacaagtctccaatggccccgtggaactcggtcaccctggagaacagcccgttggctgtgagaaggaggggcggcagcttctccgcacaataccttgatgaacgatctatgacacgcatggcctactcacatctcccaaaggagtacctggacagacggtgggctacacaagacaccatccctcgacaatgcggaccaacgcagcgtccgttcctgctgggccgctcgctggagcatacaacggggcacgtgaagccgacgtgaaaggggccccca

SEQ ID NO: 542004 - DNA, 210 bp, Homo sapiens
ttcttttccacagggtaaaattatcagtatccacgtaatgagtttaccacgagtctccactagactattttgaatgcgtgctggtagttatgaaggtgtacacattattttcagatgatatcttcaaatcagacgcacttttgaacttagcatccccagatttgatgcacctggatacatgggctgtgcctgacctaaaacgtgtgtctg

SEQ ID NO: 542005 - DNA, 391 bp, Homo sapiens
gggccaggggatccctctctcccctagtgccttcccccctttactccccagagcagcttggcccagggaggggggattctgcttatctggttcccccctggcccccaggcagcccctggttgtttatcagggtttgtttaccccgtggaattgaccccttccccccggggtggttgggtgggggagcccagggcccctgtgacccctccttttttccccccgtccccaggttgggtttagctgccaaattagcctccccatggccccctgtggtttcctgggggggcaggggggtgtccccccccctctgtttacctctcccctcttccccgctgtttcgcatattgatgagttttctttttttgcccaataaaatgatggaaactcatga

SEQ ID NO: 542006 - DNA, 83 bp, Homo sapiens
ctctagtgcatcaatcgccacatcactcgagacgtaaattatggctgatgatccgctacctacacgccactggctctcaatat

SEQ ID NO: 542007 - DNA, 276 bp, Homo sapiens
caatttacttcccatatactacctcaacacaacctcactccttcctctctccttttactttagctacccatctcctctccctccctttacacatcttaccttatatatcattataactccatcttcaccttcccaccactacttattacctactttctccccttccatcacctccacctctactcctcccaccctccataccccacttccccatctcccttctctttctccctctacccacccccatcctcctccccctcccctccccttcctccc

SEQ ID NO: 542008 - DNA, 143 bp, Homo sapiens
ttaggactctgtgggccctgagtgtatactagcgaggggcacagataagggacatcatagccactaggggcagaacagctatcagctccaagctgcacgcgccgtgggtagagtgatcgcgccgacttgtcactagccacata

SEQ ID NO: 542009 - DNA, 1028 bp, Homo sapiens
ggtacccatcaatgctctactgtaacggggacggcgatttgagctggtgcccaatcgggcgctgcatgtgcaaacgcagtgcttcgatgccgttgagaactggcaccgtctgcccgaggttgtccatctaggtgactttcaaggcccaaccaaggtcgatgatggcctgtacccactgtcccatcaacatgccggaccacttctgaatgggggccaccaactgtgtctgcctgcaatggctactacagagcatgacctgtgaccccctgtgacattgccctgtcacaacacatcccctccgcgccccattgctgttgattttccatgttgtcaattgagaactcccattcaatagcttggatgttggaccccataccacctgcgaactcctgtgacggcccgatcagtgaacctctcgtctactaaccattcattctgcaaagatgcttgtggccttcgcgggcctggagtctggccatagacaacccatgcctcgctgggagactaactcgataccacgtgtcaccggcaaacacaaccgcccaatgccttaagaggtccctgcaccccggaagtcaccacacaccaatatttaaccattcacgttagacaccttgccattgggcacccaaacaacacactacgatctaacacacgttttctgcagtcaattacaagtgatcttgttcgacaaaacgggtcgcatttcaccattgtaaccaactaataccccccttttacttctggccccgtaccaatatattacggccccgttcttgcgttgaaacgcgatttcgacagcaacccacaccgcgatgtgcggcaggccattcccaagtccgggtcacaattgtaggttccgtattccatcttgccacttccagaggttgacgccccgtaccacgcgttggtggcaccctagccattttactcccataggtcgctcggggccccccagcgcacagggggacgcccacggcgcacccacagtgcggcaggttggaactcctatgggaccatcacttggc

SEQ ID NO: 542010 - DNA, 82 bp, Homo sapiens
agtatggtgatgcatgtggaaggatcacatgagattgaggagctagggacaacctgggcaacatagcaagaccccgtctctt

SEQ ID NO: 542011 - DNA, 342 bp, Homo sapiens
ggatattggtatctgtgggaggtactggaaccagtcgcacacagatattgaaggatgactgtacttatttagcctgtagactgttccttctgcttccctgggacccctgagagcagagattatgtctggaaagtacactgctgcgtccccagcaaatggcggtgtctgagccacagcaagtgcttacaaaaagctgggtgagtaaataaatcaaaggcagaggtctatccattaaggcctcagttcccagggatgaaggtgggactcaggcaggtagggaaatttcctggtgaatttagggtcaagaggaatcagctgcctaggccccctacagcccactcc

SEQ ID NO: 542012 - DNA, 160 bp, Homo sapiens
atggctcgtggtcccaagaagcatctgaagcgggtgcagctccaaagcattggatgctggataaattgacccggtgtgtttgctctggtcatccaccggtccccacaagttgagagagtttcttcccctcatcaattttccgaaggacagatttaagtat

SEQ ID NO: 542013 - DNA, 690 bp, Homo sapiens
gaagggagagggagggcctggggtgggtccccactccccaccccaagccacagggactcccaccagggtctgggagaggacaggagctggcatctgatgagcgtctgatggcacacacagtatatcttgcatgaccatatgacaattcagacacaaccatcatcactggacccatcccgtagatcccgcacctgcgtgtccacgcagtgagtaggagggaggtgcagtccccagcccccacccctcaggtctgtgttacttggtttttaagcgactggttgggatagaaccctaaagaaataaacttccagtggataccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaatttgggcccgtttggcccaagtgatttttaaattgaagaaattttagaaatgggcccaaaattggggcaaattgggcaaatggccctaatgggggggcatttaaaaataaagtgccggagttttaaaaacattgaaatgggaaaaacctggggttccccaatttaaagcccttgaaaaaaaatccccttttggaaagtgggcaaaatacaaggccccccagtaggcctttcagatggggt

SEQ ID NO: 542014 - DNA, 185 bp, Homo sapiens
gagcttcgacagcacatgaaactatcaacagagtaacagacaacctacagtatgggagaaaatatttgcaaactatgcatccaatgaaggtctaaaatccagaatctataaggaacttaaacaaatatacaacaagcactgtcccaaaggaagggcagtcagtccagtcgtggcatcgataaaca

SEQ ID NO: 542015 - DNA, 366 bp, Homo sapiens
  misc_feature (314)..(314): n is a, c, g, or t
  misc_feature (366)..(366): n is a, c, g, or t
gtgaactggtagatagtggattgccaaccatatgaaatgacatctgtatatggcagctgacatgtataaagctcatgacggctagatgaaagtaatgattaattaagagcaacacatcattcgaattacccaggaatagcatatcgtacggcggtgcatagaaagcagtgatagagctcacagaaacggatcctcggtatgtatactttagaccacctgacaatccacctgcactacactaggaatctgatcctgtccgaacgctgagtctgcaccttacctgttatgaggctaagaacaccgtcgcggccgantggaatactgcagactgtagccggccttaccatgccgtccagggcctgtttn

SEQ ID NO: 542016 - DNA, 602 bp, Homo sapiens
gcacagagccagctccgtggcgtcgtggccccattactgctgccttgcttcagccacctctcctgcccctccctagtccctactcatggtggacagcagtggggactagggaggggcagtgagtaggagggaggtgcagtccccagcccccacccctcaggtctgtgttacttggtttttaagcgactggttgggatagaaccctaaagaaataaacttccagtggataccggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaatttgggcccgtttggcccaagtgatttttaaattgaagaaattttagaaatgggcccaaaattggggcaaattgggcaaatggccctaatgggggggcatttaaaaataaagtgccggagttttaaaaacattgaaatgggaaaaacctggggttccccaatttaaagcccttgaaaaaaaatccccttttggaaagtgggcaaaatacaaggccccccagtaggcctttcagatggggt

SEQ ID NO: 542017 - DNA, 875 bp, Homo sapiens
  misc_feature (338)..(338): n is a, c, g, or t
aatgagaaaaattatatctgaatcaagattcatgttttatttttatttttttgatacagagtctcactctgtcactcaggctggagtgcagtgacatgatctcagctcactgcaacctccgcttcctgggttcaagcaattctcatgcctcagcctcctgagtagctgagaccacaggcacccgccacacacccagctatttttggtatttttagtagagacagagtctcaccacattgcccaggctggtctccaattcctgagctcaggcagtctgcccaccttggctcccaaagtgctgcagttacaggcgtgagccatggacctggcctcatgtntgtcaaactaattgccttttatatttaccccttttgtcatcactttagaatgaaacacttcccatttacaatctgaaagctaccttaatagtcctctgtgttaataggaccgtactattatagtacttataattccatgagatctaaagtatcttctcttttcctttttcttctgctgctttaggggacaattaaactgcacactattgacacgcttgaacattttattcctacctggaaagttacccgagttctggtggagcataacgacactggcgttaatccacctctggtcctcctgtgttgactgctggcccatagttttcatttctcctccctttaacatagaagtgtccgcttcgtcagctaggtaccaggcatgtatagaactgtgctataagggattaaccctatagtttttggcgccctaacagttgatcggccccgaacttattgcgtggactcaaacacgtgcagccctcgctctaacacacgcgacgcacaatcccctctctggtcaacccccccagcactctt

SEQ ID NO: 542018 - DNA, 1172 bp, Homo sapiens
cgtccccctctttctcttctctgcgggtggtgtgtgtgtgtacaaccgcagggttctgtgtttaaggggagcccgtgttccgggttcgcccctgtggggtgacgcccccatattcccaccccctgtgttttgtgcagccccccccgcattagaggaggacacctcgggggcccgatcttccccggcccttctccgggcactttctttagccctttaggccccgcggggggagcgggagtaaccacgagagttttcgacccacccacggggaaaccacgccttatggcagccactttaggggcgcctaatttttagaggtgacccacccatatttatggaaccacacagtttttggtaccacacaaaaaaacgcccagggcgtttgggttaaccccgcggttctccgggaaattttctccccggggattatttctggtctggaccccccaaaggcgggtccctcggtctacaagaggtttgtgtggagagatttcaacccacagcgcccatataaatggggccacacctggggtgggcgccaagtcccactctctattaggggggaggaaaaatttggagaagattgtaggggaacttttcactcctctctataggccactatacggggtttcccctcggacacttcctttgttccccactgggccacacaaattgcttgggagcgccccccaacacacccacaaatggggtgtcccccaactttttcaattctgcacctcgcccacaagagcttgaagttggttttggattggcacacgcacacgttggttgttttggcacaaagtgggaaagagaaggcactcggatattgtttgggaaggcccctcggaggcgctcttgggtgcccgcgagatggcccaagagcccggccacgaagattcaccccttggctcgagatcgtgggagccaactcgcagataaagtttgagactctgtggttgttattcttaaccacccacgagtcacttccttctgtagctcacggagagcaccccctccacccccactttgctcgcacgtatcctagagattctttgtgcttctcgctgcacgttccctcttgggttccactgttttccttgttccctcccacatgcctagctggattgcagagttaagtttatgattatgaaataaaaacttaataacca

SEQ ID NO: 542019 - DNA, 298 bp, Homo sapiens
gtgaatagtgactggcgtgtggtgttagataggggtgccggaggtggatcacagcacgggcctttaggactttgcggcgaggccctgccaccatccacagataaccactctcctttggagagacagggcttggcctgctgccgtgccttagtagaaactgaatgtttgaccatgggccaccaagttaccctgtgatctgagctgcccaccatgaactggggaattatctgacccacgtagccataaagttgggcatgcacagcagtgctccgtcatccaacagagaggtatatacatg

SEQ ID NO: 542020 - DNA, 484 bp, Homo sapiens
caacatagtttctgtataatgtttgaaaacttctacaaggtttcacattgaagctttgtatttttagttattaaatacgcatttaacagaaaagtcacagaattctcacttgaaagaattctatctttcaaaatccttagtacaaaatatagttttccatcatccttactagtggcaactaaaaaaagaaacaaacagatgcttattttaaaatctaggccgggtgtgggggctcacacctgcaatcccagcactctggggaggccaaggcggacggatcacgaggtccggagattgagaccacggtgaaaccccgtctctactaaaaatacaaaaaattagccgagtagctgggattacaggcgtgcaccaccatgcttggctaatttttggtgtttcttttgtttagttttggtttttaatttttttgagatggagccactgtactccagccgatagagtgagtgagactctatttcaaaaa

SEQ ID NO: 542021 - DNA, 642 bp, Homo sapiens
  misc_feature (69)..(69): n is a, c, g, or t
gactgttacatgttacccatgctatcattagttcatctatagggtcatagactggtccgattgggtgtnatgagtccagttatatgttcgggatcctttaggtagtcagtgttgagcttgaacgctttcataactggtgcctgcgtttagccatactatgggtgttaacagtaatactctctgtacaaggctatttcctagtgtccatagatctgttcctctttggactaacagttaaattgtccagcggatttagagggatctgtgagcaaacttagagttgctctaaagtccgatcgtgcactaccagccatatccaggctcggtaagtttgtcgcctctacctatatatcttcccgctcttttacatcatatccgggtgtgctcttttagctgttcctaggtagctcgtctggatgctctgataagagctttggctagccgaacgaagttatttctagttaatgcaatatcagagcgtaataccggattagtccatagcatactatgcatggttatcatattacatcttcaccatccggtactatatcccacgtcaccatttagcttccatacagagtattcccaattttcgttgttggaagttcaaagtttgcaagttagtaatgtgtagttaatgag

SEQ ID NO: 542022 - DNA, 818 bp, Homo sapiens
  misc_feature (43)..(43): n is a, c, g, or t
  misc_feature (101)..(101): n is a, c, g, or t
  misc_feature (115)..(115): n is a, c, g, or t
  misc_feature (117)..(119): n is a, c, g, or t
  misc_feature (125)..(125): n is a, c, g, or t
  misc_feature (174)..(174): n is a, c, g, or t
  misc_feature (209)..(209): n is a, c, g, or t
  misc_feature (227)..(227): n is a, c, g, or t
  misc_feature (255)..(255): n is a, c, g, or t
  misc_feature (286)..(286): n is a, c, g, or t
  misc_feature (303)..(303): n is a, c, g, or t
  misc_feature (310)..(310): n is a, c, g, or t
  misc_feature (324)..(324): n is a, c, g, or t
  misc_feature (342)..(342): n is a, c, g, or t
  misc_feature (354)..(354): n is a, c, g, or t
  misc_feature (357)..(359): n is a, c, g, or t
  misc_feature (365)..(366): n is a, c, g, or t
  misc_feature (371)..(372): n is a, c, g, or t
  misc_feature (375)..(375): n is a, c, g, or t
  misc_feature (383)..(383): n is a, c, g, or t
  misc_feature (438)..(438): n is a, c, g, or t
  misc_feature (444)..(444): n is a, c, g, or t
  misc_feature (449)..(449): n is a, c, g, or t
  misc_feature (454)..(454): n is a, c, g, or t
  misc_feature (459)..(461): n is a, c, g, or t
  misc_feature (466)..(467): n is a, c, g, or t
  misc_feature (477)..(477): n is a, c, g, or t
  misc_feature (511)..(511): n is a, c, g, or t
  misc_feature (521)..(521): n is a, c, g, or t
  misc_feature (564)..(564): n is a, c, g, or t
  misc_feature (574)..(574): n is a, c, g, or t
  misc_feature (576)..(576): n is a, c, g, or t
  misc_feature (581)..(581): n is a, c, g, or t
  misc_feature (583)..(583): n is a, c, g, or t
  misc_feature (598)..(599): n is a, c, g, or t
  misc_feature (620)..(620): n is a, c, g, or t
  misc_feature (623)..(624): n is a, c, g, or t
  misc_feature (631)..(631): n is a, c, g, or t
  misc_feature (637)..(637): n is a, c, g, or t
  misc_feature (641)..(641): n is a, c, g, or t
  misc_feature (653)..(653): n is a, c, g, or t
  misc_feature (777)..(777): n is a, c, g, or t
ggaaaatactttgtttaaaaaaaaaatggggttatttacatanaacaaaaagtctcaaaagtgtaaatggggaaatcttccatttttagattagaattatntatggaaaaaaagnannntttctntagtctatgtttatataaaggaaaatggaactagttatgaatttttagnaaactcctcaaatataaacagaagccaatttaacnaaaacgaagtaaataaantgtgtacagtccctacacagattagtanagtttacaattaaatatacagaattttaaangtgctaaagggaaaggnatcttanattttgggtaaatnttactcaatctaaattanattttggttttnaannngagganngtgtnngtncaggcagnggtgcgtgatatactttctcttctttatttacttctatcattctctttctcttgntcaatntcctnagtgntaagnnngtcanntccttttcgnctttagatcttaaggcttgcaaagaaattatcanggtttaagcntccagtgtcaatttcgctataaatattaccattactttttctnaactcttctngngtttntnttcataatttccaanngtctttttttttttttttttnttnnatatggnaatggncagnaggacaaccacnggaataaccagaagggttgtaatgagaacaacaggcactcccgagcctggctctttgatcagtttctgtttctcttgcatcttctgcaattctgaggaggtgggtttgttctcattttggtttnacaactgcctcggcttctttgatttctggacctcaatgcaa

SEQ ID NO: 542023 - DNA, 1154 bp, Homo sapiens
ggagctactgagggtctaagtacgggcagtcgaagagtgtggttggccaagatgaatcaaatgatgcgcaagatgtagaagtcgagcagtattaaacgcgaagaagttgatgagaacatggtggagaatagagaacggctgaatgagttgcgtagagagctaagattaattgaattgtggtctggagaggatcatgttgacaggcatctaattgtaagaagaggttaatcttacaatgacacaatagggacttagatagactgttcactggttgatgcactaggttggattgataatcactgctaaaaggcggagacgttggtacgcatgaaagtgtagagaaggagctcgcgtagcaaatgatatagaggaacattcctttgtcatcacgtatgcgcatgccattctataggttgggagatttaagaattggtgtcggttgtggtctagagtgatctgagacatgtcagaaattttgccagtatagttgtagatagaagaaaagtttgcccagaagattatcaaagtcgcggtatttcgcggacattgaaatgcgctaattactaggctctttgtgcaagttaaaatggcattcgcttatagcaattgtggataatgttgggagtttttgggtgccccattaatgaatgtgtggttgattactttaatgtgaaaccaataatctttctaaatgtaaaattgtaaggtaattggacacgggttatggacttgggcgggagttggtggcaagattggacgattgggggaacctttgggggtccttttggtaattttaaacttgaaagttgtccatcccaatagcaatttatggtttggaaggccggccaaattgaaggcgacatttttaacatggtcaagttttttgaaaggtattcaaaacaggaaatggttaacgaggattgagctccagggtggtgtcaaactgcagaaatggaaggaaaaggttagacgcacaaatgggattgtaaacgtgggaagttggcattaattggggtggggtaaatataccttaatgtggagaaggtatacacggactcaaattattagtacagttaaaaatgtgggtgaagttgctccccaaagtgttggggtaaacgtaaccagagggtggagaatgaaggttgacgagcaat

SEQ ID NO: 542024 - DNA, 219 bp, Homo sapiens
gctctaaagaaaagaaaaatggaggctgggcgcatgtgcacgcctataatcccagaggctgaggcaggcggatcacctgaggtcaggagttcaggatcagcctgaccaacatggagaaaccctgctgaaaatacaaagttagccaggcatggtggtgcatgcctgtaatcccagctgctcaggagcctggcaacaagagcaaaactccagctcaaaaaa

SEQ ID NO: 542025 - DNA, 419 bp, Homo sapiens
atgacgagttagtgggtgcagcgcaccagaatggcacatgtatacatatgtaactaacctgcacaatgtgcacatgtaccctaaaacttaaagtataattaaaaaaaaaaaaaaagaaccaaaatgcagaaaaaaattccaattccaaagaacaaaaagataggttgggcacagtggctcaccctgtaatcccagcactttgctaggctgaggagggcagattgcttgagctcagcgattcaggaccagcctgggcaacatggcaaaacctcgtctctacaaaaaatacaaaaattagctgggcatggtggctcatacctgtaatcccagctatggagaggctgaggtgtgaggatcacttgagcccaggaggtcgaggctgcagtgagctgtgatcacaccactgcacttcagcctgg

SEQ ID NO: 542026 - DNA, 313 bp, Homo sapiens
  misc_feature (204)..(204): n is a, c, g, or t
  misc_feature (238)..(239): n is a, c, g, or t
tattggtaattaattgaggatttaatttgcatttccttgataacttatgaagatgaacacttttttctgttggccatttggaattctacttctatacactgcttgttgaagagtttaactcatttttctgccaagctatctgtgtcagtcgtctttcgattattctgctggctttctcttttagtgttatagtcacgtccacanctcaaccacttcaaatatcggtgatggcttgctnnaaaattcctatattaaacaggttcttataggaaagtgatgttatatattcacaagggatattttgccatagtca

SEQ ID NO: 542027 - DNA, 668 bp, Homo sapiens
cagcagtggcccctcgttttatcattcccagtccatgtcatcacgtcagagaaaaatcttcaggggtgctaatcctgtgcatcagttgatcatactaacgagaacggtaatgcgacaagatacacatgccttcatctgtacattctgtgataccaggcaaattaccaattacacacagctacttatattttatgaagggcattttttagatgacctcatcctctgtgttattgtgatgggttgttttctgttgtggttgttgtttcttccacgtaaggaaaagtagtgtaaacagtagcgagaaaatggaaaccacagaggaagatgtatttgcatgtttttcctttcagtgttcttacacgttgtatcactgcattgtggtaatagcttctataaaatctgccatagttggattatgcagctttgcaaaaatttttactagattttgcactaactcatattagcttggtcctaccaacttctggaatttatctaattatggtttttcaaagtttctttccttttaatgtttccctgctatgcaaaacctttccagacctcagtttcttaaaagaaagatgtgctacagtccgatcttcttataccggtcaggtgtccggtattcgggttaatttatctaatgaagccatccttttggccttaagtgg

SEQ ID NO: 542028 - DNA, 122 bp, Homo sapiens
aaaccctgacgaagaatgagagaagtaagccgagggcgtctttgattgtgtatagggtggaagtgatcttatcggaatgggaggtgattggtcccaggttgtgactggttccaggttgtgct

SEQ ID NO: 542029 - DNA, 542 bp, Homo sapiens
gcgtcgaccaaggtgtcccgatctcgaatcgctcgtcagattgctgtgacgtacgttgcgggggaagacgtcgcatcggcggtcgataaggctgctgatcaggtgtctaagggcctagacgtcagcctgcacccccttgatcccgatcccgctgacctagcccaggcccgacgagcaatggtcaggctgtgcggggttatcgagagactcggcgctgatccgtcctttaatggtcatgctgaagtgtcgattagcttggcggctctggggctgaaaatcagcgacgatctggcccgggaccacgcccgacaggtctgccaggttgctcgcgacgaccacgttagctgtgaccgttgacgacgaaagccccgacatacatgaccgctcgcatcgcattgtggtggatctgctgagcagatacgaaaacgtcgacgcgcaggaaattttgttataattcaacgagaattccgagagggaactgaggaggacagtttcccgaaatggggcgggtgaagatgggggaaaaagggaagaggttcttt

SEQ ID NO: 542030 - DNA, 815 bp, Homo sapiens
agaggggtcttgaagaagattagattgggaatagaaggtgagtcctacctacaagagaaaatagtactggaagaaggcctggcaggccgaccagaagtgatctacaactatgtccactagaaccctttattacgatagtgtccgtggttagaaggaagaaggaaagagtcgtgcatgtcagactttactgctggtgttaaaggagttagatatctatcatccaatctgtgcaggagactgctagcctaagtacattccccaggatccagactggtgagtcatgctttccaaacttcgcatcaagtggatgatgctggatattctccctattcgatccccctttctggcgaacagtgacctcggatcctgtaagtgcgacagaatccagtgctgtgatgctgatcttccttgaaaccatagccgatgctactcttcgcagtgacgtcgtactctcctcattctgcgctgcaaggccactcttcttcatgtgtgagatgcacataacaatgtttaggatattcgcagtgtaggctttttaaagaccaaaggtagctgaatggttttttgaaatgagtacaactctagcattgtgaagttccagttgtaaatgtatttgtttaccagtaggttttgtggaaattggttcttgtatgggggatggtcctttttcacacagctaggtcttttcagaagtggtggaaattggcagatggggtacttacagtttggactgatattcatcacacctcagataaatgcagagtaatatatagttgcactttataaatggtggttcaagggaaatgtcaaagctg

SEQ ID NO: 542031 - DNA, 755 bp, Homo sapiens
  misc_feature (549)..(549): n is a, c, g, or t
  misc_feature (687)..(687): n is a, c, g, or t
aaattttaccctgattgggtttcacaaggttttcgtaaacttaagggccaccgaaaaaaaccggaaagctctttgccctttggaatggccctgaggttcaaccagggtggtatctcttttaaagtctgggaaccggtgcaatgccttggcccactactaagtggagaagaacttcccagccatttgccatccaccgtggaatgccccagaggagagggctttctcggtatcagcagttaaaaaatttccagggggttattcttgtgtctaacgaatctatagaagttacagcaggcctccgagcgggtgaacattgcttttaaataggacaggcctgaggattctaacacctacctgcatcgggtggccagagcaggccggtttggcaccaagggcttggctatcacatttgtgtccgatgagaatgatgccaagatcctcaatgatgtgcaggatcgctttgaggtcaatattagtgagctgcctgatgagatagacatctcctcctacattgaacaggacacggtagaagactctgccacatttggnaatgtgccgtcttgtccttcaggagagagacaccaggtgtgggtggtgaagagatgacacttactgccacccacaccctgactagcccccaaacccatggattgctcatctttttcatacaccaccatctcactgaancccccatttcgtgatattgtcagaattttttttttaacaaaacttaaaaaatgaaaataaaacaataa

SEQ ID NO: 542032 - DNA, 101 bp, Homo sapiens
tttgtctgcaatccctcctcgttaccggcctaatatcaggcttgtgtgcagagttgggggcacatgcagaactgatgtggagagacttccttgactgaaat

SEQ ID NO: 542033 - DNA, 964 bp, Homo sapiens
tatggatgccaagctggaaaccctgaaggacttggccagcctctcccggtatgtcacgtatggccattggaatatataacaccctggatgtgtatctctctgcctcacgcatattgtggcaggagcgcgcactgatgcgataccagaaatagcaaagagatcatcgaacgccttgcgtttgggagaccattgctgtccttcaccctgaacggcctctcgtctgagctcgatgtgaccagtaggctatagttggtccgtggagtatacgattggccggatggcgtgcatcaaggaagataggcaaggttctgtgaacaatgtcagacagagactatctctgatcctgctagctgggccttggacattccgcagtcgatggtgctcagatagccatgacctctaccagtatagtgcgacgcatggagtatcacgcatcggaccaggtcattccactacctgcaagaggtcagtatcaagaaatcctaataactatagaatattgcacgtgattattgcgcattttcctgcaaggcctcctgaatgagaggcaggctggagatggcgaatattcttggttcagagagctgttgcgttccatcattggacctcatgtcatccgagtcgccagcgggctcatgaagaatgagatggtgcaccgagtctgtctgtactacgagtgctctacctttaacctccgggatgacgggtggctgactggcatggtcccccgggaccgcatccgaaggggcttccatattggacgtcgaagaactgcgatgaatgctgggttgaaactgtataaacagtggggctgtgaacccagggcaggtgacgcggaaaataaggagagggggccaatagtaaccgccaggtacccaaaacaacggggtgtgtccgggaattggttttcaccccaagtgatgctatggttaaacgaccaaactgtcatatcacagactacatg

SEQ ID NO: 542034 - DNA, 396 bp, Homo sapiens
cgtgcactcgttgttatactttataatggtaggaatcttatttctgtatatattataggaatcttatcttttctctggaaggattatttatccagcaccccctggctatccattgccagctaggctatatagcgagttgtctgatagatctgtggttccttcgatgagctctgtgttccactgatctacttatctcagctctctgtctgtacaggcgggtttgcttgtgcttcactttttcgcacttcacagacactgcgtatttcactatttgacggtttgtgtgctaccctgtattgagcatgtctattgttgccctctttgggtgccgggctccacttcgttctccttgtcgtcgtctgtttcctgtgttggccccctgttgaccctgtcggg

SEQ ID NO: 542035 - DNA, 288 bp, Homo sapiens
gcgagtcaagaacaccacacacgtttcctggctaaagcacccagtggtgtcatctaacagagtaaaagaaacaccagaggaagtgtaggaatcatacattccgttctggatgtgtacggtataaggggcatccaaatggaaacattcagtagcaattcgcatagagtggtccctcagcactcaggagcagaggtcaaaacactgaagcacatataaaatgacatactcaagcaactacaagcatgcaaacaatgcacacatcagaaaagcgcatgcagcaaagcccta

SEQ ID NO: 542036 - DNA, 319 bp, Homo sapiens
  misc_feature (16)..(16): n is a, c, g, or t
  misc_feature (143)..(143): n is a, c, g, or t
  misc_feature (214)..(214): n is a, c, g, or t
  misc_feature (265)..(265): n is a, c, g, or t
  misc_feature (292)..(292): n is a, c, g, or t
gaattcggcacgaggngaactagtctcgagatatgtgtgcactggagagatgagggaggacagggtgttgtgattcttatggttatgggttctttctaatttggtcttgaggtctgtcaagagtggccataagtcaagacagncactctaggagagccctgattgggaaaagttaggtttgggtgtgtggttcaggtgagacgcaatgaggagntgaatgtaaaatgcatgaaatagaagaaatatgttacttacagatccaggngaggttagcggtgccaacgggaggctnaagaggaagtttagagatttcagggag

SEQ ID NO: 542037 - DNA, 709 bp, Homo sapiens
  misc_feature (108)..(108): n is a, c, g, or t
  misc_feature (600)..(600): n is a, c, g, or t
tccggccaggcaagccccggcaaccacgagcccagccaattcagcgccccggactgcaccagagccatggtcggcagaagagcactgatcgtactggctcactcaganaggacgtccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccaccgcgacatgaatgtcattctctggccaattcagagtggcattctgcatttctggggctttcaagtcttagaaccctcactgacatatagcattgggacactncagcagacgcccgaattaaatcctgtaaggatgggagaaacgcctgacgatatttgcatgagacaccatgattttgctccaagagctctttgcctaaacttcagcaaga

SEQ ID NO: 542038 - DNA, 224 bp, Homo sapiens
  misc_feature (12)..(12): n is a, c, g, or t
  misc_feature (34)..(34): n is a, c, g, or t
  misc_feature (116)..(116): n is a, c, g, or t
  misc_feature (121)..(121): n is a, c, g, or t
  misc_feature (201)..(201): n is a, c, g, or t
aggtggtgatancagcagagccccaactctgccnccttgtgtgcggattctccgctgtgctcccagagttactgctgccagactgaactgcaaggggaggatgtaggagcctgcanagctnacacctactcctgtggctctggagtgggcatcttcctgagagtacgggaatgtcaggtgctatttttagctggcaaaacnaaaggctgtttttattctcctcc

SEQ ID NO: 542039 - DNA, 98 bp, Homo sapiens
catggatttgctggtgcagtacaactaggcttaatagggacatggtgaaacactgtctctactaaaaatacaaaaaacgttagaagcttgaattcgag

SEQ ID NO: 542040 - DNA, 153 bp, Homo sapiens
gtatccccacctgtgcggtgacaggtactttgacccacccaacggccagttcagctaagtcagccaccagcccctaagggaagaagctgactacgcgcttctgccagctgatcctagaccccatcttcaaggtgtccgatgcgatcattaatt

SEQ ID NO: 542041 - DNA, 329 bp, Homo sapiens
cgactctacattactaccagacaaacttagccaaaccatttacccaaataaagtgtatgcggaagaaattgagacccgtggcaatagatatatggccgcaagggaaagatggttatataccaagcgttatatatgcaagggcttacccctataccttctggataatggattaacttgaaataactttgcaaggagaggcaaagcttagacccccgaaaccagacgagcgttcttagaacaggttaaagagcacacccggctatgtagcagaggggtgtgcaagatagaatattagatcaacttttttggccacagaccctcttttccct

SEQ ID NO: 542042 - DNA, 539 bp, Homo sapiens
tggtaacactagtgcagagcaaaggaggggagacatgccttataaaaccatcagatctcgtgagaactcactcactatcacgagaacaggatgagggaaactgcccccgtgattcaattatctccacccggcccctcccatgacacatggggactatgggaaccaaaattcaagaggaaattagggtggggacacagccagaacatatcacgttacgacactacggcacaattcatgacgctgtactttagacactacaaacgcagcactccgaaacgtcacgtgcacatgcgtgcgtgtgtgtgtgtgtgtgtgtgttagaccgccggactgaccgggcctaagacgactatctacatattcatgacggtattcgggagctaccctagacctgacgattaaaccatacaaacaacactaaatatacctgagtacttaatattcatgaggtcttacttagaccatccactggtgacacccattcaggcaccaggtatactctgcccagtaaaacaccaataacacccagaaaaagctcc

SEQ ID NO: 542043 - DNA, 603 bp, Homo sapiens
gaaagccattggcacgatgtgcagagttgaccgcctataccttctcacccggcaattctactctcaggttagtaccttagataaagggctgccaacgttcagaaaatgacaagcgtgcgaaagttcacggcagcttgactcctaagaagctggaaacagctcaaatgtccccagtggacggggcaggcaaactgtgacatgaagccagtgaaggagtcgccgctggggtcagcagcctggatgaaacagcgcggtggtgggctgaagaaacaagacacaggaggctgcctgattccacgagccacgctgaatttaggccgaacactcatggctgcgcagggagcagtcttggctggggtggggagttgtcaacaggtgggggcgctgggggccttccagggcctggaaatgtgccctgtccgccctttcccaccaggccgagcagctcccagctccatctgtccaggggaccctcacccccttgctgcccccacccagggcatttccagagccctcacccaggggacggcgcagaagccgagggtgcaccgggctccccagttgtgcgcgagcccgagtcacgggcagggggacagcggccgc

SEQ ID NO: 542044 - DNA, 335 bp, Homo sapiens
ccagctcagtgtatggtgcagttggcaagatcccaagagggttttctgtgaaaggtagaatgagagctgtggcttgagaagaaacaggcagcagggagtcccatcgtgtcagggtgtgttactactcccctgtaggaacacaagaaaaaacaaccaaccctaaccagctgtcacgtgtgcacatgttattagagtcctggtctcctaaggtattccaaccttggcccccatcacttccaaggacccaatattattgaaaaagaaaaacatattgcaaaattgaaaagttgttttgctcaccttacactttggtatgtttgtacccatcacaaact

SEQ ID NO: 542045 - DNA, 329 bp, Homo sapiens
cctttccgggggttttgtcccccccacggtggaaacccccccccttaaaaaagggtccggggccccccttccaaaaaaaaaggggccccccccccggggggttgtgggggggggtttttaaacccaatttttttacccgccccggttttttgacccccgggttaaaaggttttttttgggttccccctttccgggaggggtttgttcccccttgtttttgaagaaaaagggggaaaaggggatttcctttttttgaaagggaattttttttttcttccttgggttggcccccccccaaatccccaaataattgggatttggttttggta

SEQ ID NO: 542046 - DNA, 521 bp, Homo sapiens
  misc_feature (57)..(57): n is a, c, g, or t
ctcctgaatgagcacaccccacaacctgaggatgactacagcaatgacctgatgctntccgcctcaaaaagcctgctgacatcacagatgttgtgaagcccatcgacctgcccactgaggagcccaagctggggagcacatgcctagcctcaggctggggcagcattacacccgtcaaatatgaatacccagatgagctccagtgtgtgaacctcaagctcctgcctaatgaggactgtgccaaagcccacatagagaaggtgacagatgacatgttgtgtgcaggagatatggatggaggcaaagacacttgtgcgggtgactcaggaggcccactgatctgtgatggtgttctccaaggtatcacatcatgggccctagccttgcggtaaacccaatgtgccgggtatctacaccagagttttaaatttcaacacctggataagagaaactatggctgaaaatgactgagtatcacattgtcccatgttctcaataaagcccaccatgcagcaaatgaa

SEQ ID NO: 542047 - DNA, 749 bp, Homo sapiens
ggacggagccgagatgggggcgggcgtacggtgacgcactcgtctgtaccctcatctgcggtgctcatagacgaactccgcaatgaggacgttcagcttcgcctcaacaggcatcaagaagctgtccatcgcatgcgcgcttgtgacctgggggttgaaaggagccgaatgtgagtcttctgccatttccttacagataccatcatatgatgaaagatgaggtccttccgtggaccctggcagtaactagctgggaaccttcactaccctggctgggaggcccagagatacgtgcactgcctgctgcagcgatggagtcagctggccacgagtggaggagacagtggtgcgggacaaggcagatgagagtcctatactgggactcgatcgtcgacacagagcaactcgccctctgacctggaggcgcacttgtgtgccgctagtgaagcgagtggcgggtccggcgacgtggttgcacctccgcgcacctcggccatgcggtctcttactccgtctgcaatacccccgagtgtccagagctgtgaaggctggaaccttcgacagttacttccggaacctgtgctcagatgataaccccatggtgcggcgggccgcagcctccaagctgggggagttggccaaggtgctggagctggacaaccgtcaagagtgagatcatccccatgttctccaactggctctgacgagcaggactcggtgcggtgctggggtggatggcgtgcgtgaac

SEQ ID NO: 542048 - DNA, 281 bp, Homo sapiens
tgcatcctttcatagagtacatgtgtatgccttaagtctttataacccctggattagaggctgaattaagaccttatgtctggggacaagtagaccacttccacagcttcgatgttgaactcatggggttctgggtggccagggcatagtccagtatcaaaagaatttttaaaggcaatccctgctggcaaggtactttctgacttcagggacaaagcatcaatgaaattaatccagaaagaatgattcttgttgtccaggcctccttatacaaccacaag

SEQ ID NO: 542049 - DNA, 201 bp, Homo sapiens
tgcgccagagcgtgtaggccgacatcaacggctgcgccgggtgctggatgagctcactctgtctaagactgacttgggattgcgatcgagaggctgatgaagagtgctacttgaggaggacctgacgagggtgcaggactttgcacccgtgtcggcccatcaagtggtgtggtgtcccccggatgcttgcccgtttgcaaa

SEQ ID NO: 542050 - DNA, 417 bp, Homo sapiens
  misc_feature (79)..(79): n is a, c, g, or t
agcccatgtaattagtatcccttcccacattttccttcctccccctcaagagcaccttaaacttaactttgtaaaatanagtatttatttaatattgtgaattatttccttttaaagactttatccccaggctgggtgcggtggctcgtgccctgtgatcccagcactttgggaggctgaggtaggcggatcacgaggtcgggagttcgagaccagcctggccaacatggtgaaacctggtctctactaaaaatacaaaattagccagatgtggtggcgggcacctgtgatcccggctgctcaggaggctgagacaggagaggcccttgaacccaggaggtggaggttgcagtgagccgagatcacgccactgcactccagccggcgcgacagtgcgagactccatctcaaaaaaaa

SEQ ID NO: 542051 - DNA, 252 bp, Homo sapiens
tgaggtcacctagaggatccccttgggggtccatcagggtgacagaagtgagacttgtctcaaaaagaaaagagtacaaaaattagcgggggcgtaggggcacatgcctatagtctcagctactcgggaggctgaggcaggaggatggcttgagcccaggagcttgaggatgcagtgagccaaggaagtgatgcctttatgagcgggtagaacgggaaagtatcctcaggggtgacctagcggggaggcttt

SEQ ID NO: 542052 - DNA, 193 bp, Homo sapiens
cagatatatactagcatcttggatatctagtaacttctatgatcattactccaaagttgtaccagaaatggttctatttcttcattatccacctactccattgcttatatgaggtttaaggaaggaaggcggtatactccctattcaatatattttttctaaaatccaacttcatacgcccaggtcagcagga

SEQ ID NO: 542053 - DNA, 185 bp, Homo sapiens
taatagcggactgtatccagcattactattacagcataaactattacagcataaattattacagcataaactattacagcataaactattacagcataaactattacagcataaactattacagcataaactatggaagtccagaaggtttccatagtttatgctgtaatagtttatgctgtaat

SEQ ID NO: 542054 - DNA, 272 bp, Homo sapiens
ccgccccacatctcccattttcctagatctcaaagacctcagctccaggaggggagccatttccactctaagattctaagactctatagggcagagatgaggccgggcaggctgagtggcagagaggacgctgatcccacctgtatcctgcgtgctgtcttgcagatccccccctcccaccccatcttctctagttggcccctgagaaaatgggacgagaatggggggaagagggaggcagaagtacatctcctgcttacatgggggtttgt

SEQ ID NO: 542055 - DNA, 674 bp, Homo sapiens
  misc_feature (397)..(397): n is a, c, g, or t
  misc_feature (498)..(498): n is a, c, g, or t
  misc_feature (589)..(589): n is a, c, g, or t
  misc_feature (629)..(629): n is a, c, g, or t
tgtgcataaaatcatacgcgatgcggagggagcagatgcaaaccgctttcaggaacctgtgctcatgcgacaggggggctgcttttcaccaacggaacaggataacacttgatattggcttggatgtgaagcaagtgccatacttttctggagggaagggaaaatgtttcaaaggctatgaataacagttctagggcatctctgactcgcaacaagtagagtttccatctgattcgaaaaacatgccgctttatatttacccttgcggaacttatatacaaaagccgtatgtttacacatcggagcaccgaaactttatttatgagtgcccgactcgtgatttaaccgctcagcatgcagattggtgaacgagattacacactgcatatcatacagngagcatcttctgcctggtaagtgaatgaactatcctatattctcggcaacggtggatttcatgactattatgagttcctaaagaagccggctctagggagngagtactgtgtgactctggtgaatgacaattgtgctgtagtttccgatgcagacctcaggtctcgttgttgccctacggatagacagtttnaccgcatgcttaatgttccatatacgttctttggacaatnaaaacctttttttctttgggattgggacttttccaaagatgtggg

SEQ ID NO: 542056 - DNA, 324 bp, Homo sapiens
cagagcttatcccgggtctgggtacagtatagtagttctatctgtattagtacgttttcatgctgctaataaagacataccagagactgaataatttacacaggaaaaaggtttaatggacttacagttccacatggctggggacgcctcacaatcacggcggaaggtagggaggagcgagtcacatcttacatggatggcagcaggcagagagagagcttatgcaggaaactcccgtttttaaaaccatcggatctcgtgacactcattcactatcacgaaaacagcacaggaaagacctgcccccataattcaatcacctcc

SEQ ID NO: 542057 - DNA, 217 bp, Homo sapiens
ctcggccgtgtagagcggtctcatacagctggccaagaggcacaattaaaggtgctcaacactgctaattattacagtgaatacaaatcaaaaccccagttaagaatcacctcacattggtcagaactggtatcatccaaaggcctacacataaatgctggagggtctggagaaaagggaaccctcctatactactggcagagatgtaaattggttc

SEQ ID NO: 542058 - DNA, 222 bp, Homo sapiens
ttttttagggtttacctccccccccccccccccccggtttgggttttggggggcccaaattaggagcccccttattaggggccctagggtacagggttttccccccccggttcccccccggtttttttttttttttttttcgcccccttttcccccaaaatgggcaagggggggggtttggtttttcccccctcccatttttcccataaaacggggtgggga

SEQ ID NO: 542059 - DNA, 162 bp, Homo sapiens
gtgcttaagtaaaagtcacagggttgctatgggcatgtcacttacatcaatagatagtagaaattatgacaggcaaacttttcaaagattcagtgagccctaagggaggacttgatttcagacgggaaggggaattaatagtcaataaagaaggaaactccg

SEQ ID NO: 542060 - DNA, 407 bp, Homo sapiens
gttgtggacaggaaagcaatgctgtgcctactgggggactagtgctcataagaaccgatgggcactgacttctcacgcaccccgcgtccctgtctatgcgactcatgaatggagacaggcctctgactagacatccagcagcagactgagataccgagcacaagaccggcgtgtcagagagatgcagactcactggcaatgggtccaactcatcttgaataaaatacacaaagaaagaaagagagagagagagagagacagagagacagagagacagagagacagagagacagagagagagagagagagaacccgagaaaccgaaaattgtttttttatggaaggtttaaacaaacttggaaatagctggttctctccgaaaactatttaggtagtgcctcttgtat

SEQ ID NO: 542061 - DNA, 501 bp, Homo sapiens
  misc_feature (77)..(77): n is a, c, g, or t
  misc_feature (86)..(86): n is a, c, g, or t
ccccctctgtaaacggggccgccttcctttccacattccaagggtacctttaggccttttagagaggttaatttctnccttaattntagggccctcaacctcttggtgtttggggcaattcttttcccttcaggcttttccaaaccccaacggtttgatttgggtttaagaaatgtggtaattccccatggagaagccgggaaaggggcttaaaaccccggagttttcctgatccatgggcccgatggacatagacccaaggaaaaggaaggacgttttagaaataaaattcgagctggtcatgagaaggccttggaagaaaccaaagaaaaatttagaaagtccagagagggaattcgaagcagaaattcagacaaagaaaaataaggtagtcccaagaatgaagaataaaaagagaacaagcccactgcccaccagtccctattcccaacccttgtaggaatacgtggtggagacccagaagataatgacataagagag

SEQ ID NO: 542062 - DNA, 245 bp, Homo sapiens
ggttcccattgaagtgtcctaaagcagctccttggtccctgttggatcaggttcccatttcccagtatgaatggtcacatgcatcctccactttccacaaaacactgtgatttgaggctcagcaacagcaaatcctgttccggcattggctgcaagagcctcgatgtagccggccagcgccaaggcaggcgccgtgagccccaccagcagcagaagcaggagcctgaccgtggctgcggcggccg

SEQ ID NO: 542063 - DNA, 114 bp, Homo sapiens
  misc_feature (106)..(106): n is a, c, g, or t
tctatgaggatccccggaaactggtgatggtacatcttgcgttggaatggattcaagagagaaggaggagacggtgcatttagacaaccctcttgaagagttttanctcctcaa

SEQ ID NO: 542064 - DNA, 662 bp, Homo sapiens
gtgtcgtttgtttgtttcggacagttctgtgtggcacgacataggttcctgcttgacacaaccaaagaaattgggggagcgagggtccgattattgttcgcattatttgttgtatatgaagtgggtgaaagttctccactgtattgtttgcaattctggaatgcatctttctttcaataatctagagttagagattccagaaacagataattaatgttgaaatggatgtagaggaagttgaagcaaaaatgtgtttagtctaaaagtacttagagaaatggaaaggtcttaatgttcgagtgttttttcccttcaatgatgaaatgttctttgctaagaacttaatgtgtatgcctgtaagtagatgtttatttatccttttaaatgtcgcaaagtgctgggattataggtgtgagccagcgtgcccaagtggaataatgtactctttaatgtctcccaaccataatcacttttgtcaggctataaactcatactcagggagtagtgctgtggaatcctaccattcgttcatgatagaaataggaatccgacattcttcaactggttggccctgatagtgggtttacaagcaattttcgcaaagaatcatgtggaccaagccctaatggcgccttgacaacggtaacctcaccgcctttgtt

SEQ ID NO: 542065 - DNA, 92 bp, Homo sapiens
tggattcagaaaggcagtttaatttaagggcaaaattagggaagggttatgcccctccattccccctcctcctaccatcagtcctatcccaa

SEQ ID NO: 542066 - DNA, 1067 bp, Homo sapiens
cgtcgctgtgggtcccctattagccttctttgtgtgtggttcctttctggatatgggtgtgtatcttgtgaagctctgggggggagccccgtttttttgtgggctcttggggtgtggcgccccactccctcggagttttgtgggcccacactggtccgccgcctattgtgttggatactctgccagcggtgcggggggtgttttgtttgacagattgtctcgtgcgacacgcggccgctgacccgcagggggattcatcggggtgtgtgtttggggtgcgccgttggtaggcgccctctagagcggccggtctcgcgcccactgtgtgtgcccacccggccgtgggttgcccgtcgctgctccactgtgtggagccctctgggtggctctttggcgttttttgtgtggcacacccctttggggcacaagagccatattccccacaggtgtggagtccccgcacgagtgtgtaccacaatggcgcccgcacaaagggcccccctttgtgtgtcgcccacatagtgtggccactctcttgtggcacaaaaaagggcgcgggtttgagaggtttctccactgagagatattggggcgaccaaagagtgttaggacacacgggttctcctcgctgtgttctggaacacttctccacagcacggctctgtccacaacacaccagaggggtctccaaagacctttaaggggttcattggacacgaaatttgggaaaggcacacaagggaggaaaggggataactccttactcacccctaggagccccaagggttttggacacaatctttgacttgttctcttctgtctcccctctcacagacgctttgcgcccttggcgttttttatgaccctatttaccttccagcgctgagacccacatttgtttctcctttctccccagcgatctcactctccccaggaagagacccaagttttcccaccccataatcctttttgcccgacccctagttccctttggtccacccagacttgttatcagcttttagggcccagggtccaccaatagaaataaaggtagtaattaggaaaaa

SEQ ID NO: 542067 - DNA, 172 bp, Homo sapiens
gttttagaacaaatcgacaggatctaaagagatatcaaagcacgattttagataacctaaacggaccagcctatacgaagttgatttatatctcgatgtcatgtaaaagattgctgttcttggagtctggcaggtctagtcgaattgatttcctgcgtttctttcagttttt

SEQ ID NO: 542068 - DNA, 1602 bp, Homo sapiens
aatgaagcatcgcggagagaagtgagtgctgtgcctggtgacgacgtgcgtgctgtgtctgtgcacctgtggtgtgtccacctgagcagcctgcctgcgtgcacctggtgaacacaaaaaacacaaggcacctgtgagttgtgctgtgcatgtgtgctgtgtagctgtgtgtgctgaactgactgtgaatgctgtgagcctggtgcaactgttgggtgtgctgatgctgctggtgacgctgtgtgctgtgctgctgtgtgtgcctggaaggcttgagtgccctgtgatgcatgcatctgcacggtggctgtggatgcttgcatgtccatgtgcatgatgccctttcctgagtctggggctgctgttgaatgctgtgtgagaatgctgctgattgaccgggggtactgatggtgcctgtttgccagcttcgcaaaagctatgctcagtgctgaattgcgctccttcgacttcaggcaatcggatggatgacttagacaaaggctcctgtgtgccagaaggtctggggagcttgaagaccctttgtggagtgttagattgcgcgattcaactgaacatgtgagcgtgctgggtgctacccaaatgtggaggtgacgcccctgttagagcagtgcttggattgtcagtacaagcgccatagttagggcctttgccggaacatggctgagcgatggatggcttgccgtggggagcggaacactggcttagcggcacagtctttgcgcatatcgtcggactggacagaggctgcccctttggcctttgacaagcgcagaaatgagggcatagcgtgtggacagtgacattaacaatgaccccccttacgtggaggcactgtggaatcgacgcccccttttggggctcttgcggacctgaaatcgaacctttagtcaagggcccctttggaggcatcttctgcatcggaaacgggcatgcgccctggaagccaaggtcctttggctcacggcacaacgtggcacgcgcacaacgcgtggacgcccttggggtccaaaggcacgggacaaacgcactggtggggcctcccaaagagggctatcacacctttggtggcagtgtgggacacgcgcattttgtgcgacgcgcaaaggtgagaagggtttcattgggggactgtctttcaaacgggcgacaccgttttcacttgagagagactttgggagacaaggctggcaccggctgtggcaaagggtctctccgggggggggccaggagagagtccggacgcggggcatagggatgtcatcccccatttgcttataacacgtggtgttgtcgccccccgtgtgttgggctaaacacgcttgttcgcaggtgggatgacgcctttcgaaaacccgtgctgttgtcgtgaactcccatttttgccgcagatattgtgagaatttaatccccacttctcaccccgtggacgggaaagggcgggagcgggacgcacaccgcaaggtgacgaatactctgttttttaaacccgctccttacaactgggctgatcccaacaagaggcgggtcgagtgattccttcaccacaggacaacgagataggacgaatacggaacaacggtt

SEQ ID NO: 542069 - DNA, 180 bp, Homo sapiens
aaggagagaatcagaagaggtggtatgtgtacggagaagttaggaaaggtatcgaggtttagcaggagataactgaacatttagaaaatcaggctggtgccagaaagagggtaggcccgtgaatgcaaggctaacagaatgtggaatctgtgggttccttcttccatagcgatgagattt

SEQ ID NO: 542070 - DNA, 809 bp, Homo sapiens
  misc_feature (27)..(27): n is a, c, g, or t
  misc_feature (70)..(70): n is a, c, g, or t
  misc_feature (84)..(84): n is a, c, g, or t
  misc_feature (92)..(92): n is a, c, g, or t
  misc_feature (118)..(118): n is a, c, g, or t
  misc_feature (134)..(134): n is a, c, g, or t
  misc_feature (146)..(146): n is a, c, g, or t
  misc_feature (211)..(211): n is a, c, g, or t
  misc_feature (241)..(241): n is a, c, g, or t
  misc_feature (278)..(278): n is a, c, g, or t
  misc_feature (296)..(296): n is a, c, g, or t
  misc_feature (298)..(298): n is a, c, g, or t
  misc_feature (557)..(557): n is a, c, g, or t
  misc_feature (617)..(617): n is a, c, g, or t
  misc_feature (623)..(623): n is a, c, g, or t
  misc_feature (625)..(625): n is a, c, g, or t
  misc_feature (694)..(694): n is a, c, g, or t
  misc_feature (804)..(804): n is a, c, g, or t
tggagtaccggcgatggcgccaggtgnccccagcaaaccccctccagagctgcccccggatggcacaganaaggagggggcttnggagtaanttgaggctgtgacgcgggtcgacccncggtgctgggcaagtnagttctgctgtngccaagagaggtgcagaggtcgtccctgaggcatagaggtcgaacacaggacgccgtgggccctnatgaaaattaagacataaaagcacaaaaanggcgcaaccagacagcattggcttcagacaggcaggncacggggcccctcgtgtnanctgtgaatttccaaaaagggcaaggacctggcactgactccggccagtggagaaggctgtgccgcccacccggccatgactcagacccagaggctgaaagcgacagacggggccgcaggcaggcagctcccgggcgtctcgtgaagacacttcagaaggaaaaaatcctaaggaacagaatcctgaatggagaaaacccaacttttttaaaaaagaaggaagtgtatgatgggaatctacggggtgggttttctttaanaggtgagaacttggaatcttgcaagcactgggagtggactccggcggcggcgcagaccgngagcangngagcgtcctcgggccacctgcctcaggaagagttcctctggcggacgttcttgcctttgtcattctggngctgcccgctgctcttcagggggtgcagagccggcgtcgtcatcatccagggacgtcctcgggcttccggcgcttctcgtagatgaagatgatggtgaccagcaccagcncctca

SEQ ID NO: 542071 - DNA, 111 bp, Homo sapiens
ccatgctctgctatatgacgcctggaaggggggtcacccaagtctccctgctgtcatttcatggaggccgacccaagtctccctgtgctgtccacctcctctgtgctatcc

SEQ ID NO: 542072 - DNA, 321 bp, Homo sapiens
  misc_feature (180)..(180): n is a, c, g, or t
atggggaggggagcaggcaggaggagcagaattgccaacattgcacagcctggctgtcgctctctgattcaccactgcatgtgggcacgtgttgccccatcaaaccatgaccgcctcttgtgccaatccctgacctcagagcacttagcttgggttcaggatcaaacagagtgacttganaaggaagtagggttgtgaggtgcaggacaagggcaagaagggttgcaaaaggtcttggagttgagctttggaaatgtttggtatcagcacattgggcttttacttcagcagcagagaccttcgccaattccaaggaggagg

SEQ ID NO: 542073 - DNA, 461 bp, Homo sapiens
  misc_feature (2)..(2): n is a, c, g, or t
  misc_feature (77)..(77): n is a, c, g, or t
  misc_feature (83)..(83): n is a, c, g, or t
  misc_feature (116)..(116): n is a, c, g, or t
  misc_feature (145)..(145): n is a, c, g, or t
  misc_feature (154)..(154): n is a, c, g, or t
  misc_feature (222)..(222): n is a, c, g, or t
  misc_feature (324)..(324): n is a, c, g, or t
  misc_feature (332)..(332): n is a, c, g, or t
  misc_feature (338)..(338): n is a, c, g, or t
  misc_feature (343)..(343): n is a, c, g, or t
  misc_feature (372)..(372): n is a, c, g, or t
  misc_feature (385)..(385): n is a, c, g, or t
  misc_feature (397)..(398): n is a, c, g, or t
  misc_feature (403)..(403): n is a, c, g, or t
  misc_feature (427)..(427): n is a, c, g, or t
  misc_feature (446)..(446): n is a, c, g, or t
  misc_feature (451)..(451): n is a, c, g, or t
ancggcggcggcggcagcggcggcacagctcccgcagctcctgctctggtccgcctcggcccggcggcggccatcancccccncggcctcggctcgaggggcggggagctgcggcncccctcggtccgaccgacaccctcccctncccgcccgnccgcgcgccccgcggcccgcggcccgcagtccgccccgcgcgctccttgccgaggagccgagcccgcncccggcccgcccgcccggcgctgccccggcccccccggcccgcgtgaggccgcccgcgcccgccgccgccgcagcccggcttgcgccccgccgcctgccgcnttcgccantgggcntgccncttgaacagtaatgactctgagtactcantcgcaacgagganaaggtcgcacgnngaggntaacaaaaagaactagaatcagcngtataaggacaagcatggncaacngggccacgca

SEQ ID NO: 542074 - DNA, 244 bp, Homo sapiens
tgaaatccgctggctgtagacttggtctactaaaatacagcggagatagtctctatcttagggcacttttctttctcctcctagtcagctcacttccagacctttctttttcctccctgtatatatccctgtgacaacgtataaggcagaaccgagatttgtatgttttagctctgttctttctttgctggttaaatttatagagtttaaggaagagctcattactcagaaccttaacattaaa

SEQ ID NO: 542075 - DNA, 1123 bp, Homo sapiens
cagaggccctaggaggcaagcacttaaccatgtttcaggactagaaacgaaacatgtgacaagacctttaaaaacaaatagaatgggatggaataaagttggatgagtaagcaggcatcaaatcattcagaaacttgttgtccaagttgaagaatttgtttagtattgtataataaatgcagaggaagctatatacacttataatttacattttttaaaggccacgttgtagctcaatcggatagtttgtcttttgatgggatgtagtatacagtatcatcatggtatattccaggcaaaaatatttaacttgaatctgtcaagcctttgcatctaacacagtttataaaaaatacaacagatagatgaacaaactaaatgatgccagaggaagtaactagacagatccagaaggtgaaacattctgcaggataactggcccatctcttcaacaatttgtcatgataaaagcaactgctttatgaaaagaaatttaagggacataacagtttgaattggatcctggtttgaacagactgtctataaaatgcattttcaggaccattaaagaaatatgaatgtagatggactgagtattggataaaatagaactgtattgccatggaaaagatcattaactgaaaagagcaagtcacgaaatagtatgttacagcatctcattttggtttaaaaatgcacatatatgtatttatgtacaactaaaaaaatagtgggcttataccctaagggttagtatgggtaatcttggaagtggaaatgtgtattttttcttgtgtttgcctatctttttcatgtaacttttccacgcctggcgacagagcaagactccgtctcacaaacaagcacaacacggtgtaggctgccttacagaggagaatcctgggacaagctcacaacaatacttctcaaatgagggcttcccatggctggtgggaacatctaagggccagtaaggcatttctggttaaaggtctcacaagacactcgggaaatatccagtggtccggccacaattccaaggacgggttccttagcagggttcattttccggaccagtgtcacgtcaacatccttggcgtgatcaaggctatagacggatgaa

SEQ ID NO: 542076 - DNA, 147 bp, Homo sapiens
cattaggggccagagctctacaaggaattctggcctgactaacaattaacaaagaaggacagtaggagcaacaaaagagaaatccaaagtgatatgcaatggaggctgcctctgtactggaagatcttcctgctccttgtgctcccc

SEQ ID NO: 542077 - DNA, 942 bp, Homo sapiens
gcctatccttgcgtcgccacagtcggccaccggggctcgccgccgtcatggagagcggtagtggcggcctctccttgtgtccagcttcatccctcctgtggctaccacactctgtgtgtgtctaccgtcgtccctgtcactccgtgtaccggcacgaaaggacccgggtcctcccaagagctcaagggagctaaaaaagttcagtttggagtgaagatttacactgagtattctttcatgcaagctccaggaaagactgcgtgccttatgctgtgatacgaatggagctgtgacgtggctgttacaacgaatacgtcttatagcagccacgtttcgttggggaacaatcatgcccgaacgagggtgctaactcacacgcctggacgtgaaacatcctattcaggaaggcaacaaaggaatgaggttggcttggcaacaatctgaaaactcaatcgccacccattgtgcgaattagaatccggcttcgaacatgaatgcatattcccttcaggaaagcgtacccagatcaagaagtcggccccttctggaaccgtggtgtgcccccacggatgcatagggcggtgtgcatagtgggccttgctgcggagattgctcgaagcctcccatggtagcctcagaaagcgagtctagcgtgtctagcagcactcgtgtattgcagtaaaggtaccaccccctttcgaattacagaaaccgttcaccagaattgctcagtcgagtccacttaacattcagatgagctggagcgtgcccccaagagtgccttccaaagagcaccgtaggaagcatgcatgaagtgcttggtggtgccaccattcaacaagggggttgtgggaaacatgtgtccattggaagaccaaatttttttccggacatgcaggccgcccaaaagaagtcgttcggtaaaaacttaaacacgaggac

SEQ ID NO: 542078 - DNA, 347 bp, Homo sapiens
ggatctctagactgactgattatccaaaataggaaagactctaaatagctcccaacaggagactgggcagataagccaagcatacccattacgatagcaccatcatgctgccaccaaacgagaggcagctctctatgtgagctgttactaaaaaaagtctgagacatactattaagagaaaaaaggaaggtgcagggaacacatgtacagcatgacccgacttacaggtttcctaaaggtctgtctttgcatagtatatatagtaggctatgcatgcttgcctatgcacagaaaatttctagaggaaaattaacaggcctttaacagtaggatagtacaaatgaagt

SEQ ID NO: 542079 - DNA, 215 bp, Homo sapiens
gagagagagagagagacagggtttcgccatgttggccaggatggtctccatctcctgacatcaggtgatccgccccactcagtctcccaaagtgctgggattacaggcatgagccacggcacccggcccaagaaaacttttttaatggcacaatttccacaacacttaacttgcacagaggcagacaaaatccagcacagtgctttccacattta

SEQ ID NO: 542080 - DNA, 120 bp, Homo sapiens
cccatctggtgacctgcgccgccgtgtatgccctgaccccctccatgtacaagggcaagggcaccgaggatgtggtgcagttccgcgccggcaagaccaacaacgatattaaataaatag

SEQ ID NO: 542081 - DNA, 529 bp, Homo sapiens
  misc_feature (106)..(107): n is a, c, g, or t
  misc_feature (120)..(122): n is a, c, g, or t
  misc_feature (133)..(133): n is a, c, g, or t
  misc_feature (159)..(160): n is a, c, g, or t
  misc_feature (198)..(198): n is a, c, g, or t
gctagctagagtgagcagctgcaccagtaacctgtttactaatcaaaatagcgggcgtgcgcgtgcactgaatcagctcctcgaaggctaggcagaagattgctgnnactgggagcgagnnntgcagtgagcntaagatcgtgtcactgcactccagcnntgggtgacaagagtgagactccgtctccaaaaaaaaanaaagaatttattaacctggttggttaataaattgtgtggtccctgccgggcgtggtggctcacgcctgtaatcccagcactttgggaggccgaggcgggcagatcacgaggtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctca

SEQ ID NO: 542082 - DNA, 145 bp, Homo sapiens
gagaaatcttacctcagtcttcactaaaagaccttataagaagacagaaagttaaaccaggagaaaataagcactaagaagttatgtgcacagatgccctggaagaatctttacagacagcagaaagaatgcgagattagaatcg

SEQ ID NO: 542083 - DNA, 465 bp, Homo sapiens
caataatcaggagcatttcatcttttattccgtagcaatagtttcagggggtctgcctacaatgattattgtaaaaattcaaataaaacaaaatttttatcttagaaactgaaagttcccctgtcatctgaaccttaaagacaactattgttaatatattattatttcaaaaattgtggcccggcagtggctcacgcctgtggtcccgccactttggaaggctaaggtggccggttcgcttaaggtcggaagttcggcaccggcctggccggcatggtgaagccccgtcttactaggaaacaagaggttacttgggtgtggtggtgcatgcctgtggtcccggctgctcggggggctgaggcgggagaattgcttgaacttgggaggtggaggttgcggtgggccgattgcgccactgccctccggcctgggcgacagagtgggactccatctcaaaaagaaaaa

SEQ ID NO: 542084 - DNA, 269 bp, Homo sapiens
aagagggtggcttgggagcagccagtgaggagaggcaagatggggtaagcttcgcacattgagggctgggcacagtggctcacacctgtaatcccagccctttggggggttgaggcggcggatcacttgaggccaggatttcgagaccagcctggccaacatggtgaaaccctgtttttactaaaagtacaaaaattagccaggcgtggtggtgggtgcctgtaatcccagctactcgggaggctgacaggagaatcgcttgaacccgg

SEQ ID NO: 542085 - DNA, 115 bp, Homo sapiens
gctagtgatgaaggacaatggcagaagctgtccccctgtcatgaggtttgcaaggggcgatgctggggtcctggatcagaagactgccagacattgaccaagaccatctgtgctc

SEQ ID NO: 542086 - DNA, 674 bp, Homo sapiens
  misc_feature (416)..(416): n is a, c, g, or t
caaaaaaaatactgattcatctgcagcagaatttattcctgaaaaaatctgttttataaaggaaactgacaatggctttaaaataaatgtttcaggtttttaaagacaaaaatgagtaaaaccctgaacataatagattacaacacatagacttgggagaaaagaaataatgatgagtaaagaaactgatgaaatatgtcagcaaatttaatgaagtattgactattttgggtgtgtgttaaacaacactgtgtttagagaaaaaaaacaagatggggaaagggagcaatttggttaattaaattgtgataagttgggggatagaaattgataaaaatagatttgtttaaaaattttatagttaaataggttgggtaaaaaaatttaggggtgccaccaaaaggtaaacaaaccanataagccttctggatttggttctacaacttggccaccaaatattaccaaattagcttctctttaaaatacctaccttattctacaggtttttgggggcaagaaattggcacaagctcgctgggcttttcttgttacgggttacccagcttgaaatcaaggggtaggctactgtgttctccagagaaaggtttctttttgagaaaatttccttcccaggcttctctaggttttggctggaattacgggccttgtctcga

SEQ ID NO: 542087 - DNA, 155 bp, Homo sapiens
atctagaggatcctgggtcaagtgatctcatctgaacacatatcagtaagaccacatggattagatacccatatgcttagcctaactccaagtagatcagaaaatgtcgcagaacactagagcacagcttaaaaactccaaggactggggggggt

SEQ ID NO: 542088 - DNA, 274 bp, Homo sapiens
gtggggcgccctctttgccatgaaagtcctatactaggaatgcatgataactaggtcctctggacgttgccgctagcactacataaatatctatccgacaccccttacaagaagaataaggaagatcttaagacctagaaggaaaactgattgcagaccaggctaggtggctcagtgcctgtaatcccagcactttgggaggccgaggagggcagattgctcgagctcagcagttcgaggccaacctgggcaacatagtgaatccctgtctcta

SEQ ID NO: 542089 - DNA, 176 bp, Homo sapiens
  misc_feature (68)..(68): n is a, c, g, or t
  misc_feature (75)..(75): n is a, c, g, or t
gtgatcgcagaacccaagaagaagagggaacgagatcttgagctggaaatgggagatgattatatttnggatctncagaaatactgggacttaatgaattcatctgagaagtatgataagataccagagatttgggaaggccacaatgttgctgattatatcgatcctgcgatcac

SEQ ID NO: 542090 - DNA, 224 bp, Homo sapiens
gcaattacctcagtacaggtttgatgaatgatttggagaaggtcagctctgtgagatagctcccgtttttttgcttgggaccctacttacttccgtgggctcccattgggagctgattaatttctgccagtcagaacccatccctaacacatcagatgatagtggctttgacctagggaagaagaggttgagcgaagaacccccaccaggtatggtttgagagt

SEQ ID NO: 542091 - DNA, 236 bp, Homo sapiens
acataactcagagtgtaatggttatagcaccatttgagttttcatctggttactggttcagtgaagccagagtctccagggcagtcgtcctttggattcccactccagcagtccagaggagctgcgcccactttggcctgagaatactttcacagaagatggccgcttcactcccagctcatcgcaaatctcaaagaagttctcctcggtcacctccagcggggccttagcagaag

SEQ ID NO: 542092 - DNA, 606 bp, Homo sapiens
tttcctttgtctcgggagagaagtctagacatgtagacctttcatacatcttgaacatgcatcttaggctcaagctaagggggaaggctgggcgagggaaagctgaggatttttcaggaggttccagctctggaaaacccagtcagtcttatgaatctgtccacttggcttctgggaccagcctgcctgcttttccctattgcttctccctttcctatgtcccacaacactcccttcattcctggccactgtggatggtgacacaggtgcccttcttactatcatgttactaagataacacaaaactctcttgaagtcttttgagaatgttacagatgagactaggagtaaaggaataagaacataaaaatctgggaatcctcagaatataggactatttgaaattagctattgcataatcctaacctttactcacttggatatggagctagaccttctctttcctaggtcctttgttgtatccctaatgaacacatcttttgtaactctcctaggaatgggctgtatagttccccatcagagtcaccataacttctttcatttacctctctcgtctcttttagataagctgcttgggcaagacaa

SEQ ID NO: 542093 - DNA, 232 bp, Homo sapiens
ctttgctatataattaatacccccccccccccccccatatacatataatagtgctgtaatgaacatgggagggcagctatccctttgagatactgctttcatttcctttggatatatgcccaaaggtaaaattgctgggtcataacatgtttttagtattttgaggcccttccatattgttttccatgttcgctggaccaatttacatcctctcccggcccgcccccccata

SEQ ID NO: 542094 - DNA, 716 bp, Homo sapiens
ttcatttatgtgtgtgtatacatgtctagatgtctttatttgcatgtacacttactgttatatgttatgtctaccaaattggcttataagtaaaagagcactcataagtaagtctaagcaattttcaagttcatgtgacttaaagtataactttactaaacaagctagctttaaaattattggtggaataaaaatataaatgccttcataattatcagcatacattttgtctgaattttatgtttgtctttgctaaatatttttaaatgtcagtgttaattcaagctgggagctacttagggtgagcctgccttcttccattctatccgaagtctcttctaaagttgcggaattgtccatatccattagttcaggattttttgttttttagggtttcactaaagtttcaggtttctatttaacatgtaattctgtataccaaatgtaccagaaagggttatgttattcatgaaaaaaaaagagaatagttttgtctaattcaatagttatctaaaagttggttcaaattacagatttaaaaaggttattcataaaacaatgtagtaaggaatcattaggcaaaaaatgtgggaaaagtttaaatcataaaatattttttaaaccctgataaagaattggagacgtttggctaattaaacattttcataaagctgttagttttgattaaagtaaaataaaaagtattgtaaaaatga

SEQ ID NO: 542095 - DNA, 875 bp, Homo sapiens
tggctggataaacagacttgtaaaggatagctggctctccacagagaatgtctacggaaaactttaaatctataacccaggagtatatacccatgcgcacagaccaattagccaaaggcaaaataaactaaattcttaccacaactatcctataaacacggcaactattcttcccaaagggaccctaatcttatgtgaaaacacctagcggggggggaaccagaaacctagctatcgtggccaaagggaaaaaatagcaatctcaggggcttaatgggtgaaagcgaggaaatgtatgcccttaaacgggtgctgcgtgtgctgcatgctgcatgtgcatgctgcgtgctggctaaatgtcccagcaaaaaagatcaccggcgcgagtaaaagggctccagcccagagggttccctggcccagaaagccagggccaagaaaggcaggcctggcctccaaaagctcagaggggtcaaaaagctccagcccagaaaagcacctgctccaaagggcttctgggaagaagcataggcggcgctcataacaaggtcctaggggtcttctgggccggtctcaaaacaacaaaacacaaaaaaacgcgggggcacacaaatgcggggggcgggacacagagggtcattgcgaatcggcccatggtccatagtgtgtttctggccccagttttctttgtcccaggtggaaatcgggggcccctaaaaggagaccgaaaatcgaaagccggtacgtagttcccccccgcaccaactaccaaaagcacaaaaagagggtccaccgtgacaccaacacgctcaaagatctaagtacaaaaatacaccacacaagaacaacacacaaagaaaaaaaacaaaaacgaa

SEQ ID NO: 542096 - DNA, 195 bp, Homo sapiens
tatacaccggaatcgtaagtgatattgacaactggcacattctgccgtggcacggtggaacttcttctgggcggcactccgaccaatggtcagtctgtgaatgagctcatcctgaacttcctccatctgaaattccctacctggatgccaacgtggagtgggttatgtgtggtggcccctgtaacaagcgatcac

SEQ ID NO: 542097 - DNA, 1342 bp, Homo sapiens
ggagaaggggaggtcatcaaggcttgggacattgccatagccaccatgaaggtgggggaggtgtgccacatcacctgcaaaccagaatgatgcctacggttcagcaggctaagtccatccaaagattaccccccaatgaccacgcttggtattttgaggtggagtcgtgtgagattttaatgggagaagatctgacggaagaggaagatggcggaatcattcgcagaatacagacctcgcgggtgaaggctatgctaagcctcgaagtgaagggtgctagtctgctggtaagtgtctgcagctgtgagacgcgtgatactactaaggagcaatgcgtctttgaaccagacgtggagctccggcgtttgaagattggggccgaaggggtggaagacaccgtgggaatgctgggccttcatgagtgcttgggagaatggcgccaattccagtcggcaatggggatgcacaattggaggaagctaattacgcacttcgttggtgatcgctaccaaaggaccgctacgacataatgtcttgtatgggtggcagggtggattgcgggcacaggcaaaaaaagttttccagaaagtcacgcaactcgagaaatggtcgtcgtaagggcgtgttagacactccattggacatttaacgatccctgccataggcaaggtgttgtttggaagagaaggccccccaaaggggaggttcctacggggcgtaggcattgcgagagtctccgaggaccaagggaagaaagggctggagtagatcgaaggaaggtcaaccgccaattagcgttggaacacgcaaggcagggggcgccaccttggttggttacctcttccaaaaggggacacggctgtgagaaacttaaccataggaccaaaaagggcctcttgtggacctttaaaccagggttattacacccggagaaccggaactccaggcgtgtaccttgggggagcgttagtgcgcacactcacatgcgcacggtcccttgaagggtataattttacaccccgaacatcggatggggcaaaggcacgcccaccagaaaaaagagggcaacccaaatggaggaccgcccggtttcagggacctttggtgcgccctttccttccaaacgcccttcaagaagacccgtgggggcgccattttgatatggtttccatatgcgcttggaaaagacccttaacagagggggcctttttccttccttgggcttggcgccagattttggaataagggccttaggttacaacccacacgtggggccccgttaagggaaaaacgtcttggtggaccacaccggcgagagcaccaataaggtcgactggacacg

SEQ ID NO: 542098 - DNA, 1151 bp, Homo sapiens
atttaaaaaaaaaaaaaaaaatttcttgagaacagggatctggctaatgttggcccaggctcgtcttgaattcctgttctcagaagggtccttccttatgttggcttcccaaagcattgggtattatagtgtattgagccaccaccactagcacttctgcctagaactcgtaacaaaatttctttcccccatctgcatagtctggtttcattaaatggattcttaccctttttaaaggtttagtctggtcttttattttggatggcttacttcaaatggccttggggatcatttactggttcctcaaatttaagagctaagaagaaatctctctaaagctcccatgcatagagggttctcaacaggttggattttaactccagtgtagatttcactagaaccatttaatttggagggtcacccaatggtacagtatatgtattatgagcagagacatttgtccattatatatctgagaagaaattctctaatccacttgtcctgtgtgagtatatgtactttgccagtttactttgggggtgaggaggcagggacagtgtattagagatttaactggttcaaaatgtagacttcctacagtttccagtaaaatactctaccctgtctaatatgtggattcccctattccagactggattcaccttttcagagagctaagtcggagacatttccttaccactgtgaagggacacggcaaattacactttacagggaaggtattggggaccagggggttaggaccacacttatcacaccaactcagcgataaacagtgaaaacccctaattctaaacacaggacagaataccactacaggagaacaaaatagagccagaacacacaggtgaccccgtaatataaccaggccgcacaaaaattttgcattagtgccacagtgctccatcattaaaatgtcaggggggatcgtataaccagttgcttatattattatcaagacgagatgatatgtaacgcagttattgttagcgaacagatgcgggaaaatgtatagcagatataaagtagtaaaaagcaactagaacgtaaatatataaaagagtaataaaagcgcacattgaaaaggctgactaataaatatagtagattgaagagagaactataagaataat

SEQ ID NO: 542099 - DNA, 868 bp, Homo sapiens
  misc_feature (37)..(37): n is a, c, g, or t
  misc_feature (186)..(186): n is a, c, g, or t
  misc_feature (210)..(210): n is a, c, g, or t
  misc_feature (223)..(223): n is a, c, g, or t
  misc_feature (231)..(232): n is a, c, g, or t
  misc_feature (234)..(234): n is a, c, g, or t
  misc_feature (252)..(253): n is a, c, g, or t
  misc_feature (296)..(297): n is a, c, g, or t
  misc_feature (328)..(329): n is a, c, g, or t
  misc_feature (338)..(339): n is a, c, g, or t
  misc_feature (389)..(389): n is a, c, g, or t
  misc_feature (401)..(402): n is a, c, g, or t
  misc_feature (452)..(452): n is a, c, g, or t
  misc_feature (475)..(475): n is a, c, g, or t
  misc_feature (539)..(539): n is a, c, g, or t
  misc_feature (557)..(557): n is a, c, g, or t
  misc_feature (592)..(593): n is a, c, g, or t
  misc_feature (651)..(651): n is a, c, g, or t
  misc_feature (685)..(686): n is a, c, g, or t
  misc_feature (706)..(706): n is a, c, g, or t
  misc_feature (714)..(714): n is a, c, g, or t
  misc_feature (721)..(721): n is a, c, g, or t
  misc_feature (723)..(723): n is a, c, g, or t
  misc_feature (726)..(726): n is a, c, g, or t
ggcgagctcagctccggagagccggcggcgcggcggncatggctcgggtggcgtgggggctgctgtggttgctgctgggcagcgccggggcgcagtacgagaagtacagcttccggggcttcccgcccgaggacctgatgccgctggccgcggcgtacgggcacgctctgtgagcagtacgagggngaagagctggcgcgagagcgcgcngctacctggaggncggcgctnntnggctgcaccggctcctgnngcgacagcgaggccttctgccacgccaactgcagcggcccccnngcccgcggccaagcccgatcccgacggcggnncgcgcaganngagtgggcctgcgagctgcggctcttcggccgcgtcctggagcgagccgnctgcctgcggcnnctgcaagcggacgctgcccgccttccaggtgccctacccgccgcggcagntgctgcgtgacttccagagccgnctgccctaccagtacctgcactacgcgctgttcaaggctaaccggctgagaaggcggtggcggngggctacacttcctccanaggaacccgaagcacgagctgaccgcaagtatctnnaactactatcagggggatgcttggacgtcgcgacgagtccctcaacggacctagaggnccagcctacgagggccgtgttcctccgggctgtnnagctctacaacagcgggganttccgcangcagccngnggncattggccgggcctttcagagtacctggaaggtttggccgggcctgccggtttgatgggcctgagcagggggactcaagggtttaccggcgcaaaaatcttttggagccctcggggagggggtgtggccattgccccttgtg

SEQ ID NO: 542100 - DNA, 374 bp, Homo sapiens
ctaaaaatacaaaaattagccaggagtggtggcgtgtgcctgagtagctgggattacaggtgcctaccaccctgtctcttaaaaagaaatacaggccaggtgtggtggctcacacctgtaatcccagcactttgggaggccgaggcaggctgatcacgaggtcagaagatcgagatcatcctggctaacacagtgaaaccccctctctactaaaaatgcaaaaaattagccgggtgtggtggcacgtgcctatagtccgagctactggggaggctgaggcaggagaatcaattgaacccaggaggcggaggttgtagtgagccgagattgcaccactgcactccagcctgggagacagagcaagactccatctc

SEQ ID NO: 542101 - DNA, 169 bp, Homo sapiens
gctcgaagcccaccttccgcacagtcccgcgccctcccgcaagcccgagctgcaccgggagatgcctcactcccagaaggtggtccgggagatgcacaccttgcgggccgaagcgctgtaccgcctatccctggcgcagcacgtgcgcgtccgagtcttgtggcggccg

SEQ ID NO: 542102 - DNA, 804 bp, Homo sapiens
  misc_feature (98)..(98): n is a, c, g, or t
ttcaaaatataagatataagttctacgcatgcgagcaagatcagtgggtctaacgacacagatgattcgcatgactatttctcagtctagtgatcagnaagaggtatatcgccactgctccatatagtatgtagcagaggacatgtagtcatagcaccataagctcaggtcaatcttacagcatgacatgaatgtgtcccctctacagaaggctcctcgctttatagggatcatggtatgggatgatcatgtcgatcatcattcatttcccaggtgagagtaggatcttacacagattatcctgcgatataagctcagctagcatacgtattccagacagctatacatggatctgcagaacgcctatcgcaggcacgccagacatacttgagactatgcagctagtccaatcgctccaggtaccaagtacatggtaagagagtgtgtgtgtcatcatctcgatagacattcccgatattgtagcggcatgctaggcgtttctcctggtctaattcgatcacggcttcctgtacagggtagagtctatagcacgcatcctaggagactcagaatgaaaaacagagtgctcatagccacataccataataagaggctgcgtatagtgtagccagacagctctaagatagattggtaggacattagcgagccctggcaccggagcaggcatagaagtgagcatgcttctactggaagtgcagtaggcaaaggtgaaacgcatggtcttcactagtgagaacatgtcgctcagaggcctctagaagtgtccaatgcagcgctctcctg

SEQ ID NO: 542103 - DNA, 309 bp, Homo sapiens
gcttatttggaaattttagttaaagggtttaacgggcagggattaaaagggggggggttttttttttaagaaaaattccccaggtaactccccctaaccccttaccctttattttattgaaagggaaaattaacttacccgaaaaaagggtttttttgggggggaggggggcaaaccctttaaagggattccccctcctttaaacaaaaatccggttttagggggatcggcaaattttgggaaatttgtcaggccggggggggccccccattggggggaccccgcaaaaaaacttttccttttaaccca

SEQ ID NO: 542104 - DNA, 330 bp, Homo sapiens
tttttcagggaactgggaacttaggggacttaacttgggagggaggcaggtgggtggtaaaagggaaactttggagagcctgcccccaggttctgagtggggagtgtacaaacccctcccttgggggttccgggaataatgcaactggttttactagggggcaagggggttcatccccaagtttttttttgtcctcccatgcaaagttgggcatgcccctgagtgtgaacaggtttgcctacgttggggcaagtgggcatgggtgggggcttttcccttccccttgccccccttcctcccccacctgcaataaatccgcttttcctgcca

SEQ ID NO: 542105 - DNA, 175 bp, Homo sapiens
gctggtggtggccaagtatgcgcccgtggattctacattgcctccggcagatgtgtctgggaagctgactgatctgggataccacgcagaaggagctcctgttgaagtgttagtagcatgacctttcgctgtgaagatcaaatacattgcttggactgatggtatcagagatgcg

SEQ ID NO: 542106 - DNA, 140 bp, Homo sapiens
gcggccgcctactactactactgctcgaattcaagcttctaacgatgtacggggacatggtttgtacaataaatacatctgtggggcgggctctccgcagccgggaagggccaccgccacggttcagtccaaaaaaaaaa

SEQ ID NO: 542107 - DNA, 394 bp, Homo sapiens
caaggattggcctttcagaggtactacagggatagtagcctctggtccagggctggagccatccgtctctcctgatttttgcaggccagtgggctctgaggcataaaccttggcactccgacgttgtgggattaaaccacatgaaactgactgacaagccctgcctgtggccgatgactatagctggacatcattactgtttcctggagtccaatgggctttttggggaaaagcttgccaaccggggggtgtccaacttgaccacaatatacttacctacaagctcccagatcagcccccaacaccctgcttatctgtgatatgaagcaggagtcatccctggtgtcttcctgactgttgatccccataccacacgacatgccgtacccagtgc

SEQ ID NO: 542108 - DNA, 242 bp, Homo sapiens
aggatcccgtcgggccacgcaccgttgaggattctacgtggttctcttggttcccctggctgtgtgtgtgtgtgtggaggaggccgcggcccttagatcaccttcttgagctcgtcgtccaggaccagcccgagggcgccccccatgccccgcaggacgttggaccacgcacccttgaagaaggccttgcccccctcatctctgaagatcttcctccaacagtcgacggtgcgttggcccca

SEQ ID NO: 542109 - DNA, 209 bp, Homo sapiens
ctctgtcgactccagttaaatcacacctagctggctgctgactcagcctcttgcagaacgtccagacagatgttccaacattacctggtcactcctgcctggagctgcagcctccctgctggttcccatccccagggagccggcctgctcttcctgccctgccacctgtgttgctccaggctcagccctcatcctcggggagcatcaag

SEQ ID NO: 542110 - DNA, 125 bp, Homo sapiens
ttcaaatgccagaaagttacggcgtgtagggcagtgagactcaagtttatagtctggcgccactcagctcacaggttagcactatgggcaggtatttatcactacaatttctgtgcccatttcaa

SEQ ID NO: 542111 - DNA, 1015 bp, Homo sapiens
cgcttcctttccgctcggctgttttcctgcgcaggagccgcaggccgtaggcagccatggcgcccagccgggaatggcatggtcttgaagccccacttccacaaggactgcagcggcgcgtgcccagtggttcaaccagccggcccgtaagatccgcagagtaagggcccggcaagccaaggcgcgccgaatcgccccggcccccgcgttggggtccccatccgggccatccgtgccgctgcccaacgggttccgggtacccacaccgaaggtgcggcgccgggcggaggtttcaaggccgtggaaggagcgctcaggggtggccgggcattcacaaagaagggtggccccggacaccatcggcatttccttgtggatccaagaaggcggcggacaaggtcccaccgggatccccttggagaccaaacgtgcaggcgggtagaaagcgaagttaccggttccaaattcaatctttttccccaagaaaagccctcggcccccaaagaagggggaacaacacgttctgtggctgaagacgttgaaatgtgggccaccccaatgtttgaccgggaccggttcatgccccggttccggaacgtctataacggagggagaaacgtcgagtcatcactggacggaagaagacgattacacaggcctgcgaagtctcgtatggccgggcaacgcccggttcttcggcatcggacaaaaagagccaggagcccgagactggtttttgaaaagaaaattaacggccttccggggactggacaccgtgggtcaaacaacacacaaagaggggcgatagaatcccagaggccaatacgcatcccgtttgcaggggccctaagggacgtataagcagccgcccgttaacgtcacgaacgctgtgccttgagccttggcgcaacgccccacgaagccggatcatgatctgcactgctgggcatatatcatataataccacactcgtagtatactaactcacatatcgtatcagcacacaacaatactc

SEQ ID NO: 542112 - DNA, 114 bp, Homo sapiens
agacgtaactaccgaaagatatacaaatgaccaagcacagcacatgagaacagtaagtacactagggaaatagcaaatacagaaactaacaatagagatagccactatacatat

SEQ ID NO: 542113 - DNA, 198 bp, Homo sapiens
gctgcggtcgctctcgcgactcccctgcttctcgagcggctctgccttcgatgcttcccctttcttgcacacactcacttgcgcgcaaacacgctgcgctggcctggctttcttgttttttttgtttttttttttttttttttttttttgggcctgggccccccttttttggggtttcccggggcccccgggggcccc

SEQ ID NO: 542114 - DNA, 263 bp, Homo sapiens
gtactggcattgcatatatagtagtgacagtagcaggctcagaaagacagacatttacatgttctcacttatttgtggaatctaaaaatcaaaacaattgaactcatggagagagagcatagaaggatggttaccagaggctgagaagggtagtgaggcattgtggggttggtggggatggttaatgggtacaaaaaaaaaaattagattgattaagatctatccgataatacaacagagtgactatagtctatttaattggt

SEQ ID NO: 542115 - DNA, 301 bp, Homo sapiens
ccccgactagcccgaaggaggaggatgtgcccgtgtggctccgtaaagcatttgaaggtgccgatggaggggacatgaccatgctggaaacaggggttgatggaggtatgctctgcccagtgccgcccacagtggaggcttacagtggcgctgtcgtggctagtctggggctgtctgggctatgtcggggcttgtcgggctagtctggggcttgtcgggctagtctggggcttgtcgggctagtctggggctgtctgggctagtctggggcttgtcgggctagtctgggggtggtaccgag

SEQ ID NO: 542116 - DNA, 148 bp, Homo sapiens
atattatcgagggctcacaagaaaactgcagacttgaccaactgtcattagtaaattataagacttcctgtttggaaatcttcccatggaaccatatttttccttcatgtggatcttcttcccggcccacctcttctactaggtcttc

SEQ ID NO: 542117 - DNA, 378 bp, Homo sapiens
  misc_feature (286)..(286): n is a, c, g, or t
  misc_feature (378)..(378): n is a, c, g, or t
ttggagtctcgctctgtcgcccaggctggagtgcagcggtgcagttggctcactgcaacctctgcctcccaggctcgagtgatcctccctctgcagcctcttgagtagttgggaccacagatgcgtgccaccaagctcagctaattttttttgtatttttggtagagacagagtttgaccatgttgtcaaggttggtcttgaactcctgagctcaaagaatccagtgcccgccttggtctcccaaagtgttgggattacagctgtgagccaccgtgcctgggcatnaatggattgttttaggaagggatcttgggtgttagacttgtatagttggtgagactgaagtgttcttagatggaggttgtacctgcaggagn

SEQ ID NO: 542118 - DNA, 186 bp, Homo sapiens
agttgcttccaacacaaggcaggcaagtttttcctgcttccatgatgatggaaggtaggtaactcctttacggagtttcccttccaacagggaagatgaggtttttttttttttcctgctcctagtgacacaggagatagaagttatttaggcagatagtgagggtacgagttcttggcagggctt

SEQ ID NO: 542119 - DNA, 464 bp, Homo sapiens
  misc_feature (463)..(463): n is a, c, g, or t
tcctggtggcttactaattggttgtagtcctggtttcatgaatgtccccaagatcaaaggtacccacacggcaatgaaaagtggaagtttggcagcagaatcaatttttaagcaactaactagtgaaaatctccagtcaaagacaacaggactccatgtaactgaatatgaggacaatttgaagcaatcctgggtatggaaagagctacacgctgttcgaaatataaggccatcttgccacgggatactgggagtatatggagggatgatttacactgggatattttactggatattgagaggaatggagccatggactctaaaacataaaggctcagactctgatcagctcaaaccagccaaggattgtacacccattgagtatccgaaacctgatggacagatcagttttgacctcttatcctctgtggctttgagtggtactaatccatgaacatgaccnt

SEQ ID NO: 542120 - DNA, 137 bp, Homo sapiens
aaaagaaatagatattaaaatttaatactaactatggaaaagggtccattgtgtaaacatagttatctttggatcaatgtttgtctttggttttcaaagtagcttgtattttcagtattttctacatatatggtgga

SEQ ID NO: 542121 - DNA, 211 bp, Homo sapiens
cctgtactacttgactgatgcagcatcaatgaggttatccaattgggtgcggatgtatagtccgtccaaatgctgccaggttcttttgccatgccgaagcttgacctccagagaagcacaccaacattagtgattgcatgcaagggggaaaggttcattccacgttccttcacttaggttttcgattgggttgccaaaaataacagcaata

SEQ ID NO: 542122 - DNA, 403 bp, Homo sapiens
  misc_feature (23)..(23): n is a, c, g, or t
  misc_feature (51)..(51): n is a, c, g, or t
  misc_feature (68)..(68): n is a, c, g, or t
  misc_feature (80)..(80): n is a, c, g, or t
  misc_feature (111)..(111): n is a, c, g, or t
  misc_feature (182)..(182): n is a, c, g, or t
  misc_feature (237)..(237): n is a, c, g, or t
  misc_feature (290)..(290): n is a, c, g, or t
  misc_feature (315)..(315): n is a, c, g, or t
  misc_feature (347)..(347): n is a, c, g, or t
  misc_feature (360)..(360): n is a, c, g, or t
  misc_feature (380)..(380): n is a, c, g, or t
atcgcgatttatttagcatttanggcctgattttaatttccataaaaattnactcttacaaagatttnttcaaagaaatntgaccgccttcaaactacatgtttggtttgnattacatggaatagatttccacatatgaaaaaatcataaaatgaaggctacgttttccaccgctatttaantactgtttagaaactatcgttgaatgaatgaaccctgattttgcctcatcgggtntatctaaaagaagtcttttgaaagatattaattttcatttttctttacatggnccctcttttttcaatcctgtaaatnaaaattatgagcaatttaaggacacaattttnacaacaccaattntttctggtaattggtctggntacccccaaggccccctttaaga

SEQ ID NO: 542123 - DNA, 882 bp, Homo sapiens
aaaagtgcacaccttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagagcgaggcggcgcgcggcggccattagtatttcttcttgtctctaggtgaggccggactctcatatcactcccgacgctctctgtcttttttgctcatacggagtgagggccctctcttgcgctggtgtgcgttattctttaccccccaccgcccagtgctctctttcttaatactacacctactcacgtgtgacgagagccagaggacgaccctcagtggccctacacgtctatgtatactttttctaacagacaaagcatccctacctttctctctatgcctcgataactgaacagataacagaagtgacgcccgcgaacaaaacacatccccctcctccatctactaatctatatattagaatcatcttcacagagcatcctctatctctccataataattacacacacaccagatatattctcgaaacaaagacgaagcacaacacaaatcaaaacaaatcaattatatatatactctatcccccctccctcacaatcaaaagacgaggtagtagttcgtgggtcgcgcgctagcgtgggcgtgggtctattgtctagtcgtgatctagctgtagttctcatttttgatgcttgacacgcgaggcggagggggatgggtatgagagcacggtaatgcacagagctggcggggcacgagcggcaagcgagaggtagaggctagtagtcaggggccacccgggcgggcagaacgggaggccaggacacgcccgca

SEQ ID NO: 542124 - DNA, 1045 bp, Homo sapiens
cacctttggtccctttccagggtgcacattgggctgctgtgtccccacacttggtttcttttgccccttctctcgctaccgcgccttgtccacccgggggtctcctatgggcaccccgctttcaacatgccagactttgaggacgatggtggcccctatggcgcatctgtaggctctctgcgccccagtggcccagagcaacccgcctggccactattcgcgtctcccgggacactcctccgcgtcctgttcccacgagcctccgaggagtccctctctgttagcgtgggaagacttattctgggttgccctcggcttgagccctttctgaggactctgtgagcgcgcgaaggatttccgggtattcctcggacgcgcgtgcgaacacacaacggcacgccttgcgctggcgcgcttccccgcataggtcttctaacgtcgccgcttggctttcgaccggctatccgccctggaacactgagcccgccactgtgcctcgcgcttgacacttccaccgagcgttgtcgatgagggccgcaaggcttgccttcccccgcttgtggcgtcacaacgccgcgtttgcctcccacacaccggattggctccctttcccgctgcacttctgccgcccccgggaattctgcaacccaccgcacccagcgcgcacgccctgtgcgcccgcaacggccaccgggccctgaagccctggcaacccgcctggccaacccacacccgcgcaccgccacactcggggcccctgccggcgcaatcctgcaagcccgccttaaggcgtaagtgcaacggggccgccccgccctggaacctggagaagggagacctacggaacgccctggaaactgcgaacgccctgcacctgctcccgcctccacccacgcgcctccccctgatgtcgtggtcccgggcctggccccggggcccctttacaagccctctccccttttataaatttcccatttaaaccccctatttttcttaaaaaaaagaaaaaactcgagatattcggtcgagaagagatatgggcccg

SEQ ID NO: 542125 - DNA, 167 bp, Homo sapiens
ggagccctgctatcatagataccatttgctggattgggagaggggccctacccgtaactggagttcaagactgtagacgcgttggaagctcgttagagtcgcaactgtcgtccttgatacgaccgtaccgggagtctttagaaagaatctctacgtgggcggggcgc

SEQ ID NO: 542126 - DNA, 148 bp, Homo sapiens
tcgcgatcctcaatggctcagcgacttgtggccttgagcattcgggaagggatgacctgcacgctggccggtgtgtcaggcgcggacccagccgtgtttgtcttgcgtttgatgtgctcggtgatactcataccgggactcggcttta

SEQ ID NO: 542127 - DNA, 94 bp, Homo sapiens
gatctctctcggggtggagtccgacatctgacgctaagctcgtgtgaacctgggcaagacagcaaaactgtgcctgccttaaccctgcttaacg

SEQ ID NO: 542128 - DNA, 813 bp, Homo sapiens
tcctaatttggacctgtttcaccagtgttttacccttgacgtgcccctttctagtgctgcttccaaaagctgactagtgtgctgtaagatttttaccttcctttctaaaggtttttttttttttttttaaagggtgaggttcgcggtctttcctatatttcttcacagcaaaatgtgaaactcccgggataagtttataagttactccaaggttattttgagacctcaggtaaaggctcaacagggtatattccctcccagggtgcattttaaatataaacccttttcatctccaagaaaaagatatagggtatatataggggataaaaactctctctgtgatgggggactcatctcataggtggtattctcaaggataaattaaatcttttctagagagaaataatataacggggctctctcggggggactggggctcttgagaaagagtttctgtgtgtcacgagatatctcagagccctctcgagtatagtaatagcgaacagtgtgccatgtggctggtgttgtgagggtttgggggagttcaaaaaaatattgagacactttttatgagtctcctctcccgtgggaaacacgtgtggagttttttatcatgaaacactactcgtatgagggaatatcaaacatattgtgtgaggatatccctcaacacaagagggggggctcgagagggcgtgtttggggaagggctattaaaaaacgaaaggcccaacacatttttgtggcaatattatgagttgtttgagggcgtcacgcggcataaaaaagggtgggaaattttaaggtgaaatc

SEQ ID NO: 542129 - DNA, 400 bp, Homo sapiens
  misc_feature (62)..(62): n is a, c, g, or t
  misc_feature (80)..(80): n is a, c, g, or t
  misc_feature (99)..(99): n is a, c, g, or t
  misc_feature (114)..(115): n is a, c, g, or t
  misc_feature (117)..(117): n is a, c, g, or t
  misc_feature (139)..(139): n is a, c, g, or t
  misc_feature (143)..(143): n is a, c, g, or t
  misc_feature (151)..(151): n is a, c, g, or t
  misc_feature (154)..(155): n is a, c, g, or t
  misc_feature (161)..(161): n is a, c, g, or t
  misc_feature (165)..(165): n is a, c, g, or t
  misc_feature (178)..(178): n is a, c, g, or t
  misc_feature (184)..(185): n is a, c, g, or t
  misc_feature (191)..(191): n is a, c, g, or t
  misc_feature (193)..(193): n is a, c, g, or t
  misc_feature (209)..(209): n is a, c, g, or t
  misc_feature (231)..(231): n is a, c, g, or t
  misc_feature (233)..(233): n is a, c, g, or t
  misc_feature (238)..(238): n is a, c, g, or t
  misc_feature (250)..(250): n is a, c, g, or t
  misc_feature (259)..(259): n is a, c, g, or t
  misc_feature (265)..(265): n is a, c, g, or t
  misc_feature (274)..(274): n is a, c, g, or t
  misc_feature (293)..(293): n is a, c, g, or t
  misc_feature (299)..(301): n is a, c, g, or t
  misc_feature (321)..(321): n is a, c, g, or t
  misc_feature (326)..(326): n is a, c, g, or t
  misc_feature (329)..(329): n is a, c, g, or t
  misc_feature (336)..(336): n is a, c, g, or t
  misc_feature (348)..(348): n is a, c, g, or t
  misc_feature (358)..(359): n is a, c, g, or t
  misc_feature (361)..(363): n is a, c, g, or t
  misc_feature (365)..(365): n is a, c, g, or t
  misc_feature (380)..(380): n is a, c, g, or t
  misc_feature (384)..(384): n is a, c, g, or t
  misc_feature (388)..(389): n is a, c, g, or t
  misc_feature (394)..(394): n is a, c, g, or t
tgtcaacatttcttcagttattcaaactcactgatatctaactgggagtagtttgtattctngaagacttcctaaggtanaagtatctttccctatttnccccacaatagatanntntaactagccgaactaattaacnctantgttgccnttnncagcantatngagatatctagtnctaatnnagacananaccacattaatttganatcaaatgatacaagaaataantntgaanccagttatcacncaaccccanacaggngagaacccntaggagggccctcaatgangttaannnggtataaaacaacgatagancaaanagnaaaaatnatcaaacttaanttacataganncnnntntaatttataaaacantagntgtnnatttnggacaa

SEQ ID NO: 542130 - DNA, 103 bp, Homo sapiens
ccgcgtcgactgctgcccagtgcatcaaaagtggaatgtgttttcttttggttggtttttagagacaaggtctcatgctatgcccaggctgggcgtgcggtgg

SEQ ID NO: 542131 - DNA, 119 bp, Homo sapiens
ctcccacctcaagaagaaataggatatccaaacatacctatatcaagaggttaaaaaaaatgaatttaaaaaaacaatcttccagctgggcatggtggctcacacctgtaatcccagca

SEQ ID NO: 542132 - DNA, 137 bp, Homo sapiens
tgagagacgtgttgcactgggtggtctgaactcctaagctcaggcgatccgcccactttacctcccaaagtgctaggattacaggcataagccataattattaaattgtatttaaaaatacaattctcattgcaaca

SEQ ID NO: 542133 - DNA, 194 bp, Homo sapiens
gaaaaaaaaaggagagaagctgaagcattgcttcaaagcatggggctaactccagaatcccccattgtccctcctcctatgtctccatcctccaaatctgtgagcactccaagtgaagttggagccaagactctggagatggcgccctggatctagacgcgggcccttaaacttggatggctaaatcacgaagt

SEQ ID NO: 542134 - DNA, 1004 bp, Homo sapiens
ggtcttggtcgccaagatggcgtcctccgcctccgcccggactcctgtgcagggaagcgagtgataaatcaggaagaattgctggcgtgttaatgaagtgagaagcagctgtctgagcaccagtcggaaactggatagaatctccattcgcgaagtacaaccgttctggggcagctgagttgtgccctgtgtaacactccgtgttaagagctgagctcctgtggcagactcacgtcctgtgtgaaagcagcaccgagagaaatgtggccgagctgaaaggcgcgcacagtgaagccagccagggttcgtccgccagttcagcgcctcagtccgtcacagacgcgcaagcgccggacgcagacgaccaagatgtcaagagagcgaaggccaccttggtgccctcaggtacagacctccacatctgcgtggaccaccaactttgacacacactaggacaggagctcattagagcgactcccagtaagccttcagcgactcacgtctactccccgcttactgccgactgaggacgccggccgccacgcacggacgccgaccgccacgcccacgccacacgcggccacgcccacaagccgcccccgacgccccgccacgacgccccccccccctccccccgcagcgcccccaacgaccaagcgccgcccacccgaacccccaccaccctactccgccccccccgccccccacacatccccccctcacggacccccgccaccgccacctcccccacccaccgcgcacacgaccaccactaccccacacccctacccccacctctcctcccaccccctcactcacctccccacaccacaccctcctgccccgcaccccccgcggccccacaccgccgccccccaacaccctcgccccccccccaccgcaccccctccccacgacacacccccccacccccccccgccccacgccacccacccccccccgcccccccccccgcccacacacccacccccacagccacacaa

SEQ ID NO: 542135 - DNA, 423 bp, Homo sapiens
  misc_feature (354)..(354): n is a, c, g, or t
catttcaaaaaaaacaaaaaaaaaaccaaaaaacaaaaccaaccaaacaagaaaaacacagcatcgagttcttcactatgataacttttactacaaaaccgaacacagttaaccttttaaggtttaaatgtaatcactttcttagaagtggaagactgcagaagctaagcgtatctatcctttccttaaaagacagccagagaggcatcagtgaaaatgaccctctcgtggttccgaagaaggagtcaatatttcacttggtatggaaaaagctcctcccatgggctccagccctccagaagcaggagaggaaagaggtacttggtttactacagttgcaaggggccccagtgnatgcgatgatttgggaaggtatttggaattaagtgacgatttcacaatttggaattggtcgccaatcgg

SEQ ID NO: 542136 - DNA, 432 bp, Homo sapiens
agaagttacaagcaaacattaatcaaatcaaaccgtagtggactcaaagattttctgattggcaactgattgaaagagttaagttgtgatttaaagacctgaaatcaatagaaatgaatgtctgggttaagataaggtggtatgtagagtactagaggtgtcttgattactgctagagtggatgtcttccagtagtatgcagtgcgttcatgagatgaataggtgtggtgaaagtgtattcgttatctgaaacttgtagaaatggtgaccataccctaccccatcagccagcggtccacaggcacaccactgctccctgaggcagccttggccctggcttgggctagggcaaaattagagaattttaaaattttgggaaaatggcagataggcaggactaacttgcagctcccactcagacagacagagaag

SEQ ID NO: 542137 - DNA, 240 bp, Homo sapiens
acgccgctgacggatcggtgttacctttgcctcatgggagctttgcagcttgaccttgggggtgcaccagctggtcctgctggcactgggaaaacagagactaccaaagatctggcaaaagctcttgccatccagtgtgtggtctttaactgttcagatggtttggactacaagatgatggggcgcttcttcagtggcttggcacagtcaggcgcctggggctgctttgacgaattcaat

SEQ ID NO: 542138 - DNA, 428 bp, Homo sapiens
cacgcctcaacagcaagtagctgggattaaggcatgagccgacagtccggctaagtttctgtatttctaacaggagacaggggtgcaccatgtaggccagcgacggtgtcgaactccgtgacctcaagtgatccacctgcttgggcctcctaaagtgttgggattacagacgtgagccaccacacccggcctagcacttttcagttgatggctctgtttagtttcttggtggctagctgaagtgcagatgaaggtcttaggagtttttgaaggtcagggtgtagaaagttcttgagcatctttgctgaagtcattgagaataatggctgaatttgggagcaagcagaattgaagttattgggtaggggaaataggagggtgttctggaggttggtagatgttgcagaaggaatggtttcagtgagtaa

SEQ ID NO: 542139 - DNA, 878 bp, Homo sapiens
cataagtgtagttttgatgtaattttagaagacttttagcaaacatgcattccttcatatgtatatattatcttgtatacgatagctatttataaaagtaagccaagtgctgtctagtctgctgtataaagtaggaattgcatcagagtacgtataattcttgcatgattacaactgcgcctggtgacagttgcacggaggagtgtctgtaagtgaaaagttgtatgctatgagtgactgcactcatatggcaggtctactaatgtgcgacctgactatctgtgttttgtaccccagaaatgatcgcacattgttgagctacaaagattaagctaattaaccaatttgtaacccatttttgtcactcataaacagactactcaatactagacaatattagtagtacaatgtagtgtgtatgtgacgtgaagatatcgatacgatattaatttacattagagtgaacaatataaatggtttgtttctggagagttgagttccgtaaagtagagttctcaggtgtctctgcagagaagtttactaacaatcatgttttatatgtggctgtaacatcagtgtgacgtacctcgcatcgtatacaggatatattcctcaactatatattatacgggagaattaatttgggatactccatgtctccagagctgaggatcattcttctgaaaaaatcccggtgaccaacatcgctcgttcgctccgggggggacttttggagcggacctgtcgtcgtaacccctcaacgttctcgcagtaaacacacaaaggccccaccgttgacctccacctcggcgggatttaacctagggagaaaggagcgaccacgaagcgcttgcaaccctttacccgtgttgctggga

SEQ ID NO: 542140 - DNA, 107 bp, Homo sapiens
gcctctggcggtgtgcttgatcttggagcggtacgacaggccgatgcgggtgtcttcggtgggctgcagcatgaagcccacgttccagccccacgcgtcgcccttca

SEQ ID NO: 542141 - DNA, 618 bp, Homo sapiens
  misc_feature (453)..(453): n is a, c, g, or t
  misc_feature (562)..(562): n is a, c, g, or t
atattggtaagatgtgagtccccatgaaagcagcttctgattttccatgaaatgaatatttatgaggtactggtaacttcctacataacatacaagttctcaggttcttttcagacacaagaatgactaatgattttgtttaatttaattcgacaaatttattgagcgcccatgattcttgatactgatgacatattttagtcctgatgtttcagcatattctatgacataaataaggtacatgatggccttttcatactattttttagcatgaagaatttttggtaaaaggtcacgcttactgtccactgtgtggcagtactacaaatgaccttgcaagtctgtactatgtcttcaattacaggatatgggaactggtggccacatatatcttgaattcagcatataaatatgagtgcagctattcaagtaacaacaacctgaacaggaccnaaacatacattcccatatctgggatctgatagcagtcattttgcatccaaaattattctaaagtgactttttttttaagtaattatcactaatcaaatgttttctgacntattttcaagcatttccaccggggcactccccctctgcaacctcctgcccaccgcc

SEQ ID NO: 542142 - DNA, 184 bp, Homo sapiens
tgctgcatgacccatcactgcaaatccaaggggagggagtgatcttgcctgtattgaggtgagtggtctgtccccttggaggggatggagttgatggtggtgggttgtcggcaggtggtcggggtgggggcggaggtaggtggtctcggccccccgatttgcagtgatgggtcatgcagcaggt

SEQ ID NO: 542143 - DNA, 250 bp, Homo sapiens
  misc_feature (186)..(186): n is a, c, g, or t
  misc_feature (208)..(208): n is a, c, g, or t
  misc_feature (240)..(240): n is a, c, g, or t
gagtacccagcaatcgggatgaggcatggtggtggcatgcgcttctagtcctggctgctcaagagggtaggcagaattgcttgaacccgggagttggaggttccactgagctgagatctgcactccggcctgggtacagagcaagactccatcttgaaaaaaaacaaaacaactaaaaagcctccnaatacttagctgagcttacatnttaaagagcggtactgcattattacgtagatncatttattga

SEQ ID NO: 542144 - DNA, 712 bp, Homo sapiens
tttgtggcgatggggtatgaacccagccagggctttgttcatgctaggtaagtgtactatcgttgagcaacattcctgatgcctagcatcgtcattggttgaactgggtgagtctggagttaaaccagagagattgatggatctggatgagaaatgatgggggcatgacttagactcaggggagggggcagtggcacattcactccctggagggtggcctagggggatgaggtgacaggctgagtgaggggaaacaaaagtgactccgagggttttcaggttagctgcccagtggaaaattgtccgtgatcctgcaaggactgataaccccgagaactctgacacagtgtctggtcaggttctctctgttgaataataacaataaaagttccttatgtaagtgttgtggttaaagattaaaagcaagggctttgatactggagttaaaacacactggtcttgcgctgtgtcccttcagagaatgaccaattgttatagaaggaaatcatagctgtcttctgggttaggatttcgctcaagtggagcaaaacccctagcagaaaaccaggtcattcgaagtaggacacaccgaatgcccagtggcttcattgcccttggttagtcttcctagactaagactggggatgtagtctggttaagtagaacactactgagtatgccctataccccagctcaagccccagtaccccac

SEQ ID NO: 542145 - DNA, 149 bp, Homo sapiens
gttaaggtacttagaggatgttataaaggcgagccgggtaggagaaaggctgcagtgctggtcagcctggtgtcgcttggggggtgagagtgccaggaagtggggaggggcggtgagacccgaggctttaaggcaaagcggggcaaggg

SEQ ID NO: 542146 - DNA, 590 bp, Homo sapiens
gcagaatcagcttatcccgccagatggagagtttgagcttatgaggtatcgcacaaccaaggacatcatccttcccttccggggtgactacccgcgtagctgctgaggaatgtggagacgcaccgaaacctggtaggtcagaggtggtcatctaacgtccaacgtattataacccgtacactggcatgggctcgagaaaggactcgcagagtgcacgcgatcgcccaatcgcgccacctgaaacagccaatcgcaggtgggtcgaccacggctcgactccttgccactcgagacgcgcgggacacggcgcaaagttaccaaacgtggccagtccggagacagtggccaatccggtgctgcgaaacgaatccaaagccgcaatggtcagtgccagtgtgaatgcgacactcggcaggactccaggcgcccagagagcgaatttgagccgttccatgccgcgttaccccaatcgcaccagaggcacaggcacacattcgagcggcggtcggaagcctctcccccaattctcttcccgaagtgaaaaccgtttttcgcactgcgttcggcgccattctccggaccgcctccga

SEQ ID NO: 542147 - DNA, 1425 bp, Homo sapiens
ggagagagagagaactagtctcgagttttttatttttttttatttaagggtggacgggaagtaaaatattatgggggagtattaaaaggggggacagcacattgggaacccctcagtgaggtgcagggcccgccattgtgtgtccaagagggccaagaagcgtggggaagtgctacttaaccccacagccatcgtgggcatgagccgctctttctcagccaccagtgtcttacaatattacttcaaggaatgagaaatctgggcgtgaaagccccacacatctctatggaaaagtggtggaactacattcgtgggcggccgaggaaaaactgtgaacactgggcccctggcggcaagggcctccaaactcacagtgcgctccatgtgagacacaggacaaacaactgtggcgcggcggagatgtgagaaacatgtgaataacccctggcgccaaacggcgtaaccccctgtggccccaaacgaggccacagtggaggcaatatccaaaaagggacacctctcgacaaaggccagtgacagaggagagaccgagtacgagaccccccagaaaactgaggaaccaacaatactgtgggcaggacatcggcggataagacaacggggagcaagaggtcgtcgacaaccccagaaaacagcggaaaaatagcgaaaagacacacacaaaagagacccaccacacaacttcaacacacacagtgagagacccacacatggagggcacacacaaactcctccggagaacaagccaccacccagagggacacaaccagacaagggcacaaagcagtgaccacaaacaaaaacaaccacacgaacacaccacagaacgacaacacaaaaaaccgcgagcaaaaaaaccatcccacacaataaggcctactaaacccagaacacccaacagaccaacaaacagtgacagaaaccactgggcgaataccgagcgaacccccccgcgcgcacgcaaccgcagcacaaaccgggaaacaccgagacagacaacccaacaaaaacacacgagatacaacaccagcggaagaagaaacacaacgcgcccaggagagaacacccaaggcaaacccaacacaggagcccacaacaaatcaaacaaaaaacaacaaacgaacccaagcaacaccaagtaccacacaaaaccagcacaccagaagcagtgcgaaaaaacacgaacaagacagaaccgagcacaataaaaacaaagatgagacagcaaaggacaaaagaagaaaccaacaagacacagcagacacgacgcaacgggaaaaacaaaaaacaaacaaaaacagagcggagaggaaagaaacccaaacagcaccacgagcaccccaacagaggcacacccaacaaagccctacagagagaagaaaacccgacaccgcagcaatagca

SEQ ID NO: 542148 - DNA, 281 bp, Homo sapiens
cttcacttaaagccaattttgaaatttcacagggatttctggataggccgcggagggaagtttgtgttaagaatcatcgggcctgtggcccagccagcccgcggaggtgcagccagggtggcccctaactgggccagctggaggagcacggactgccccgctggcaggaagttgatgttccgagagcgtgagagcttgaacgcgatgtcctttgcagcttccagcttgcgcagtttgataaggccatcccttgcagtggccagggagttgccattcagttc

SEQ ID NO: 542149 - DNA, 540 bp, Homo sapiens
tagtacactaattagctgggatgaagtatcggagcagttctcacatatgcacatgggcagggctatcagagagtatactcggaatcacaaggtagttagaaccatcttgtatttttgcagagctgcctagaggtgacatctaggtagctagagaacctcgggtggatgggcttataagctctacctcggggaaattcacgagggcttcgttgggcctatcctgtatatcatgactagtaatcctgtggtattagtagactgagccacattaattaagtcaattccttcctccctccctctctcctttcctccctcccttgcttgcctttttactctgttctgttcttgcctttcctttgtgtcttctcttctcgtctcgtctcgtctcttctttttttctcttttcttttttcttttctttccgatagggtcttcctctgtcacccaggtttaagtgcagtggtgtaattaaaactcactgaatccttgaattaaacccatctttgactgggtttaagtgagcctcccatttcacttttc

SEQ ID NO: 542150 - DNA, 340 bp, Homo sapiens
tgcaggatgtcccagtgcatgctgggactgtacttcggcttcctcttggtgatattcgccattgacatagctgcggcactctggggatattcccacaaggcatgaggtgattaaggaagtccaggaggttttacaaggacacctaccacaggctgaaaaccaaggatgagccccagcgggaaacgctgaaatgtcatccactatgcgttgaactgctgtggttaggctgggggcgtgatcactgtttatctcagatcatctgccccaagaaggaccgtactcgaaacctttcaccgctgaaagtcctgtcctgagtgccaatcaaaagagagtcttcgac

SEQ ID NO: 542151 - DNA, 430 bp, Homo sapiens
agactctgcaggatccccgtatacgtgtggaagcatgtacttctgggccatttgatcacatgtgtggattagtgtagtcaccaccacaatcaagatacggaacaggctcatccccacgaacgtctctcttgtactgtccctttacagtcatgcttcctcctcctcttactttccctaaactttggaaactactaatttgttctccagatagataattttgtcatttcaaaattatcatataaatcgaatcatatagtatgtgatttttaaaattatttttttctttttagagaccggatcttgtctgtcacccaggctggcgtgctgtggtgtgatcatagctcactgcagccttgattttctgggctccagtgatcctccatcttcaacctcctgagtagctctgactacaggtgcatgccaccatgcc

SEQ ID NO: 542152 - DNA, 673 bp, Homo sapiens
  misc_feature (8)..(8): n is a, c, g, or t
  misc_feature (28)..(28): n is a, c, g, or t
  misc_feature (45)..(45): n is a, c, g, or t
  misc_feature (54)..(54): n is a, c, g, or t
  misc_feature (59)..(59): n is a, c, g, or t
  misc_feature (62)..(64): n is a, c, g, or t
  misc_feature (85)..(85): n is a, c, g, or t
  misc_feature (97)..(97): n is a, c, g, or t
  misc_feature (107)..(107): n is a, c, g, or t
  misc_feature (111)..(111): n is a, c, g, or t
  misc_feature (137)..(137): n is a, c, g, or t
  misc_feature (147)..(147): n is a, c, g, or t
  misc_feature (149)..(149): n is a, c, g, or t
  misc_feature (151)..(151): n is a, c, g, or t
  misc_feature (158)..(158): n is a, c, g, or t
  misc_feature (161)..(161): n is a, c, g, or t
  misc_feature (165)..(165): n is a, c, g, or t
  misc_feature (169)..(169): n is a, c, g, or t
  misc_feature (174)..(174): n is a, c, g, or t
  misc_feature (197)..(198): n is a, c, g, or t
  misc_feature (207)..(207): n is a, c, g, or t
  misc_feature (221)..(221): n is a, c, g, or t
  misc_feature (246)..(246): n is a, c, g, or t
  misc_feature (250)..(251): n is a, c, g, or t
  misc_feature (257)..(258): n is a, c, g, or t
  misc_feature (267)..(267): n is a, c, g, or t
  misc_feature (271)..(271): n is a, c, g, or t
  misc_feature (288)..(288): n is a, c, g, or t
  misc_feature (304)..(304): n is a, c, g, or t
  misc_feature (307)..(307): n is a, c, g, or t
  misc_feature (333)..(334): n is a, c, g, or t
  misc_feature (339)..(339): n is a, c, g, or t
  misc_feature (342)..(342): n is a, c, g, or t
  misc_feature (344)..(344): n is a, c, g, or t
  misc_feature (347)..(347): n is a, c, g, or t
  misc_feature (359)..(359): n is a, c, g, or t
  misc_feature (362)..(362): n is a, c, g, or t
  misc_feature (375)..(375): n is a, c, g, or t
  misc_feature (394)..(394): n is a, c, g, or t
  misc_feature (403)..(403): n is a, c, g, or t
  misc_feature (416)..(416): n is a, c, g, or t
  misc_feature (424)..(424): n is a, c, g, or t
  misc_feature (440)..(440): n is a, c, g, or t
  misc_feature (455)..(455): n is a, c, g, or t
  misc_feature (462)..(462): n is a, c, g, or t
  misc_feature (475)..(475): n is a, c, g, or t
  misc_feature (485)..(485): n is a, c, g, or t
  misc_feature (500)..(500): n is a, c, g, or t
  misc_feature (507)..(507): n is a, c, g, or t
  misc_feature (540)..(540): n is a, c, g, or t
  misc_feature (561)..(561): n is a, c, g, or t
  misc_feature (565)..(565): n is a, c, g, or t
  misc_feature (567)..(567): n is a, c, g, or t
  misc_feature (577)..(577): n is a, c, g, or t
  misc_feature (640)..(640): n is a, c, g, or t
tgtgagtnggtttgttttcttcatttcngaaattcgggtcatggnactttttcnaaganccnnnggggggttcccggggattttncccccccctacngatgaagacntccnagggccccgccgccgtgacgaagacnaaagcctgancngntctgggnccnaagnggcncggcnggggcggggggcccgggggggcnncccccgggnggccggggggctgnggggtgcgcgccccgccccgggggnagcnncccccnnccccccccncccnggccgccgccgccgccnccccgcccggcctgcnccnccccccggcgggggggccaggggccnnccccnccncnccncccccggccctnccncggcccccggggntgccgcggaagggcccccnaagcctgcncatagccaagggncaggtatntggccaaggccccccncagccctgaactggngtgtgtntgaggctccggcnggggcccccncacttgggcgcggancctgggngtggagagagcggaccccacacctggggccggnccaacctggggtggcaaaaanggantncgggtctttnggttttatgagggcagagggaggggcatgcgtcctggtaaatcgggtgctgcggaggtgaggnggttccattttggaaactgaggaagcagagctt

SEQ ID NO: 542153 - DNA, 167 bp, Homo sapiens
gtacgtggcttgcagtaaagtgaatagtcagctccttcttcttcccggaggacaaaaaaaaggaaaaatagcatgcgatgacgttcagttgtgggttgttggggggaatcactgtatcgctctcctttgatagctggaaagcgggggcttcgggagacgttattctt

SEQ ID NO: 542154 - DNA, 358 bp, Homo sapiens
cccccccttttaaggggcccccccttaattaattagggcccatgaaaaaagcatgcccccctggggatattaaaaacatatttatatggtgtggtatggggaggaaacatttttgtttgaacccctcccaaataatttccgaccccgctcctttcccaacctccaagagattctggccggtttttcggctgggggtggtggggtgctttccccaaccaaattttacatttcattaaaaaagggtttggtagggaagtcgggaaattgggcctttccctcccctttattattaaagggtttttttaactggaacagccccaccccgggcccagggggttataaaaattttgtccggcca

SEQ ID NO: 542155 - DNA, 226 bp, Homo sapiens
cgcggtcgacttctgctctcagagccttgcggtgaggctcgccccccgcaggagcattaccgtgtgagctccgcctcctgcagagcattaccgtgtgagctccgccctcccgtcagagcattaccgtgtgagctccgcctcctgtcagagcattaccgtgtgagctccgccttcccggacagaagcattaccggtgtgagctccgccttcccgatccagagcatta

SEQ ID NO: 542156 - DNA, 153 bp, Homo sapiens
aatttaggtttggagcctggctcctttgcatttgggattggggatcctgggtgggtgtttggtccattttcagggttttaccaacacgtgtgtgtgtgtgtgtgtaaaggctatccacccaaaatcccttttggccaggggggccccccccca

SEQ ID NO: 542157 - DNA, 181 bp, Homo sapiens
gtacttgccctggtagatcaaagcccaccgcgctcttgtatactcggtctgcctgcacgccatacttactggcaaaacccactggagtagtctttctggcgaggcatgcttctcagctcttcccctgggtattcaaatgccatacagaggtgtacctgagccgtcgaatttcagtacatca

SEQ ID NO: 542158 - DNA, 938 bp, Homo sapiens
gggagacggaagtgaccggcggggtcgactgacggtaacggggacagacaggctgtcgcagaggcggcggaagatgaatgccagaggacttggatctgactaaaggacagatccagtactgaacttcagaagtggacctttttgaaagtcatgatcttcttcggaaaggtttatcttgtgtgacaaatgaacttttgcctagtcatccccttgaattatcagaacaaaatttccagctcaaccaagataaaatgaatgggcacactgagaaacattcagggtctatttgctccgctaaaattacagatggcacttcaacggcagtgcgagcaggtcagcgtcttccatttcttttcaaagctcaaatctttccctggactgttcgacggggtactgctcgagcactatggacttgaggatatcttcaatgatcatcaaccaacagcgaagtcactggtcacgagccacatttgatggtcggaacaataaacacttggtcactgtcaatcagacagtgctggtcatcggacaaccggagcggctgcatcttggtctattagtcaacaataggtccactgcaaatttgatgctaacaacaaccattcctaagttaactgaacactcgaacaatgcctgccccacgcaagacatccgcgagagatgtcaaatggacggaggacaagggaaacgaacgtgacacataaacaacaaacggaaaagccggcagaccaaaaagtacaccacaaaagacgcaccacagcataggggccaggcggtcagaaaaaagaccacgccaaaacgagccgctatggcaacagaggcagaccaacagagcacagaacaagacaacacgctgggtagaccaaaaaagacattacaggccaacaggaacataacaaccccacaccgaacagccacgaccaaagcagaaacccacc

SEQ ID NO: 542159 - DNA, 335 bp, Homo sapiens
tgcttcggggagaggcgacagtgagaaaggagcaatgccggtcattcctccaataagcacgagaagagtattgataatgggtttcctgaacaactgtattagaaaaaggatcctaggccaggtgtggtggctcacgcctgtaatcccagcactttgggaagctaaggtaggcagatcatctgaggtcaggagttaaagaccagcctggccaacacagtgaaactccatctctactaaaaatgcaaaaattagctgggcgtggtagcgtatgcctgcagtcccagctactagggaggttaaggcatgaaaatcacttgaacccaggaggtggaggt

SEQ ID NO: 542160 - DNA, 803 bp, Homo sapiens
aacgacggtgctggtgacagccagatcgggcattgctgctggctcagtgggccttggcaagagggcagcagttaaccgactgtggaaggcgatacacacaggcccccgtggccaccatggccttcgaacccaccatccactctgactagccacaggatgtgctgtgatgtgggccgtgcgacgtctgggaaatcgtgacggcactactgtggacacacacacttcctgaggactcagcccgagtatcgtgcaccatagtggccttccaagccggaccctacacagcctgctgcatcttcatacatcggacacaggatgcacgacatccagcgtgtggtcacatgaaaggaccggtcatgcctggctgtgcatgaatgaaccacatacagcgccagtcaccatacaaatggcacattcagagacccagacaggcacacaacctatgcttcaagaatccaggtccagtagacaaagactctgtcatcactcataggggacacttcaagtatggctgccaaggaaccaagaaggacccgtggcccttgctgttatggaggcaagcggtgagaagggacttggttagatgcgtggttagaccaatgaagggaaggctcaagatggattacccaaaggagttggggtttggtggacagattacacaacaagggacgatgtaacgatatacattgacagagacatgaggaggaacaaaatgggcaaatagttggagagcgattggttgagggaagaggacagaatataatgagggccaagatgatggtggtagccaggaccagggaaaa

SEQ ID NO: 542161 - DNA, 1292 bp, Homo sapiens
  misc_feature (373)..(373): n is a, c, g, or t
tcgggtcccctaatcggcaagagggtggtatcagccgttttaagctatatctcaagagtgtggctgtaacccataactaaaagagtgcaacggtgcactgtggttaatcccgggtgtccgctgggaaattgtttccccggggggaaatatttcgagttcgcgatgcctcgcaatcgagaggtgcccggtcgcgtcctttagtgcccatttgcatgtccgtgccttcagacgttttggtcaaaatcaatccgtttgcccgggcatggggccacctaaggcccctggttctgccggttaaacgtctaaggggacgtcgtccgccggtccgttaggaaaagatccgccgaaaaggcccgagtcaccccgtggcacnagggcaagtggtccacacgcattcaccgggaccatggccctggggcgaccattacaatgtactggacggaggccttgcaatcccctaatggggccccaatgcgacgcaaagattgcggcttgcaaggcccagtcctatgcagtccgggcatcgcctcgctatccttgcaatgtttgcgcttcgtgtcatgtcgtgtctttgcaggcaccctggcatatgcgcatggatcgtagagttggtctccatgactgggcaacgcatcatggcaaggctagtgcgttgggctcgtgtgagctcgtggctcgctcggcggcaacacactctcgtgcgtcacagcgcacttacttgcggtgtgtctttcacgctgtgatggaaacgtatactgactcgaggtctctgcgtaggctctgactatcgatctgtacgcgaggagcctgcagtggtaacccagccgagtcactagctagcaggcaggccttgtgcttcttatgcagtatgcaatagcagtttcatggatgtgtgccctagaactcatgggtgacagtcaaggctctgtgaggggtttcaatgaggtcgactgataacatgtgccgacattgcaaagcggaattggctcataatgaagaaggtctcaaacctggagagactggagaaatgcagctcgtcataacgtaaagttaactttaggtataaacaagtacgaagttgactagctgacgggtataagaagtgtaaccatcagttaagacctctcctgtcattcctagcttccttgcttcagtaattgaaatggaagtgggggtgtccctactctgtagaattctgggactgggcaaatgtttgtgtggcctccgttaaacgtagctgttatgttatgatgtttattataaccggggtaattagagtaagctatttctac

SEQ ID NO: 542162 - DNA, 185 bp, Homo sapiens
cctggaactggacctgcaaggacttgctcctccaggccctaaaggagtcccagtcctacctggtggaggacctggaacggaactgaggctcctttccaacaacactccggtcagcccctggcaatccccccaaatcatcctgaatttgatctttttataccccatatacgaaaagccagcttgga

SEQ ID NO: 542163 - DNA, 109 bp, Homo sapiens
tcctgcttttcggaggcttcgcaggtctcacctcgacggtgatttgcaggtggagagtgctgggatggaaggccgggatactcacaggctgccgagagccctctgaggg

SEQ ID NO: 542164 - DNA, 219 bp, Homo sapiens
gacgtcgaggatggtgagtcatacctgtaatcccagcagtagagggaggctaagtcatatcgagtcatctgaagttagagttcgcgaccggcttggccaacatgggatatatcccgtatctactaaataatacaaaattcgccgggcgtggtggcacatgcctgttatcccaggtactcgggaagctgatgcagcacaattgcttgaacccaagaggcg

SEQ ID NO: 542165 - DNA, 330 bp, Homo sapiens
  misc_feature (10)..(10): n is a, c, g, or t
  misc_feature (59)..(59): n is a, c, g, or t
  misc_feature (101)..(101): n is a, c, g, or t
  misc_feature (130)..(130): n is a, c, g, or t
  misc_feature (135)..(135): n is a, c, g, or t
  misc_feature (185)..(185): n is a, c, g, or t
  misc_feature (212)..(212): n is a, c, g, or t
  misc_feature (232)..(232): n is a, c, g, or t
  misc_feature (241)..(241): n is a, c, g, or t
aagcagcagncctagggtgaagtaggcaaaagtacttacagactcggtcggccgggttnggtggtcaacgcccgtaatcccagcactttggaaggccaagncgggtggatcacagggtcaggagttcaanacaancctggctaagatggtgaaaccccatctctactaaaaatacaaaaaattanccgggcatggtggcgggcgcctgtaancccagctactcgggaggctnaggcagganaattgcttgaacctgggagggggaggttgcagtgagctgagatcgtgccattgcacaccagcctgggctacaaagtgagattccgtctc

SEQ ID NO: 542166 - DNA, 161 bp, Homo sapiens
caccccaggggaaacgccaactataacccctccctcgagagcgagcagcatgcactggcacgtcaggaccagtcgccctgaaagggacccctttgaccgccggggacacggccgggaataccgggcgagagaacgcccaacgggggaagccgggacgggcc

SEQ ID NO: 542167 - DNA, 390 bp, Homo sapiens
ttccatttcagatctacaccggttgacttttgaggctatctacgttttccaagagttcctgcattttacacttggagatcaaccagggtttcggtacatcacgaggcgcttgtgcgcccgagttactggtcgtgactgttagaaaccttgcgaatggataagtttaaggaaggcacgtaggaagaggaaagtgggcaagagcagttagaggaaggagagctggaagaaatgtaggttaggagtgtttggagaggtaggaggagaaaacggagatcgcacttactctccagagtgaagcctgagctctagtcatatacagatcccacagaccttggagagcttcttgcaaggctcagctcacaaaacctcacttaaaaaacaattctctga

SEQ ID NO: 542168 - DNA, 415 bp, Homo sapiens
tgtagggtggctctgtatgtttatttttatttagagacagcatctctccctgtcacccaggctggagtgcagtggtaccatcatagctcactgcagcctcaaactcctgggctccatcagtcctcctgacctcgtgatctgcctgcctcggcctccctaagtgctgggattacaggcttgagccaccgtccccggcctttttttttttttttctattgtgaatgtgtttgagcagtggccagtattccactctttaagaccttacaccagggccccttgagacaaatgcccgagcccagcactttgtgccctgtactatatctcagctgctttctgtcactttggttgatgaagtgttcagaattgggattgttgagatttcacaggtcactattgtggggatcatcagacttgc

SEQ ID NO: 542169 - DNA, 400 bp, Homo sapiens
  misc_feature (235)..(235): n is a, c, g, or t
  misc_feature (238)..(238): n is a, c, g, or t
  misc_feature (254)..(254): n is a, c, g, or t
  misc_feature (258)..(258): n is a, c, g, or t
  misc_feature (265)..(265): n is a, c, g, or t
  misc_feature (268)..(268): n is a, c, g, or t
  misc_feature (279)..(280): n is a, c, g, or t
cctttccttgcccaaccctcccttctttcctttgccggcaaggcagggacccacagtggttgcctgcctccgggagggaaggaaagggagggtgggtgggtggaagggggccttcctccagggaatgtgactttcccaggccccagaatagtttctggacccaagcccaaggcccagcctgggacaaggctccgagggtcggctggccggaggatatttttcccttcccgccttnccnggtgggtccccccacntgangttttgntgnagagtttgacnntggattcccccccctcaccccgcccctggtcccattcctgcccccgccctacctccgccccaccccatcatttgtggacactggagtttggaataaatgctgtttgtcacatcaacacca

SEQ ID NO: 542170 - DNA, 331 bp, Homo sapiens
ggatactggagaaggtgcgatggagtactacccttcggactggtggtgacttgctgaactcgcctgttgctgagtcaaatgtacctgtcaccccacagcttcttcatcatgtcctctactttctcggccctgctcggaaggcccaaactgaacctcccccttggcggcgaacttgtgcacatacatctcggcaaactgcttcagggtgaagtgcccacctgtgtaggccagacccaaaagcccacgtgttacctgaggacaggatcgatcactgctgtttgcccattggggcctcgttctcagccctcggccggtaggttgggaggcattg

SEQ ID NO: 542171 - DNA, 909 bp, Homo sapiens
cgcggtggctcacgcctgtaatcccagctctcagggaggctaagaggcgggaggatagcttgagcccaggagttcgagacctgcctgggcaatatagcgagaccccgttctccagaacaaaggaacaaccacacaaaacaaccaaaggacaaaaaaaaaaaaaaaaaaaacaaaaaaaaactgttgtgtggggcggcgcccggcgcgcccgggagaaaaaagtttctacacacccacttcgcgttgggcgcgcgcgcggggccccagggaggttcaaggtgcacaccctggggcccaacgggggccccaaggagaaaaaacccggggcccagaaacagtggggcgtgtgggtttcccccccaaataaaaaaagacgccgggggggacaccccaggcggtgtttgggaaacaaactccccaagagtgggggggtctcccgagggggccaaatcgggggctcatactcacccagggaggctcccaagcgacgccggatactaaaattataccgcccccgcgcgtggaggaggatgatgagtaggaagactaggggacaaaacgtcgtaagctacggttcaagacgtacgaatagaagaaacgatcatgaagaaacactaagacatacataatataacaacgaatgtatatacgcagctagcgcacggagaacaaccgacgtgcaatagaacgaagagctacacgagaacaacaagacatagaaaagaaagagtaaaaacaagaaagagaagacaaaaagagaaaaagcatagaacgaacgaagaaaagaagagatgagagacaaagtggtgcgacaaggagcgatggcatcacagagaaaaagagagatcaataacaggaccaggagaaaaatgagccggactagcagagaaagacaagaaacacagaaaa

SEQ ID NO: 542172 - DNA, 227 bp, Homo sapiens
agagcagagcgccgagggcgctccaccgtaccgtttcgcccgccgtgccggggaggtggagcacgagcgcacgtgttaggacccgaaagatggtgagctctgcctggagacagaggagccggaccgaactgtgcgagagctgcagcatgctgccttaggaggcacagctactcgacagaacaattgagccgctctagcctcttcgaaccatctagtagcgggtaccg

SEQ ID NO: 542173 - DNA, 251 bp, Homo sapiens
gtaaggctaaggagaagaggaagataaggttaaaagttgttaatgaccaaacatttaacagacatgcaaaacacaagtttattttcaagccttggaactatttaggcaagcaaatcatttctaatgcatatcatttgtgagactttctcattaatatcctgactcattcattttagctaaggcttcatgttgactcgatatgtcatctaggacggtactatttcatggtcagacctgttgccatagttggt

SEQ ID NO: 542174 - DNA, 142 bp, Homo sapiens
ggttatggctggagtggttatggtgccatatgggcttggaactcggataatcagaagtttaactaaaacttggaaataattcactttcatctggctttctagatttggtacatctcagtccataaagcaaggctggtggggg

SEQ ID NO: 542175 - DNA, 896 bp, Homo sapiens
  misc_feature (4)..(4): n is a, c, g, or t
  misc_feature (227)..(227): n is a, c, g, or t
  misc_feature (307)..(308): n is a, c, g, or t
  misc_feature (311)..(313): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (331)..(331): n is a, c, g, or t
  misc_feature (339)..(339): n is a, c, g, or t
  misc_feature (342)..(342): n is a, c, g, or t
  misc_feature (354)..(354): n is a, c, g, or t
  misc_feature (364)..(364): n is a, c, g, or t
  misc_feature (367)..(368): n is a, c, g, or t
  misc_feature (372)..(372): n is a, c, g, or t
  misc_feature (389)..(390): n is a, c, g, or t
  misc_feature (392)..(392): n is a, c, g, or t
  misc_feature (397)..(397): n is a, c, g, or t
  misc_feature (403)..(403): n is a, c, g, or t
  misc_feature (425)..(425): n is a, c, g, or t
  misc_feature (438)..(438): n is a, c, g, or t
tttnttaatattcaatttacgtaacaggctcaaattttattaattgaattctgcatccatacgaatttagtcttaatttataaagcaacttacttcgatactcttccttgaagtatgttataaaatacaacgtttaaataaacatcacaaaaatattgtttgtcgatcatttttgtgactttaacagagaaatcttcaagtttataatccactcattcttgcttacngccagacactacataaatccttaccaaaacaaaacaaacccaggtaggttcactgttacccctaggtatgcttcgttggnnttnnnccagngncncccattttncctctaanggngtcaatgctttngttctctacnggnntctngggggtgactatgatgnngngatgngggttnggggggtctgggggggaatganacatttaattaanggcaatagttgttcaaacagtaagaatgtatacacagtttatatatagatagatagatgggtatgtattttttccccagagaaagggctcaagagacaaaacagtaaaacacttcaactttccctaactcttgagagggtatctgattttgagtgagtttacgaagttcttattttgatgagccacttgtgtggggacacatatgcgtaagggctttttgtgaaagagccaaagcttgcatctgagttaaaacttgatagtcagtacacttgtactgggacatacgtgcccctgaagtttttattaaagagctaaaatctatgtctggcttataacttaccaatcaaaacaagtcacacacatacataaagaaggaagccatacatggttactgaaaatacacaaattattttcacccagatgtgtcacttccaccatgaaagactgctaagctgaag

SEQ ID NO: 542176 - DNA, 502 bp, Homo sapiens
cgcaacaacaagaagctgctgggcagagtcaaagcattcgacaggcattgtaatatggttctggagaatgtgaaagaaatgtggacagaggtgcccaagagcggcaaaggcaagaagaagtcaaagccagtgaacaaagatcgctacatctccaagatgttcctgagaggcgactcggtcatcgtggtgctgaggaacccgctcatcacagggaaataaagctgacgtgtaacacgactgttcaagtacagggttgtctcctggacacacactcactcacacaactgtgttaaaagtgataattaggcttttcagctaattaattattacttcatacacagaatgccttgagctgaaacaataatgtttagctggaaaacgtttaacatcatctggagagattgtctggtcaacaaaatgataaagatgttggagttaattttgttgttgttattgttttgtcatttgtgatttgttttctaaataaatttttggatattca

SEQ ID NO: 542177 - DNA, 650 bp, Homo sapiens
aaagggagtcaagcaggagcgtctgtctgaactgagaccagatatgaatctttcaccacaaaaatgttaaaagatatgaaggaaggagttaaacaatatggacctaactctccttatatgagaacattattagattccattgctcatggaaatagacttattccttataattgggaaattttggctaaatcttccctttcaccctctcagtatctacagtttaaaacctggtggattgatggggtacatgaacaggtatgaaaaaatcaggctactaatcctgttgcttatatagatgcagaccaattaccaggaacaggtccaaattggggcactattaaccaacaatcagtaatgcaaaatgaggctactgaacaactaagggctatatgcctcagggcctgggaacaagattcaggacccaggaaactcctgctctgcttttagttcaatcagataaggctctaaagatccatatccagactttgtggcaggttgcaagatgcagctcaaaaatccattgcagataataacgcccgaaaagttatcgtagaaataatagcttatcaaaatgaaaatccagaatgtcaatcgggcataaagccataaagaggaaaggttacagcaggagttgatgtaattacagaata

SEQ ID NO: 542178 - DNA, 157 bp, Homo sapiens
  misc_feature (83)..(83): n is a, c, g, or t
tttgtcagctcgtgttatgggacgttgggtatcgttcagggccggacctggtctaagtggtattctaacggggacacttgcgnatgctccatgacatgctgttaaaggtctagttcgatgctttgtcgactcaaccctccttggtgctctgggccta

SEQ ID NO: 542179 - DNA, 116 bp, Homo sapiens
  misc_feature (32)..(32): n is a, c, g, or t
  misc_feature (47)..(47): n is a, c, g, or t
tgtgtatgtggatgagcgtgggaaccctgaanggagcctctctgcantttctgggacacaggttgcagttaacctaggacaaaaagtcagtagagtcctttatgggctgctgatga

SEQ ID NO: 542180 - DNA, 381 bp, Homo sapiens
tgcagcacacaacagcagcagctgttagtgagctaagttagcacatgactgcgtaaaataccactacatctggccaatctatggaaaagagaaaaacaatggagttacttaattgtgaataacaagaaacgaaagttatctcttcccaggagaggctagaaatagcttttctgtcttttggacagtgccgagtggaatgcctggtttgggggaggacgagggactgggttcagctgtggtgcttcgttcgttcacggcagtctggccttgtgctactgcggagaacgatggagcctgggtctcaagcccagcttcgctgtacctttgccacatggtattgtatgcttgccagctagaatgagggtcaggtattttttaccg

SEQ ID NO: 542181 - DNA, 538 bp, Homo sapiens
cattgtgaaggcagtgagccatgatggtgttaccatactccagcctgggtatggtattttaaataaaaacatttaaaaataattttctggccagtgcacgatagctcatgcctgtaattccagcactttgagaggacaaggcagaaggatggcttgagtccaggaattcaagaccatcctgggcaacagagtgagactcctttgctacaaaaaaaacatggtggtgcacacctgtagtctcagctacccgggaggctgaagacttgggaggctccttgagcccaggaggtcgaggttgcagtgagccgagattgtgccactgcactccagcctggatgacaagagcaaaactccatctccaaaaaaaaaaaaaaccaaaaaaaaaccaaactttgtttttggtttttttttcccctctctcgcctctaattgcgggggggtgtctctgaaaagaggccagttcatgagggcaaaaaatatgtgttcccaaagggattcgggggcccttttccccaggccggggctgaagggggcactt

SEQ ID NO: 542182 - DNA, 187 bp, Homo sapiens
  misc_feature (104)..(104): n is a, c, g, or t
ttggtactggccaaatggcagccagagccctggcccaggcactgagaagtttcccctacatgtaccccctatcccgtgcagtccagccctgggctatggcacgntgctgtgccgggcaggctggggccctgggcacgggggctcttactaaaactaggctgcatcagtgaggaagcccaggagagca

SEQ ID NO: 542183 - DNA, 389 bp, Homo sapiens
agggggggtttcctctgtggactacaagttaaatttacaatggttatataaagggttctgtgcgccaatttacatgttgaactaagattctatcttggtcacacagctgccacataggcgggtgtgctctgttagctgctcttaggtagctagtctggtttcgtgggtcttagcagtggctctccgtgcaaagctgtttctagttaattcattacgcacaaggtataggggttagtccgtgctatattatgctcggctataatttttcatctttcccatgcggtactatatctactgcgccaggcctcactttccatcgcctagcctcaatttgggtcaatggtttggctaagggtgtctggtagtaaggtggagtggctcgtgccgaa

SEQ ID NO: 542184 - DNA, 887 bp, Homo sapiens
  misc_feature (31)..(31): n is a, c, g, or t
ctggcgccgaccgctggtgtgcggtgatganttagagcggagtctggcaccaacgaggagaacgcgcggccactctttctcgatgaaaacgatgaacgcgcttgggacgacccgccccgccgtttgctccacgcggtagcgtttcgacggtcgggtcaatatgagacctctcctggtgaagtgcctcccctctagggaagggacaaccgccgccccgggggatcacgacggccccgccccggagattgtgaagagccgagaacctgggaggaaacaacgcccccgccctgcgaaaaaagcggacgggttgtttccaaaagcaagaggggtcaggcccttttaaaccgcgccagagaggggcaagtgcccgccccccctggcacgagttgccgtgccccgcccggtacaaatggggcccgcgcagggcacgcctgaagcttcgcacaacagggcgcccccctaagagtcccctgtgggctgcggcgacaccaagtacatccctgttagcagggcagaagtccaggactgagtgaatggccccaagcaccaagcaagggcccccgccaacgaccaacaggcgcagaaaccacccgaaagacaaataaaggaggcaaaatctgtacgcaaaacaatgggaaaccccgttggcgccccccaaagcgaaggatattagggcggcaatgcgcatggaaaaagaaaggcggccagagcattggggccaaaacaagtaaaacacggggaacccaggaatacacaccggtggtcttgccacccttgggcaacaacgggggccgacagtccctcccccggcggggtgactccccggcggaataccccccaatacccttgtgtccaacaaagcaaaacaattccccgcccacatgaca

SEQ ID NO: 542185 - DNA, 1353 bp, Homo sapiens
aaccatgcgtacgctgtaggcacttggtcagtgctcgaggtggatgtgttggcgttgaggtgactgacaagctcggcaaggagatatcccgtccgacgcattacaacttcttaatgtcaaccatagcgttcaagatggccgtataactctgcataaacacgcgctgggcctagggctgcttgcgcgacacgatatcaccgctaagagaggaaactatgtcaaaggtagggtagatcggagattaatacgcagggctactcaaatatggcgatgttccaagtgaaaacactagcagggaccttgtggtgcgtccattccactctgcgttcgcaagagccatctacgtaggtcactgagaaggggctaggaccatgatgttgaagctgtggcatggcggccgtactttactggcggggattcgtgatacccccagtaatgcttcagggcgtctgctgtctgttagctgctgtctgagcatgtgctcgccattgggcctccaaggcagccgctttcggactacggtggccgctgcagtgcaagttgccatactctgggtctgtgagagaaacgtaggggctgtcccggagttgacatcacgcgtcaaccatcaccaatcttgttgcctcgagtattgtactccacgatatactccaagttggctcgcatgggtggaaccggtacggaccttagctgcaaagtttgagtgaggataatagaccggctgatggttgccgctctgcgaagctccattccggtcgtcccctggagattaggcgcgttagctggttgttaaacccccaggagggaactacctatgacccggtggatcaacacaggctgaggagtcgaacaactcagtgcagccacagaaccagattgagttgaggggtccccaaagacaaagcccttaaacctggtgaatgaaccgcccgatcaccaggcgtctccagtattacctcaaaggggccctcaacccaaagaactccaagccatccagcaaatcggcggaccctcagtaaaacacagaaaaatcgggaacagcacacatatcccgagaagaacacaatgcgccacacctatctaccccgggccccacagcataatatacatcaaagccaaacctagctaacccactccgactcaaacacccaggaacacaggacacagagaaccagggaaaagacgaacaacaggagcacactataacatcacgaagacaagacacaaaccaacgtagacgccaacacgtagacgtcgtcagtcttctcgtaaacaactaaacagcacaaacacccactaagaagacagcacacaaagacaagcacgcagacgctaacaacaacaccgcaagaa

SEQ ID NO: 542186 - DNA, 138 bp, Homo sapiens
agtgacgtggcttgtggctggcctcaaactccatggtctcaggcgatccacccacttcaccccccaaagcgcttggatcacaggtgtgagccaccgcgccaggccgagatgtttttgtctgtattgttcattgacggt

SEQ ID NO: 542187 - DNA, 153 bp, Homo sapiens
ggcggcgtcgggtgggggtgctatagggtaaatacgggccctatttcaaagatttctaggggaagtatgtggagtgaaatagccgcgatgggcgggtcatagtgccttagagccgacagactctaagaggcaacccctcaaataccgcacaac

SEQ ID NO: 542188 - DNA, 550 bp, Homo sapiens
  misc_feature (18)..(18): n is a, c, g, or t
  misc_feature (22)..(22): n is a, c, g, or t
  misc_feature (45)..(45): n is a, c, g, or t
  misc_feature (61)..(61): n is a, c, g, or t
  misc_feature (95)..(95): n is a, c, g, or t
  misc_feature (459)..(459): n is a, c, g, or t
gccgccacactaggatangaanagagcagaagcgtagatctaggncagcggtctttaaagngttaaaatttcctctcgctagtaaagcttacagncggcaagaatataatatatacacacaaatacagttataatggtgaaaactggaaacaacttaaatgtccaacaatacaggcattaattctctataaagtgaatatcaaatagccatagaaaagacattaaagacccagaagtgttgctaatggagcaaaaatacatcctttccggtcagatgcagtggctcacacttgtaatcccagcactctggcaggccgagatgggtagatcgcttgagaccagctggggcaatgcagcaaaaccccatctttgcaaaaaatacaagaatacaaaaattagccaggtgtggtggcatgcgcctctagtcccagctactcaggagacagaggtgggagaatngcttaagcctgggaggtcaaggttgcagtgagccctgatcatatcactatgttccagcctgggtgacagagtaagaccctatctcaaaaaa

SEQ ID NO: 542189 - DNA, 1019 bp, Homo sapiens
  misc_feature (37)..(37): n is a, c, g, or t
  misc_feature (67)..(67): n is a, c, g, or t
  misc_feature (70)..(71): n is a, c, g, or t
  misc_feature (73)..(73): n is a, c, g, or t
  misc_feature (79)..(79): n is a, c, g, or t
  misc_feature (85)..(85): n is a, c, g, or t
  misc_feature (94)..(94): n is a, c, g, or t
  misc_feature (101)..(103): n is a, c, g, or t
  misc_feature (106)..(110): n is a, c, g, or t
  misc_feature (128)..(128): n is a, c, g, or t
  misc_feature (131)..(131): n is a, c, g, or t
  misc_feature (137)..(137): n is a, c, g, or t
  misc_feature (147)..(148): n is a, c, g, or t
  misc_feature (150)..(150): n is a, c, g, or t
  misc_feature (155)..(155): n is a, c, g, or t
  misc_feature (176)..(176): n is a, c, g, or t
  misc_feature (186)..(186): n is a, c, g, or t
  misc_feature (188)..(188): n is a, c, g, or t
  misc_feature (191)..(191): n is a, c, g, or t
  misc_feature (200)..(200): n is a, c, g, or t
  misc_feature (202)..(203): n is a, c, g, or t
  misc_feature (219)..(219): n is a, c, g, or t
  misc_feature (229)..(229): n is a, c, g, or t
  misc_feature (246)..(246): n is a, c, g, or t
  misc_feature (260)..(260): n is a, c, g, or t
  misc_feature (264)..(264): n is a, c, g, or t
  misc_feature (280)..(280): n is a, c, g, or t
  misc_feature (285)..(285): n is a, c, g, or t
  misc_feature (614)..(614): n is a, c, g, or t
  misc_feature (937)..(937): n is a, c, g, or t
  misc_feature (955)..(955): n is a, c, g, or t
  misc_feature (959)..(959): n is a, c, g, or t
  misc_feature (974)..(974): n is a, c, g, or t
gcttcttaaaattcatagaaagaaataatatatttgncccatcggccaccccccccgtctcccactnacnncnatactnccaganaacacgctnctacaannnatnnnnnatcacaaaaaagatagcntantgaaanttcaaaattnngntacgntccgagggtttcggcgtgtangaggttgctnangtnttttttttntnntatataattatttaantattataagngactctgtatgcaaagngtacaaggaaagtnagangttagtgaggtatgangatgngggggggttttgttgaggaaaaataacttagtctagtttataagttgttgcagaataaaggaaggaagaaaagatacaggtaaaactgaatgcatataaaagttggaaagagagaatcttttgtggtcaaactgaccaaaattgagtgaatttattatgtcttaaaaatgagagtgaatttattatgtcttaaaaatgagccctaatatcaagggtacattgatgcaaaactagaatttggcattatcttttaaaatgcaagattttcttgtagtattgataaaaaagagtgaaagattttctttttcaccttttaagtaatctgccanaaaaaattatgtcttatcaaaataattttctctttcatgttatcttttatcaggccttcaattactttccaagaaaataaaatcctattaagagagctaatatatatatttttacaactatataactttatttgccttcaaagccttttaataattaccctggtgattatgaaatgaatattaataaatattaaatgctcattaaatacttaaatcataaaatattaaatgattataaaatgaacagttgattaaataggatcccagatcactatataattcaataatcactctggtaccagactaattattagtgactaaantaatagtacctgagatcntatnatcaaatttttcttntttcttttcttaattcaaaaattgggaggctcatgatttgtgagt

SEQ ID NO: 542190 - DNA, 900 bp, Homo sapiens
  misc_feature (1)..(1): n is a, c, g, or t
  misc_feature (176)..(176): n is a, c, g, or t
  misc_feature (209)..(209): n is a, c, g, or t
  misc_feature (230)..(230): n is a, c, g, or t
  misc_feature (245)..(245): n is a, c, g, or t
  misc_feature (285)..(285): n is a, c, g, or t
  misc_feature (362)..(362): n is a, c, g, or t
  misc_feature (403)..(404): n is a, c, g, or t
  misc_feature (440)..(441): n is a, c, g, or t
  misc_feature (452)..(452): n is a, c, g, or t
  misc_feature (465)..(465): n is a, c, g, or t
  misc_feature (480)..(480): n is a, c, g, or t
  misc_feature (490)..(491): n is a, c, g, or t
  misc_feature (496)..(496): n is a, c, g, or t
  misc_feature (498)..(498): n is a, c, g, or t
  misc_feature (502)..(502): n is a, c, g, or t
  misc_feature (504)..(504): n is a, c, g, or t
  misc_feature (507)..(507): n is a, c, g, or t
  misc_feature (510)..(510): n is a, c, g, or t
  misc_feature (517)..(518): n is a, c, g, or t
  misc_feature (534)..(534): n is a, c, g, or t
  misc_feature (536)..(536): n is a, c, g, or t
  misc_feature (540)..(540): n is a, c, g, or t
  misc_feature (542)..(542): n is a, c, g, or t
  misc_feature (547)..(547): n is a, c, g, or t
  misc_feature (560)..(561): n is a, c, g, or t
  misc_feature (578)..(579): n is a, c, g, or t
  misc_feature (583)..(583): n is a, c, g, or t
  misc_feature (596)..(596): n is a, c, g, or t
  misc_feature (598)..(598): n is a, c, g, or t
  misc_feature (600)..(600): n is a, c, g, or t
  misc_feature (610)..(610): n is a, c, g, or t
  misc_feature (617)..(617): n is a, c, g, or t
  misc_feature (625)..(625): n is a, c, g, or t
  misc_feature (639)..(639): n is a, c, g, or t
  misc_feature (681)..(681): n is a, c, g, or t
  misc_feature (683)..(683): n is a, c, g, or t
  misc_feature (692)..(692): n is a, c, g, or t
  misc_feature (696)..(696): n is a, c, g, or t
  misc_feature (703)..(703): n is a, c, g, or t
  misc_feature (735)..(735): n is a, c, g, or t
  misc_feature (805)..(805): n is a, c, g, or t
  misc_feature (852)..(852): n is a, c, g, or t
ngacaagttgtacaaaaagcacgctgtaccggtccgaattcccggatcccgacccagctctgctctactggggccccgggctccccaatggcctctttcaggagatgaagacatctcctccattgcggacatggacttctcagccctgctgagtcagatcagctcctaaggggttnacgcctgccctccccagagaactgggttgcagnggattgaagccctccaaaagnacttacggattctgntggggtgtgttcctactgcccccaactttgtggatgtctnccttggaggggggagccatattttattcttttattgtttttatctgtatctctctctctttttggaggtgcttaagnagaagcattaacttctctggaaaggggggagctggggaaanncaaacttttcccctgtcctgatggtcagctcccttnnctgtagggaantctggggtccccnaaccccaaccaccancttctggaannctccnanaaananaancangctggannaaaggcctttgagccnanaaancnttaanaagtaacttccannatggaaacaaaacagcnnaaanaaaataacgcccnananaccagccccnaaatggnactggcantgtccctgtgcctnacaccagcgtttgaggtgctggccttcctgccctacagaggncnctgccggcncttnccttgcncaaccatggctgaaggaaaccagtgcaacagnactggctctctccaggatccagaaggggtttggtctgggacttccttgctctcctctttctcaagtgccntaatagtagggtaagttgttaagagtgggggagagcaggctggcagntctccagtcaggaggcatagtatcttcctgggacaatcaaagcacttt

SEQ ID NO: 542191 - DNA, 476 bp, Homo sapiens
gccaggcctggataggccagaggtgctccgtggattgcaaaactcctcttctcacctgccaaagatggagaagagtgccagggacccctcaagggagtggagacggctccagtatcccagggacataggatcttgcgaggttgcctatggtagcaaggagcaatctcccgatcgtcagcgtgacgtgttctgcgtcttctggagaactttgcgtcacaatctggcgaagacgcgagtcctagtccgtctcgttacgtgtcgtggctccatcgtcttgcatgctgcagtcgagtcacgtaggtggatggctggaaccatcttcagaagaagttttttggtatatggatgaggattttcgttataattgttggatagcaagggtctatcgtactgatcccctaggatatctcatctggatgtgatttttgagacaaattccacttcgtaggtttcatactttaacttgtacacaatat

SEQ ID NO: 542192 - DNA, 539 bp, Homo sapiens
  misc_feature (274)..(274): n is a, c, g, or t
  misc_feature (327)..(328): n is a, c, g, or t
  misc_feature (356)..(356): n is a, c, g, or t
  misc_feature (521)..(521): n is a, c, g, or t
  misc_feature (536)..(536): n is a, c, g, or t
ttaggacataccaggatctcacatgtcacccagtgctggagtacagatggcgccatcacagctcactgcagccttgaactccctgggctacggttatcctctcacactcagcctcctgagtagtatgggactacagacgcattccactatgcctggctaattgttagtattttttatagacacggtggtctcattatgttgcccaggctgttcttgaactctgggctcaagcaatctgcctgcctcagcctaccggagtgctgggattacagtngtgatacatttctgataagagtgcaattagtacagtggttgctataaccattnnagagaatggtttgacaaaaacaaagttnaaaatgcaattcgactccttcctagtacagtagagagacttttaccctgtgtacatgagaagacattatagcagggtgttccttataatattatttcataatggtgaaatttgggaaacaattcctaagtactcaatcagggcttttttttttttttgagacggnttcggcttctgtcanccg

SEQ ID NO: 542193 - DNA, 262 bp, Homo sapiens
  misc_feature (16)..(16): n is a, c, g, or t
  misc_feature (167)..(167): n is a, c, g, or t
ccctggggtccccccnttttccatataaacaaagacaaaatacaagaattcatgattaacaaatgaattagccatttcccatagtaattcttaagtcttttgtctgatttttaaagaactttcttataaatttggatcatgttatgatttgtaacattcacacaacncctcacttttgaatctataaaagaattgcacgtatgagaaacctatatttcaaaactgctgaaacagacatgaaataaagaatttaaagagggaa

SEQ ID NO: 542194 - DNA, 631 bp, Homo sapiens
  misc_feature (492)..(492): n is a, c, g, or t
atagcgacaccgtacctcgctaaaaaccggttgcgcccacacttacgcccagccaatgggactcttggtgccatattgatcgctgcaagctcaatctttctggtgaaaatatcgatcaacctgtggtgaataactgcccttagaaatcacctaccctattctgatgataaggacgatgttccctatttaaaaatatgccccctcttggtcagtcacggcatccgctccatggctaacaccatcctgaacgagcgtgggtagcgtccggagctaatcgaagtcgcgctggcgcatgttgatagagatgaagtccgaagtgccataccgggctaattacagcgaccccgagacacccagtgaatactgcgcactccatcctcacgggctcacgcttaaggtctatcagacaaccgcgacttttgcctttctacggcggatcaaccctgctgttaactcgtagtagtagatggtagctggagctgagcatcgcanatagtgctccagaaaccatctcacgtgcttttctctccaggaccagggagtcgcgcaaccccagcgttcacgaatcatctcgtgcatcctttctgcttgcctgatgtgccgctgctgcgtggcagtacggtgtcgctat

SEQ ID NO: 542195 - DNA, 876 bp, Homo sapiens
gctgggaggagactctctgagggtgtagagctagagggagcattcatggccatgcagtagttaccactgatgctgagtcagaaacaggtatcccaaaatccctttccaatgagcctccctcagaaccatggaggaaatcagagcacacatgcccacagcctcgatgaccctgatgcacctgccccattgtgtgatgaaaccaatgccagtgtcaagcaccccatgaacaatgaccatgggctcaggcccgcttaggaacaccagcgtgacaggcctgtcaagagtatcggccgatggaatattggacctcttccactcaggtcatgcaaagagcccttatgcaatgcaaaaaaatgtttcccaaagctatgtgtggggtaggagttggcagtgatgattctcaccacaaatttcaaaggtttcaccgtgatgaatgaaggcgagagatagaagtctccagaatgtcgtacgtagagaggttttcaggagatgtccgtggacatcacgccagagtttctggaaaaacacaagattggcttggtggttcatgatgaatccgtattcctctgtggtctgatgatgttaccacgcacattaaggagcaggtatgtggtccaacgcgagaacgaggttctaatctcggactatacaagaatgtgtgacatgatgttatgcccgcgtacttcaaagggtttagccagactggcgcacgtttactaggacgcgtcttccgaccgggccatcgcactcgagttgggcagctcgcttcgcggggccaagcgctcacacgggaaccggattggctcacggccggcagcaatcaagagcgtcgtccacgtgacgggcccctttacccatctgggggggcaggcgctt

SEQ ID NO: 542196 - DNA, 170 bp, Homo sapiens
ttggggtagacgtggacggaactgactggacgggtaggacgacgccttgacgcctgcgacgaagacgtctcttagacatagacgacacgctgacacgttaaacgttgtggaacgagacgtggggactaacctgacgtgaccacgataactcacggacgacagacaaacgg

SEQ ID NO: 542197 - DNA, 237 bp, Homo sapiens
cctcaggactcatatattgatacttttcatttaacagtagggagatctggagtaccagagaactgcctcattgttcacttctgcactgtattctgtagttagccatcctgctgtagggaattacagtatactaatcttttgatattaccaaccggtctgtgcgaatcatcgtcatacacaacccttgtgcccatggatgagtgtttctcagggtaggttacccaggaagtgaaaatc

SEQ ID NO: 542198 - DNA, 852 bp, Homo sapiens
  misc_feature (42)..(42): n is a, c, g, or t
  misc_feature (206)..(206): n is a, c, g, or t
  misc_feature (248)..(248): n is a, c, g, or t
  misc_feature (325)..(325): n is a, c, g, or t
  misc_feature (368)..(368): n is a, c, g, or t
  misc_feature (411)..(411): n is a, c, g, or t
  misc_feature (459)..(459): n is a, c, g, or t
  misc_feature (477)..(477): n is a, c, g, or t
  misc_feature (490)..(490): n is a, c, g, or t
  misc_feature (498)..(499): n is a, c, g, or t
  misc_feature (501)..(501): n is a, c, g, or t
  misc_feature (517)..(517): n is a, c, g, or t
  misc_feature (521)..(521): n is a, c, g, or t
  misc_feature (542)..(542): n is a, c, g, or t
  misc_feature (833)..(833): n is a, c, g, or t
acggctgctgattctggtggctggtcaggaaaccaaggaganccccccccccaaccatggacccaccgtcgccaagccggacctcccaaacccagcccacagccacctctccgctgacttcctaccgctggcacacagggggcggtggggagaaggcggctggagggttccgctggggccgctttgctggctggggcagggccctnagccaccaggagcccatggtcagcacccagccagcccctcgntcgatattccgtcgggtcctatctgcgcctcccaaggagtcacggaccagtcgccttcgactctccaaggccctctnggggaggcataagaacccaccgccggagccagacccggagtcnggagcaggaggccccagagctggagccggagccagagctgganccccctaccccacagatccctgaggcccccacacccaacgtgcctgtntgggacatttggggcttnaccctgctttatnggaatctnntnttttttggatgatatnattntttttttttaatgttcctttnttttaattgctagctccgagggcagcatccacgtggccatggggaacttcagggatccagatcggatgcctggaaaaacagaaccggagactgctggtcccaaccaggtccacaacgttcgggggttgctcaagaggctgaaagagaagaaaaaggccagaccccccagtgctctgggctctagggagtcgctggccacactctctgaactggacctgggtgccgagcggggatgtgcggatctggccactgcaccccagcctcctgggggagcccactgctttcaggtanctggacgggtggaagcgct

SEQ ID NO: 542199 - DNA, 210 bp, Homo sapiens
cacaccaccgagtcacgagctttggtctaggaatgatttggaaaagaactgaagcgcataattccacaggtacattctcagcttgtgtgctacagacagagaggagcagtgaaagtgttttatgaaccatttgcgcgtggacaatggacaggcccggtcttcatcggtattccgtgtttgctcgatcctacatctgcgtggaagcgtgga

SEQ ID NO: 542200 - DNA, 442 bp, Homo sapiens
gcacgaggaataattacattattgattgctacgtccaatacgcatccagtgctctggctacaaaggttttcttaagatccgccggtggtgctgccttccccttgtttaccattcaaatgtaccacaaattgaatttgcactggggttcttggttgttggctttcatctccactgctatgattgctttaccttttgcattttcttactggggtaagggcttgagacataagttgtccaagaaggactattccatcgacagtgttgagatgtaagctggtgcaagtttacggtaaaaataatgatgttctagtcattcatatatacgatacaaaaataacaaatttccacatatattctgaaaaattaatttttaatattttatattaggaacttctcaaaaaaaccgtcgggacatttctacatactctttaacgaaatatca

SEQ ID NO: 542201 - DNA, 611 bp, Homo sapiens
ccgcgggtgcagtgggtcggttcgatcgcgccgcgacctgacatcggccggagttggcgtccttctcctctccgagtgctgctcctgtcattgtggccatggacggtaccctgtccagttgaagttcacgggaagcagctggagaagctggccaggaaggcggagaacggactccagcgcggaggaggcaagtgaagaaggcccttctgcagaaaatgtaagtgtgcccgtgtgtatgccgagaacgccatccgcgagaagaacgaatggtgtgaactggcttcggatggcgtcccgcgtaacgcagtggcctccaaggtgcaggacagctgtgacgtatcaagggggtgacccaagaatatggcccaggtgaccaaagccctggactgggccctgagcaccatggacctgcagaaggtctcctcatgtgatggagcaggttcgagcagtaggtgcagaatcctggacgtccatacatcggtgatgggggactccatgagctcggcagcatcctgagcacgccgcaggagcatggtggacaggctcatcatgcagatcgccgagggagaaatggctggaggtgctggtaccagctcagccagttgcacgag

SEQ ID NO: 542202 - DNA, 156 bp, Homo sapiens
  misc_feature (129)..(129): n is a, c, g, or t
actagagctctggccgtgtgtatatgtatacatacgtgaacacatgcctgtgtgtgtgtgtgtgtgtgtgtgtgtacttgtatgcacgtaggcaccagcacaaagatctgatgatgcaccccacccccnccccataaagaaataacagaaaacccg

SEQ ID NO: 542203 - DNA, 324 bp, Homo sapiens
gatttaaaaaatcaattatgctaagaaaatgatgagttatgtttgctcatatagtcccagaggattcaagttacttggatgaatctattagattaatagagtaattctttgttatagttttttatcagtctagatatatttttcttaacggatcagatgtccatggtgttaacgtgtattgggcaagcgttaagaagactatgaactcacagtaaatctggactgaagtaaaacaaatgttggtggcaatgtggttgtacagaagagaaatatcgcagccattgatcagtcagaagatatagcagaaagagattctattctaca

SEQ ID NO: 542204 - DNA, 173 bp, Homo sapiens
gttaggcactgaagcctgtattgtcaggcttctagtgctgcacaggcttcagtgcctaaccaggcttcagtgcctgaccatactggcttcagtgcctagacaggcttcagtgcctgaccaggcttcagtgcctgaccaggcttcagtgcctgaccaggcttcagtgcctgacc

SEQ ID NO: 542205 - DNA, 695 bp, Homo sapiens
  misc_feature (158)..(158): n is a, c, g, or t
  misc_feature (427)..(427): n is a, c, g, or t
cgtccttttttcttttttttctttactaaaaattattttcccttttagaaaagttcaccaggaaaccagttcccctcccaccaggcggggcaggccagagccttcttttaaaatccgcgacggatttaccctcacacccccagaacaggaactcctcnaggatgggcctcagaggggctgggagtctctccctgtctgggcggggacaccctgtgtggcggtgaaggcccctctgccacagacggagggttgctgattggtggggacaccagtctgggtttgtgggtgttctgtcctggtcttctaacttgaaagacgacttccctggggtgacaggcccagtgcaggaagtgtgagctatcgaagacaccctggtgtgaagtcttcgcagggcccaagcgaaaattgtgttgacattcgctcagcngctagtgacttgcttgtggaagtctgtacgtcgttggtggtgtccctggtgacagctcccagggttggtttccttggcggcaaccctttaaggaattttctagccatcgacaaaaagtcgtgtctggtcaaccctgcttgatctcccagagcattacagccacattcctggtagggtataggggggcgggcaaacgccgccggtgtgcagcacgtggctgacaagtctgctgtccaagctggtcatcacctgtcaatcagttcttccg

SEQ ID NO: 542206 - DNA, 394 bp, Homo sapiens
caggagcttttcaagcgcatctcggagcagttcactgccatgttccgccggaaggccttcctcccctggtacacaggcgagggcatggacgaaatggagttcccccaggctgaaagcaacatgaacgaccttgtctttgagtatcaacagtaccaggatgcccccccaaaaaaggaggaggatttcggttaggaggcccaaaaggaggcctaaggcaaagcccccatcccctcagggttttcagttcccttaaccgttttaatcaaatgcccctttcctctccctcaaaatttgtgtttgctgcctctatcttgttttttggttttttttttgggggggggtttaaaacagtgcctggcccatagtaggcgctccataaaaacttgtttgttta

SEQ ID NO: 542207 - DNA, 195 bp, Homo sapiens
  misc_feature (82)..(82): n is a, c, g, or t
  misc_feature (98)..(98): n is a, c, g, or t
gccacgtatgctcagcttctttcacgctcgacacagccacaagaagatattggttgtcccccagaaaagtaatgtgattganttttcaaactctacantgatttttaaaactgcaaggccgtgaattcaagattccgtgactagaaaatgcctggcacttccttacaaggctctaatattgtcactcaaatgacg

SEQ ID NO: 542208 - DNA, 1145 bp, Homo sapiens
ccacgcgtcgggtgggcgcatcatgccaggacgaggtggagcgaatacctggaggtgcaggggtgagtgtagccttgtgtggggtgtccacgatggacggtgggaccagtgatggcatgaccttggatggtggacctgtggggaatggagccatgcggtgtgtctggccttggttgtgtggtcactggcaaggctaaaatgtctgtggcgtaaggtgcccatcgtgtagatccgagggcactagccaagagtgggaacatcagggacactggacggaagctatcccatgcgagagcaggaacccagggacggcaccgcgccgtcgatacagagactgagaagcacaagagaagaggcaacgataaaactgagctcgggaaggccagagatgagcggcgcatcgcacaacggagcgggcatgcggttggggtacccatgaggccaacatggcgggaacaggggtggccgatctggctcaattcacagagagaggaaagggggcacgcggacaaccacagagacagtcggacagacggcggaagacgccacacagggtgagcatgggcagaacgagaaggaggacggaaaaggcgcaaggcacggcgcacatagtgatacggctcacagaattctgaggcgaaacatagtgggggggtgagatacttcgaccaattaccttagtagagcgttgggacggtatgagcggatataaatcggtgggataagaaagtagtggggcgcgtttataagcgcaccgtagagcccacttgttcagcgaggagcagtggtagacagaagttaccagaaagacaaaaaatgtcgacaaacttcagatagattcaatctagcgactagtaacgggacatacagcgcgatagcgcgtggacagagacacagacagagcagcagcaatagcgacgaacagccgagagaagcgccacgcgggtatacccacacgcaagacccacgagtacccaaacgggggggagaaacataccgacaccaaacatagaggcgcagccccgcgacgggcaccgaacgaaaagtagtaagccccgcgaagaagacgacgccaacgagtccacaaccgctggtcggcagcacatcgaggcgacacgcacatagtacacggagggaaacgacgt

SEQ ID NO: 542209 - DNA, 115 bp, Homo sapiens
ggtactcgtatagggggagttctctggaggatacagagcctgtctgagaatcatgcagtacttttcccagcttgtccagacggtgtgatcctcctagagatcgactctgcagtgc

SEQ ID NO: 542210 - DNA, 866 bp, Homo sapiens
ggccagatgtactgctaccccggcagccacctggcccgggctgctgacgcgggcgctggctgctggccctggtgctggccctgctggtcgggccgttcctgagcggctggcgggggcgatcccatgcgccggggtggccgctgggcgcgcgatgggccggtccctccagcactcacgcaaggccgcatcggtgctcctggacgtctcgtgcgggacaggctgacttatggtggacggaacgccaccctgacgcccgatggacactggagccaaacactcaccaaaagccataccgagagacttgggttgggccttccttggagcttgggcacaagtaggccaatacaaatgacaggctttgcagggccttatagcagacgagatagtggtgagaggcttagcttgtgtacgagaaccgcacactatatacatacatgcaacaagaggactggaaagcacaggcagcgatagaaagttgaacaagacatataacaaccatatacctcaacattactagcaacagtaagagaataacccgacaacaagaacagtcactagaacaagcagaagaaacaacatagacagggccaccacaaccataaaaaaaaaaatagagcacaaatcgaccaataaccaatacaactcacataaacatatacgaaacaccacatataaaaaaaaatcaacaacactacaaacaaaaaaaaacaaccaacaagacaccaaatctaatccaaaaaatatatacaaaaaaaaaacacataccacacacaacgaacaaaataccaacataaaaataacaataacacaaaacaccaatcacaaaaataacaacaataaaatgacaaacaaacatacaccaccat

SEQ ID NO: 542211 - DNA, 298 bp, Homo sapiens
ttggacacatagatggtgttgccaaaggtttggaacacttttttttcaaggattaaatttaaaacccgggttaaacatcattgttcggggtttgcttaatttggagctattccggaattgcggagaaatccattttcccagaaatcaggttgttatttttttttactttttcacttagacaactgtgtttcatttgctgtaaccagtttttaaaagtcggttggaaggagcaattgaagtcctggaaaatggaaatttaattttaaactttcccattaaagttggggggggaagggga

SEQ ID NO: 542212 - DNA, 266 bp, Homo sapiens
  misc_feature (3)..(3): n is a, c, g, or t
  misc_feature (9)..(10): n is a, c, g, or t
  misc_feature (15)..(15): n is a, c, g, or t
  misc_feature (22)..(22): n is a, c, g, or t
  misc_feature (24)..(24): n is a, c, g, or t
  misc_feature (47)..(47): n is a, c, g, or t
  misc_feature (56)..(56): n is a, c, g, or t
  misc_feature (59)..(59): n is a, c, g, or t
  misc_feature (67)..(67): n is a, c, g, or t
  misc_feature (73)..(73): n is a, c, g, or t
  misc_feature (75)..(75): n is a, c, g, or t
  misc_feature (81)..(81): n is a, c, g, or t
  misc_feature (88)..(88): n is a, c, g, or t
  misc_feature (93)..(93): n is a, c, g, or t
  misc_feature (105)..(105): n is a, c, g, or t
  misc_feature (115)..(115): n is a, c, g, or t
  misc_feature (123)..(123): n is a, c, g, or t
  misc_feature (152)..(153): n is a, c, g, or t
  misc_feature (224)..(224): n is a, c, g, or t
  misc_feature (236)..(237): n is a, c, g, or t
  misc_feature (250)..(250): n is a, c, g, or t
  misc_feature (253)..(253): n is a, c, g, or t
  misc_feature (262)..(262): n is a, c, g, or t
ganaggcanntaggncgtctgncngtttgaggcaggtccgttaaggntttgttttnaantttttttnccaacnancctgtncaatatnccgtntagaatatttgncttaaaattncaaggccncaaaaacaatgtttgggggaaaaaaaagnnaaaatcatgccagctaatcatgtcaagttccactgcctgtcagattgttgatatataccttctgtaaatanctttttttgagnnggaaataaaatcngcnggaactganccct

SEQ ID NO: 542213 - DNA, 662 bp, Homo sapiens
ggacgactagagtcgttgggccctggtgcgaccctgcaggagcgtagagatgctgcgggactagggtgcagagctcctgggactgtggatcgtgagccggctgcgatgggctggagagcagtgaggagtgagctggttctgactggcatgttgctggccatggctcagcagcacgagggctggcgtgcaggagcttgtgaacaccttcttcagcttccttcgacgcaaaacagactttttcattggatgtgagaagaagggatggcagagaagcttatcacacagactttcatgccaccacaatcatgctggcacatgaagaccctggcagggagaaagagaagccctggcatggaggcctgagctggcgggagaaggctggagctgggctggccagacttggccaaaggaatgccaagtcagagacctcagggccccagatcaaggagctaacttgatgaagagtgcagaggagtgctgcagactacaagatatgaccagaaaaaggatgcagagaatcatgaggcccagctcaagaacggtagccttgactccccagtggaaagcaggatacatgacagaagatgaggaggaagatgagaaggacaaaggacaactgaagcccaacctagtgcaggggacagacctgccaattaccgctg

SEQ ID NO: 542214 - DNA, 472 bp, Homo sapiens
gcacggagtgacaattccacgtgcgtccttacgggggtttgcaaggcgtccgaagttattgagttccagcttaacaaggagtccagaagactcgccaagtataaatagtattgggctgtcctcttccaacacatacttcggaagaacactaattgttccgtgtcactacgacagggattccggcccataaaactttccataactgtgacagaaaagtcttggggagcatgttgtgccagacaggagtcgcgagttcgcggctccgttggttgggccacaagcgcttggagattgttgcattgggggcgtttggacctttggggttcaacttggaaaagcccttcgggccttcccccaggtcccaagggttgggttcctccgggccttcaggggtttcccggagtctaggcttggagatttaaccggatttcctcccttctgggtgcatcctgtgggggcctttttgcgcttg

SEQ ID NO: 542215 - DNA, 275 bp, Homo sapiens
cagctcggaggcgatatgaaggcccaaggtctccagactcttatactcctagcacacagaaatccactgatctcctctgtagcatcttcaggtaccatcttgacaacttcctctaaatccccgggggaagagttgtctagagactcctggatgccctgagggagcggctcccgagcttgccttccctcctctgtggacaccacggtccagcggttggcactgttctctgacaatccttcttggcactgttgatcggactggtaggcttgacgagt

SEQ ID NO: 542216 - DNA, 181 bp, Homo sapiens
ccgcactacagagtgtctttcaagaggcgagggtctgtacccagggagccgaaggacggagccttcgcgtgctcgtccgtagcacccttccacttctcgaagggattcctactgggtaggttcggccaggtggagtgtccggaaggaccctatgttccgaccgtactgagtgtagcacgcc

SEQ ID NO: 542217 - DNA, 427 bp, Homo sapiens
  misc_feature (363)..(363): n is a, c, g, or t
  misc_feature (377)..(377): n is a, c, g, or t
  misc_feature (383)..(383): n is a, c, g, or t
cggcaaaaagtggcctcggcgcaggcggaacatcatctggtggccgatatcgcctgggcggttattcaatactggcagaccacgggggatgaaagtttcattgcgcatgaaggcatggcgctacttctggagacggcaaagttctggattagccgcgcggtgagagttaacgatcgtctggaaattcatgatgttattgggccagacgaatataccgaacatgtcaataataatgcatacaccagctatatggcccgctacaacgttcaacaggcgctgaatattgcccgccagttcggctgtagcgacgatgcgtttatccatcgcgccgaaatgttcctcaaagagctatggatgccaganattcagccgacggngttttncgcagatgattcgtttatggctaagcggcgattaatctggcgaa

SEQ ID NO: 542218 - DNA, 118 bp, Homo sapiens
  misc_feature (71)..(72): n is a, c, g, or t
  misc_feature (85)..(85): n is a, c, g, or t
  misc_feature (118)..(118): n is a, c, g, or t
gcatttgttttcctggggagtcctggcggtttttattaaggcttttcatgttgaaagcccaagaaggatgnnaggtattgttctnttttgacaaccaaattgtaaagtttgccccggn

SEQ ID NO: 542219 - DNA, 177 bp, Homo sapiens
ctgctactgagctgcatagcaatcgttgagaaattctccagagagtcggacaagacagagtcagagagagaagcacatgaaacaagcctgtagtggtggctagaagccatggactgggttgggaacaattctagagctcccagaaggcaggccaagattgagtcacactttccacaa

SEQ ID NO: 542220 - DNA, 213 bp, Homo sapiens
agcacctgtttatagatagtagggagcaagaatcgaaggatagtggacagatgcagatggaaagcgtacaagtacaacagttatcttacagttccgctctcaagattgctggtggagggtggcaccaaaacctcttaacaagtggcagataatagctaaatcttaacagacaaagaagaaatattttccttggaataggctgctggtagttgg

SEQ ID NO: 542221 - DNA, 191 bp, Homo sapiens
gcgcgtggggatcgctcgaacgataaagagcatccggagctgttctccggcctggtatggtcgggcgagcaggcattgccgctggcttgattgacggcttgggcagcgccagctcggtggcgcgggatatagtgggtgagaaggagttggatggattttacggtcgaggaatcgccgtttgatcgcttctc

SEQ ID NO: 542222 - DNA, 528 bp, Homo sapiens
aactcgagtgtaagtctgtattgcacaaggaaaatatatgggaaaaacactcagctattactgatagctattactttgaaacaaatattagatcattcttatattaaaaacatgaaactgaatccaagccagacagtactgaggttgttacacaggcctcttatgtattcacggtcgtatatctaagagtgaatgagagaccactgccagacatgccaatgacacttcacattcaagggctggaagctggaaagcttcccgactgagtcactgtataagccttctgggaaaaagaaccaaagtgacatcaaatatgccatcttcatgcttgtagtctgtcatcagtttttttcaactttggggtctactggttagctgggtaggaggcttctttctaccctacagaaagactcacactcccaattcacaatgaacactgaatgcagagcaattggtgtgaacacaattctacgctgagtaactgttcttacagctgtttttccttaaatttccttatgataccgcgaa

SEQ ID NO: 542223 - DNA, 701 bp, Homo sapiens
  misc_feature (622)..(622): n is a, c, g, or t
  misc_feature (630)..(630): n is a, c, g, or t
cttgagcgtaagctaaataatttgcatacactagcatctgtatgtaatatggaaaaatatggaaatggttggggtgataagcaagtcttgcatattcttttctcctcaattttttttctccaaagtgggccaagccaagagtggcacagctgtgtggagatactgagctccaccttgtcagggaagatcccaactcaggagaaaacacctctaacaaaatctgtagccacgttggcacatctgcccttgaattcactttgtctcttttgctgcttccataaaaaggctttcccttgacaatgttaggcactttttagcaactaggcctgggtggtctgctacaatgcccaacacttaatacagtatcactattactgttagtagtatgctaagcgaatactattgttataaaaaaattcctaagcatgaaaattacggtatacaatttattgtgaaggcaacttcttgtgaacattaaatggtttatctccttcacctcatattaaagtccatactcttgggatatatctgacatctcaatattaaatgactaagatgactaagtcgtttatgttgctcccacctcacacaaagttaaactatttgttactttaaatagttngacaatgntattttaaaatctggacaatcacaaatataaaatacttatttaattttcttctgtaaaaatactatgctga

SEQ ID NO: 542224 - DNA, 360 bp, Homo sapiens
  misc_feature (40)..(40): n is a, c, g, or t
  misc_feature (75)..(75): n is a, c, g, or t
  misc_feature (82)..(82): n is a, c, g, or t
  misc_feature (89)..(92): n is a, c, g, or t
  misc_feature (100)..(100): n is a, c, g, or t
  misc_feature (108)..(109): n is a, c, g, or t
  misc_feature (113)..(114): n is a, c, g, or t
  misc_feature (124)..(124): n is a, c, g, or t
  misc_feature (127)..(128): n is a, c, g, or t
  misc_feature (140)..(141): n is a, c, g, or t
  misc_feature (153)..(153): n is a, c, g, or t
  misc_feature (157)..(157): n is a, c, g, or t
  misc_feature (169)..(172): n is a, c, g, or t
  misc_feature (176)..(176): n is a, c, g, or t
  misc_feature (179)..(180): n is a, c, g, or t
  misc_feature (184)..(184): n is a, c, g, or t
  misc_feature (189)..(189): n is a, c, g, or t
  misc_feature (194)..(194): n is a, c, g, or t
  misc_feature (198)..(198): n is a, c, g, or t
  misc_feature (225)..(225): n is a, c, g, or t
  misc_feature (232)..(232): n is a, c, g, or t
  misc_feature (251)..(252): n is a, c, g, or t
  misc_feature (254)..(254): n is a, c, g, or t
  misc_feature (257)..(257): n is a, c, g, or t
  misc_feature (280)..(280): n is a, c, g, or t
  misc_feature (282)..(282): n is a, c, g, or t
  misc_feature (287)..(288): n is a, c, g, or t
  misc_feature (292)..(292): n is a, c, g, or t
  misc_feature (295)..(296): n is a, c, g, or t
  misc_feature (305)..(305): n is a, c, g, or t
  misc_feature (311)..(311): n is a, c, g, or t
  misc_feature (315)..(315): n is a, c, g, or t
  misc_feature (317)..(319): n is a, c, g, or t
aacaaagattcaatatcagttttgtacaaaaacatggtgngaaaaaataaaaacaaaaaaaaaaaaaaaaaccgnactaacnacccgcnnnnccccctantttgccannaaannaggagaagancannaaaataaaaatnnggggaaaaaaanaaanatgaaaaaaaannnngggngtnnttcntgggnctccntttntccctatccccaatctagaaatttggngggggtngcggttcatggccatggcnngnggnggggggggggggggggggggggnanggggnntggngannggtgggggngggggngggntnnnggggggggggggggggggtggggggggggaaagatgttggg

SEQ ID NO: 542225 - DNA, 331 bp, Homo sapiens
  misc_feature (278)..(278): n is a, c, g, or t
  misc_feature (296)..(296): n is a, c, g, or t
aggcaggagaattgcttgaacccaggaggtggaggttacagtgagccgagatcatgccattgcactccagcctgggcgacagagcaagactctgtcttcaaaacaaaacagaaggggcagggtgtggccacaagcccagattcctgggtcaagtcaggccccagaagtgtagcatttcagggtgtatggggaaaggtgacagagcccaccaccagccctttaacttgctgggctgaccctaccccttgggccagtgtattggtttgatggaacagagntcccatttattccctttngttcagttgaacaaccttttacaacaggatttttg

SEQ ID NO: 542226 - DNA, 150 bp, Homo sapiens
cacagacacagcaccgtggaggacaaggatctgtggccttcacctgtgatcctgaggttcagaacacaacctacctgtggtgggttaatgtcatagccttcccggtctgtcccagtctgaaaccaataaaccttctgttcaatgacaaca

SEQ ID NO: 542227 - DNA, 235 bp, Homo sapiens
gcgggatggcgaggaccaaactcaggacactgagcttgtagagaccagaccagcaggagatagaaccttccagaagttggcagctgttggtggtgcctcttggaggaggagcaggagttacacaatgccatgtccaagcatggacggctttccgaggcccttcaaccctagagatgggagccctatctcccaagtccaccatccctatcggtggcatattttcctggcctgtctt

SEQ ID NO: 542228 - DNA, 955 bp, Homo sapiens
gggcgtgcgactatgatcgttgtgttggttgacgactctgttgttattaggtgttgctgcttctgcgtcgcggtgctctggttattgttgttcctcggttgtttgtgttcccttagttgctcgctcggtttggtatgggttgttctgctcccattgtcgtcttgtggtttatgtgttggtgcctcgatgtcgctgtatgtgctttgtgcgccgttgagttgtgtccttgtctccccctgctgtgtggcagttttgtgcttctttggtgttccatcatctccctcggttgttctgtctctttaccttcttgcttgtgcttctctctaatctggtgtctctttttgttgtctcccagcctgtgtcctttgttgttagcttgctccgccgtttggtcagtgtggtgtctctagttatgtgttccgggatcggagtgttgtaatttgattccactctcttttgtgtgtgttacccatatcggtgttttgtcggctgtcgtctgtctgttctttctgtgtccatgatcttcctctgtgttgcgtattttcttggcctcttttgtgtcgccagctgagtttgtctctctgttgtgtttctcatatttggtgccgcctctggtggcctggcaaatagcgtctgtactgagtttgcgttttctctgttggattggcgttcgtgctgttgcgtgtggcccagtcttggtggcgtttctccctgcttttcttgcgattcgatttgtagtaccctcgttgttcgttctcttcgtgacgtggtcgtggtaagcgccccccctttgtgtgtcgccccgcgagatgtgatcctgcgcgctatcttccttccgcatggcagaagtgtttgttgtgagcggtctcgttgtccaccggcggggtaaacagattgggtcgtgccgacccatttttttctgagggcaattatgcttttttaatcccccaaaaac

SEQ ID NO: 542229 - DNA, 844 bp, Homo sapiens
  misc_feature (844)..(844): n is a, c, g, or t
tgatcaatctacaatctaatgctacatgcttgttctgtgtatttggtatctcccacaaacctcctgtgtgctaccagtagctgccagaaggctatgttccagtgtgggttattgcagcagctttgtactatcctaatggctacttggggttccctgcttgatatcctgactgagagcataaatacctgtatcagaagtactcgaggctggcaagtaaaccaagactaccttgtgcatctgtaaatgcaccttcaaacccagcaagaacggacaatggtaagatacttctcatgtccatggttaattgaaaggcagaccatataggaaaatgcagctgatgctgtacatctacttgtattccaagttgtaactatgtataaaaaaagcaaaattggacaaatggcagaaaatcgctgtcaaacaaactatgtaaccccttctaaccatttgatgcaaacaggtcaattcaggattcaggctggctccagttcactacatgtgcgaggaaaggaaagtacatacatggattcaactaattacaaaaccttggagttgcttggatagatggccccatattggccccaaatgacaggtagcaacaagaccaaaattggccgaccccaatgaaaactggacacaatgtgtggatacctaaggatcaacaatttgagatccacaaagtaattggggcaaagaaccattccaagagaataacattaaaacaagcagaaaccacgtaggcaccaaaaactaattccttatcaaccaatgggcaaatgcaaaaaaatacacaaaacgcaaagaacgtttggacattaataccccatgggacgcaaagcggacn

SEQ ID NO: 542230 - DNA, 421 bp, Homo sapiens
ttgagctttgtacaaggagataagaatggatcaatttgcattattctgcatgatacctttcagtttacccagcaccttttcttgaaaatgctgtccttttttcccccactggatggttttagctcctttgtcaaagatcaagtgaccataggtgtgtgggttcatttctgggacttcaattctatttcattgatctacctttctgtcgctgtaccagtaccatgcagttggtttttgtttgtttgtttgtttttgttttgttttgttttttcacaattgcagatttcacaatctgcaagattttactgaaaggaccctgatatagctgtctcttgtgagactatgctggggcctagcaaacacagaagtggatgttcacagttagctattggatggatcacagggctcctaatgtcgacgc

SEQ ID NO: 542231 - DNA, 856 bp, Homo sapiens
gggaggctgaggcgggcagatcacctgacgtcaggagttcaaaaccagcctgaccaacatggtgaaacaacgtctctactaaaaatacaaaattagcttggcgtggtggcacatgcctgtaatcccacctactagggaggctgaggcaaaataattgcttgaacctgggaggcggaggttgcagtgagccgagatcatgccactgcactccagcctgggcaacaagagggaaactccttctcaaaaaaaaaaaaaaaaaaacttcgaaattagttctctctcttcttttcgcgcggacggcttgggcgtgctgcttgggcggccgcggggcaagcgggagggccgccggcacttccggtccccgccgttccccgtccccgttgttccttagccccttgccaggtccccggcggagcggggcttggcgccacccgggggcctggccgggaccgtgtgggccgtgaggatgaggacggctgggaacacgcgaggggaccgagggcccgggaagcccctggtggagaagaagcgggcgcgcggatcaacgagagcctgaaggagcttgggatgctgctggcgggcccccgaggtgcaggccccaagctggaaaacgccgaaagtgcctggacctagaacggggcgagagggccccagggtgttggctgcgagggcaggggcgcgcaaaacgcaaacagttgcaggcgaaaacgaaggggaacgcatcgatgccgggtaacacccagtgcatgtcccgagggggcccacgttctgtgtccccgtgccaggccacagaggcaaccgagtgcgaagttcctgaaccattggtccaaatcaggccgtggtgagaggagccatc

SEQ ID NO: 542232 - DNA, 256 bp, Homo sapiens
gtaaatcttttttgctttttgattttttttttcggggggaaatccgcccacattaagggggggggagagagggatctatcctaaggcctttttacggttaaaaaaagtttcctagccatgaggccttgctcctgatttagacagggtttttgggtatttatttggaccccttatctttccaggccttttgggaccttaggcggtttttcctgaccccccaccccttaagggggttatcctacggtctttggttaaa

SEQ ID NO: 542233 - DNA, 989 bp, Homo sapiens
tagaggagcatacaaggactctacatcgctgctcagtacagcggggctcaggtacagcgtgctctccgaaccaacccacttccatttggggcaaaccaaccgcacccctgaatttctccgacaaatttcctgcctggcaaggtcccagcatttgagggtgatgatggattctgtgatgtttgagagcaacgccattgcctactatgtgagcaatgaggagctgcggggaagtactccagaggcatcagcccaggtggtgcagtgggtgagctattgctgattccgatatagtgccccacagccagtacctgggtgatatccccacctatgggcatcatgacaccacaacaaacaggccacatgagaatgcaaaggaggacgtgaggcgaattctgggagctgctggactgcattacttgaagacgaggacttaatctggatgggcgaacgagatgacataggactgacatcacagtatagtctagaaccctgtaagatggactctataagcaggtaactagagacctatacttaatcccgaccaggccatatatacacacaactacacaacacggcgtgagataccatcagcatgacaattaaaacaagagcaccaagtatccatgaggcatggtctcgggagggaaagtgaaaaacatggcgcatgagaaacgactggccaccagagaaggaatagcgtcaacacaaggatcagggcagaagaacccaaacccctacaaaacgcgccaacagaccacaggacacgagtacgacaaggggggattcaacagggagacaaagcacggaaacgaccaaacaaaggcgcccccccaagtggcatatgaacggccgcagacaaggcgacagggcacagaccaacccaagaggctcgggacattggccccaccatggcaatacccaatgaggacacaggacagaggaaagacaaacgtggccatggcaacagagtggagcacaacccagaggga

SEQ ID NO: 542234 - DNA, 896 bp, Homo sapiens
gggtgatcctcttgcactggtggcgctggaagaatgaagtcgctgtgcagctgaagcaggatcacgctgtgctcatgagtttcctctggcggaatgtaaaggctccacagaaggagattgtggagttcacagatgagtgctgctgcgtgacgggtctgaggatggacgccgcaagacgcgctgtggacgctggccgatgcgtggccactcgacgggacaggcctgcgctgtagcggctagcctggtgatggggaaataggaacgtgtttgtagacggcagggcctcagaagtgaagacccctggggcagtcctcgtgggccccagcactctgtcgcgagaagaccctctggtggagtgctgagccaggtggagcccagtgatggcagtgagctggtttcggcatgccgaggctgtgagcgtcgcagacgtctagcggaaatccgcccatacccacgaggggtcagtcgggagattaggagcatagctcgccgggcatttgaacatgggggcaagtgggagtgacaaagctactcgtttgactgggaaggccgcgggccgctcaggtgaaggtcctatacggcgatccgtagggggcgaaaggagggaggggcatttcagtagaactttcctatatgttctagcagaacgacagataaaattcgagctcaaattttttgccaaagtgggaactccaggtggaaatggggcccaacgtgaggttgcttggttgaacaaatagactagagtgtgtgcttctggggatcattgctttgtgggttggcgaaattgggagaatgccattgatgtggcgaatgtggccgaatggaaagggagcacggggttgtggttgacgcgggttagctttgacagggaagggggattctggccataggag

SEQ ID NO: 542235 - DNA, 157 bp, Homo sapiens
tggtccccgggtccatagatcggcacttgactttgaaccgggcaccaaagggcacaatatctgatacccgggtacaagagtctataagagagtgcggccacagtagagtgggcaaaacgtgagccactcagccgtggggcatcctcataaagctcga

SEQ ID NO: 542236 - DNA, 181 bp, Homo sapiens
tgcctaatgtacttggccctgttatgccagtatctagccagcagaatggcattgtgccatcgatggagcctgagatcctccctgatggggaccatgactatgaagctgctgccagtaatgtgacactgagaagtgtgctatggcttgctgtctacaagtgctacttgagtgaacaccacat

SEQ ID NO: 542237 - DNA, 105 bp, Homo sapiens
tgcgtccgatggagttgacgccgcaaggtccaagtagtctactcctctataaccatcatctatactccaggtactaatgcagatgtcctgcaaacaccggcctat

SEQ ID NO: 542238 - DNA, 305 bp, Homo sapiens
tcccaacacgcacaattagcacatagtagatgtaccttttttaaaattttttattttttttgacaggatctcactttgtctcccaggctggagcgcagtggcacaatcatggctcagtccaacctcaacttcttgggttcaagcaatccttacatctcagcctcctgagtagctgggaccatatgtgcgcaccaccatgcctagctaattaaaaaaaaatttttgtagggatagggtctcctatgttgcccaggctggtctcaaatgcctaggctcaagtgatccttgcaccttggcttcccaaa

SEQ ID NO: 542239 - DNA, 612 bp, Homo sapiens
  misc_feature (491)..(491): n is a, c, g, or t
  misc_feature (507)..(507): n is a, c, g, or t
  misc_feature (598)..(598): n is a, c, g, or t
gcttgcgttcccgctgtgtgtgcgcctaatctcaggtggtccagccgagacccttgagcaccaatcctaatcacccggcggtcccttatgcgctccggagcaagatgaagagaaacaatcatgaaccaggaaacactcgcctgactgcaggcacaagtgcgcattggtgggaaaggaactgctcgcagcaaacgagcaccggtggttcatagaacagccgatcgagcagatgacagaaagagattcttcacgtgtctccttaacgtatgttcagtgggtacaacaatatctctggctacttgacagaggtgaagtatgttgtacataaccacatgagttacagcagatgatccagtttaacgaccctaaagcttcaggcatctctggcgagcgaacactttcgccattactggccatgctgagacaaagcagctgacagatatgctacccagtatcttaaaccagcttggtgcggatagtctgactagttnaaggagactggccgangctctgcccaaacaatctgtggatggaaaagcaccacttgctactggagaggatgatgatgatgaagttccagatcttgtggagaattttnatgaggcttccaag

SEQ ID NO: 542240 - DNA, 321 bp, Homo sapiens
  misc_feature (156)..(156): n is a, c, g, or t
  misc_feature (186)..(186): n is a, c, g, or t
  misc_feature (206)..(206): n is a, c, g, or t
  misc_feature (249)..(249): n is a, c, g, or t
atgagacagcatcttgctctgtcgcctaggctggagtgtagtgctcacgacagccttcctccagggcttaagtgatcctcttccctaagcttcctgagtagctgggaccacagccgtgcaccaccatgccctgctaattttttgtagatacgaganttttgatatgttacccaggctgggtctcgnaactcctgagctcaagcaantcctccctcctcagccctcccaaatgtgctggagattacaggntgtgagaccaccgcaccttggcgccttctgtcgtcattctcagacagcccgccatagtagtagtagtaggcg

SEQ ID NO: 542241 - DNA, 582 bp, Homo sapiens
  misc_feature (15)..(15): n is a, c, g, or t
  misc_feature (67)..(67): n is a, c, g, or t
  misc_feature (70)..(70): n is a, c, g, or t
  misc_feature (75)..(75): n is a, c, g, or t
  misc_feature (127)..(127): n is a, c, g, or t
  misc_feature (183)..(183): n is a, c, g, or t
  misc_feature (189)..(189): n is a, c, g, or t
  misc_feature (199)..(199): n is a, c, g, or t
  misc_feature (221)..(221): n is a, c, g, or t
  misc_feature (237)..(237): n is a, c, g, or t
  misc_feature (255)..(255): n is a, c, g, or t
  misc_feature (259)..(259): n is a, c, g, or t
  misc_feature (311)..(311): n is a, c, g, or t
  misc_feature (337)..(337): n is a, c, g, or t
  misc_feature (362)..(362): n is a, c, g, or t
  misc_feature (366)..(366): n is a, c, g, or t
  misc_feature (394)..(394): n is a, c, g, or t
  misc_feature (418)..(418): n is a, c, g, or t
  misc_feature (424)..(424): n is a, c, g, or t
  misc_feature (434)..(434): n is a, c, g, or t
  misc_feature (443)..(443): n is a, c, g, or t
  misc_feature (521)..(521): n is a, c, g, or t
  misc_feature (582)..(582): n is a, c, g, or t
gggtgattaactgcntgtacaattacgtctcacttttaattaattgtgcttaaggctttaattaaanaanggggntcccttcttagagcagctcgtactgacgaaggtgcatgcgctgaatgatggnacggcagtggttgaacacacggcggatgtactcagtgtccacagcgcaggggaaangagggnagcagtagtnacgcccatctccactggcagtnctgaccctcagaaacncatctcgaatgaagtacntggnccgggtcacgcgtgggtcctctccgggcgcgggagttgcatcctcaggagtngtgtagcgagcaaattctggaaagtngttctcaatcttcgatttcccagcnaggnctttctcagcgagcagatcttgcttgtngaggaacaggatcacagagatggngcgcancaatctagtngttccagangctcttgaagaggttcagagcctcctgcaggcggttggtctggttgtcctcccggatgaccatgttgtagctgctgcnggccaccacgaagatgatggcagttacatcgttgaagcactggatccacttgcggcgttcn

SEQ ID NO: 542242 - DNA, 296 bp, Homo sapiens
cggcatggggtctgtactaaagctgcctttcctggcactcagaagcgcccttccaggcctaactgcagaaggtgggcctcagcctcctcctcatgctgcttgacttcctcctcacggatctgcaccagcaactgaaagagggctggggctgctccttccccagccccggtaagccacagctgccttcggatggccccgctgcagatgcccacggcaatgacctgctctaggcgcgcatgattcacattatcattatcaatggctccattctctaccaccttctgtagcagaggctc

SEQ ID NO: 542243 - DNA, 126 bp, Homo sapiens
aaaaaaaaaaaaaagtttttttttgacaatcgttggtcggtaaggaagggcattggtctcaccgctcaggtcatattctctactctattgatcatgtggccacgccagtatttgatttggaagcag

SEQ ID NO: 542244 - DNA, 307 bp, Homo sapiens
  misc_feature (32)..(32): n is a, c, g, or t
  misc_feature (140)..(140): n is a, c, g, or t
  misc_feature (159)..(159): n is a, c, g, or t
  misc_feature (171)..(171): n is a, c, g, or t
  misc_feature (197)..(198): n is a, c, g, or t
ttccccccctgcaaacttcagccccttctggncgcatccccacccaatcaccaggtgccctggatcccgccctcttcccccaacaccttccatctccactgcccacagcccacgtggccccccggagcatcgcagggggngcccctcagaaagccatgnagccatggatgncagagatgagactggacgccactggnntggagcagggggcagtcagggttgtggggacacagatgagggctgggagggggggaacgcaagagggcggggggtttcttcacgatcgcactggaagattttataagag

SEQ ID NO: 542245 - DNA, 437 bp, Homo sapiens
  misc_feature (264)..(264): n is a, c, g, or t
  misc_feature (267)..(267): n is a, c, g, or t
agtcctttggccaggccaagcaccagccaacagccatcattgccaagaccttcaagggccgagcgatcacgggggtagaagataaggagtcttggcatgggatagcccctccccttatacatggctgagcagatctatccaggagatctacagccagatccagagcataaagaagatcctgagcaacccctccacaggaggacgcaccctcagtggacattgccaacatccgcatgcccagcctgcccagctacaaagttgggnacnagatagccacccgctaggcctacgggcaggcactggccatagtctggccatgccagtgaccgctatcatcgtcctggatgggcacaccttttattcctaccttctcggagatcttctaaaaggagtacccggaccgcttcatagactgctgcattgttgaagcagtatct

SEQ ID NO: 542246 - DNA, 489 bp, Homo sapiens
tttaaccgagactgagtctaaaacgagcctggatgatagcgaagcccgaatatatgacggtggccagaaataatccggctcgccgaatatataaactagacgcgtggagatatacgtctggcgtcttgcataacgggtcctcagttccagaaaaaccgagtcgctgagtaaatctagaatgacatcgcttcagatatagaacaagatcagctacttctatgctacacgggtagaacaatgggcgtatcaaaatatgggatgtctctacaggaaaactcctccttaactaggtagatcatactgaagtggtcagagatttaacaaatgctccagatggaaagcttgatcctggtgtcagcttcaagagacaaaactctcagagtatgggacctgaaagatgatggaaacatgatgaaagtattgagggggcatcagaattgggtgtacagctgtgcattctctcctgactcttctatgctgtgtacagtc

SEQ ID NO: 542247 - DNA, 388 bp, Homo sapiens
  misc_feature (385)..(385): n is a, c, g, or t
ttcataggcaaatagtggtgcttttgaacatccttaacgtatatctttgtgtacttgtgcaggtatttctggcagtatagaaacagtaagtggacttgctggtcaaatggtagctacatttaaaaaacagtgatggctactgcttaattgtatatcaaaagagatttataccagtaactttcatacatttctgtttccttattctctcacttaaattcaacaacatcattcctcttaacatttttgccaatggtgaaaagtatttcgtatacaaatttacatattcttactcatgtggttaagtttcttacatgtatttgttgaacttcctgtgaattgcttattcatatctttttcgcactttttcctaatgagttttgtattnttc

SEQ ID NO: 542248 - DNA, 251 bp, Homo sapiens
agcgaaggtgatgccttttatcaactgccactgggttatacactattatgagctgataacactgcagaccctactaacgctttagacaattgtatttgtgccgagctaacgatccaagacgctgtgatgccacttgtcaagagcgctcattctaactctgtcttcgcaatgatctccacatgcttccagaccagcgtgtggctatcgaatgtgaaggggacagctagattgttgttgacaggtgcctgtgc

SEQ ID NO: 542249 - DNA, 250 bp, Homo sapiens
  misc_feature (134)..(134): n is a, c, g, or t
  misc_feature (196)..(196): n is a, c, g, or t
  misc_feature (206)..(206): n is a, c, g, or t
  misc_feature (217)..(217): n is a, c, g, or t
caatttggtgtctcattcaacagcatttcaaatgagtttgttttttctagaccaaaagcagtgggaaaacagaagtaaaactagccaagcatgcttttattccttaatatttctaggcatgatgcaagtgtttnactgacgttattcaattgtttttcataacaatcccacatgataagaaaaccaagattcaaanagttacgtancctaggctttncacaggttgagagggtacctgaagaccaccttt

SEQ ID NO: 542250 - DNA, 300 bp, Homo sapiens
  misc_feature (12)..(12): n is a, c, g, or t
  misc_feature (53)..(53): n is a, c, g, or t
  misc_feature (69)..(69): n is a, c, g, or t
  misc_feature (94)..(94): n is a, c, g, or t
  misc_feature (245)..(246): n is a, c, g, or t
atttgagatgcnacaaaacccagtaaaagattcaaaagaaatgtttcaaaccnacaaacagatggaccnggagaagagaagcagaagccttggnagcagccctgtaaaataatcacaagatgtggttttgaaattgccactgggaaatttctttccaaaaagaacaaaatatttcgctgaaactaatgagaaaggccatgataaagatttctcagagtttggttcccactttcattggatttcanngaaagggcttaattaaaagggcttgagaactttgggtaaaaaaaaaccccccaa

SEQ ID NO: 542251 - DNA, 100 bp, Homo sapiens
aatgtccacactcctctgtgctgtccatctgtccacctcctctgtgctgtccacctcctctgtgctgtccatcctcctctgtgctgtgccctctgtcggt

SEQ ID NO: 542252 - DNA, 108 bp, Homo sapiens
tgtagacacattgccaattccaggtgtgcacagaacgatatcaatcaatctttttcttaggagcaagaagaaaatgtggccctaaagggggttagttgaggggtaggg

SEQ ID NO: 542253 - DNA, 629 bp, Homo sapiens
atcactacctaccctgacaggtataacagacaagaaatggtggcatcgtgtgtggcaatcataccgtcaccgatcgatgtgatcatcattgggcatccgatggctattatgccatggtgggtcgagtgcacgggggactcactgtggtgtgattcagagagccatggtgaaggcctgcccacacgtctggtttgagcgctcggaagtgaaggatcgccacctggtggctacgagactgactgaagcatgtgcaagatacgagcaagcggtctatcctcatcttcccagaaggaacctgcatcaataatacatcggtgatgatgtgcaaatagggaagttgcgcaatcggagccacagtttaccctgatgctatcaagtatgaccctcaattgggcgatgccgtctggaacagcagcaaatacgggatggtgacgtacctgctgcgaatgatgaccaggctgggccattgtctgcagcgtgtggtacctgcctcccatgactagagaggcagatgaagatgctgtccagtttgcgaatagggtgaaatctgccattgccaggcagggaggacttgtggacctgctgtgggatggggggcctgaagaggtaggtatgatgaaggacggggt

SEQ ID NO: 542254 - DNA, 460 bp, Homo sapiens
  misc_feature (1)..(1): n is a, c, g, or t
  misc_feature (53)..(53): n is a, c, g, or t
  misc_feature (454)..(454): n is a, c, g, or t
natcttgattaggcaatgatttcctcaaatatgacaccccaaaactcacacanacctacatatatatatatacacacacacatacacacataaattgggcttccatcaaaaattgaaaaacttcccgtgcatcgaaaagacattatttagggccggacaccaagttcgcacgcctgtaatccccagcactttgggaggctgggactggcggatcacttgaggacagcagttcaagcccagcctgataaacatgcgaagccccgtctctactaaaaatacaaaaatcagctcggtgtggtgcgggcgcctgtggtcccagctatttgggagctgagccagaacaatcgcttgaacccgggaggtggaggctgcagtgagccgagatggtgccactgcattgcagcctgggcgacaagagcgaaactccgtctcaaaaacaaacaaaaaaactccntttcaa

SEQ ID NO: 542255 - DNA, 104 bp, Homo sapiens
cgtgagagctcagccttggatgatgttgtggctggtggtcaaccgtccgccgcagggggtgggcctaaagatagagtcgcccgtacggggtgggttgagagcgg

SEQ ID NO: 542256 - DNA, 193 bp, Homo sapiens
tgtcgcgtcaagacaacaacctggcagctggttgcaggagatcctgcggcgactggcgcttttggggacagaacaacgggccatgtgcaagtaagctaggtcatggtggtcaaccgaagtttcgaagaaacgctgcagtgtgaacgatgtgtggcaggagctttggagacagaacaacgggccgcgcaaagag

SEQ ID NO: 542257 - DNA, 199 bp, Homo sapiens
gtaagtggccttctaataaccaacaactcccagcaatgatgaaagtcaccatcatatgtcaagcaatttggtaaatctaaaaacatttccccaagaactgctacccctccaacacaccacacacacacacacacacagttttttcctcccctgtgatgaaacaggctgtgaaacacttaaagtatttgcttgcctctgg

SEQ ID NO: 542258 - DNA, 327 bp, Homo sapiens
  misc_feature (75)..(76): n is a, c, g, or t
  misc_feature (184)..(184): n is a, c, g, or t
gagacagagtctcgctctggagtgcagtggcgtgattccagctcactgcaacctccgcctcctgggttcatgtanntctcatgcctcagcctcccaagtacctgggattacaggcacatgtcaccgtgcttagctaatttcttgtatttttattagagacaggggtttcaccatattggcctgnctggtcttgaactcctggcctcaagtgatccacccatcttggcttaccaaagtgctgggattacaggtgtgagccacatgtccagccagaaaatatttttttaagtggagaaccattaagattagatatagcctagaaaaatc

SEQ ID NO: 542259 - DNA, 175 bp, Homo sapiens
ctaattggttcttcgatgacgcctctaccacctctcgccagaaccccatctacttcgcctcctcgcacccaacattattcttactatttgcaggctccttctctggattaggctgcaagtcccatgacagcagggatgtcccccctcccaccaacgtcatcgaagaaccaattag

SEQ ID NO: 542260 - DNA, 106 bp, Homo sapiens
tacattataggctcctacacgtgaggcccctacacataggtgtatctcgtgtgaatgagggttttatgttgttaatgtggatgggtgagggagccatcatggagga

SEQ ID NO: 542261 - DNA, 342 bp, Homo sapiens
ccccgagaagctgatgttcgtttcgatcagcatttcgtagtatgaagcaatataccattttatggctcttgtattgatgaaattgtgcatcattggcgcacggaccgtatggccaccctcttgcattaggtcttgctggaactagccacggttgtctggcccttccgggcgtaaagaagatttggactaatcgtaccgtgacttctgatcatacgatcggagtgccagaagtcacagtgtttctgtaccatgggcgaccaataaccggtagtgcacttgtctttttggaatctctgtagctctgaggcgccttccaggcttctcggggggggtacccgagct

SEQ ID NO: 542262 - DNA, 604 bp, Homo sapiens
  misc_feature (253)..(253): n is a, c, g, or t
gttcagtttctacaccccatttcagccataaagcccattttaaagacgaagaaacatacataggaagatgaatattcatttttaatgtattacacaatcaaaacaaaacgcggacacactcacgcttccaagtcttgaccaagcacacatgctcaagctccagttctaaccatactagtgatgtcactattaccactataaactaccatgtaactggcagactcatgttttactggtgtagacaattgaacantgtgtttgttgccagtggtaatccttgctctagtactgagaggaaccgcaggttccagaacattgtggtgtagacaatggaacgtacaatttctacacaattaaaacaaagcatcgagaaggcccgcggcggggtgtatgacgtgatgtgatttctgcccagtgctctgaaatgtcaaagtgtagaaatggaacgtacaattttctacacgcttcattcacaactcacctctgagcacacctccttcaaggaagccttccccgattagggaagccagggtagggattcctttcctcccccagaataccaggaataaaacaccaccccccatattctggcagtccatataca

SEQ ID NO: 542263 - DNA, 109 bp, Homo sapiens
  misc_feature (15)..(15): n is a, c, g, or t
  misc_feature (104)..(104): n is a, c, g, or t
cgccgcgcgctcagngctccccaaagtggctgagattacacgctgcagcgcggcgcttacgcttttctacttctaaattttgtaagcaagcccatgcatgcatntctat

SEQ ID NO: 542264 - DNA, 123 bp, Homo sapiens
ccgtagctgtactggctgtacctaaatggctgtacctaaatggctgtacctaccatggctgttacctaaatggctgtacctaaaaggctgctggatttggcgctcatgagttgccatataggt

SEQ ID NO: 542265 - DNA, 800 bp, Homo sapiens
gggttgggttcctgtctgccgcactgcgtggccgccgaaagccgctacacaagtagcggcgtgtctgccctagggaggcaaagcgcaaacttgttaccgcgccgggactgccccgggattctcccagcggctccgcaggacgcagcgcctgtgcctcgcgccggccctgtggaactgggcacaggcactgtccgcgccccttgggttgccgccgagggcgtgcttttacccctcctgttctggccgcggggcagcagagagagctcgtgggccggggcaaagcctcaagatggtggaccacggtgggcgagcccagaaccctggctggggagtccctccccgccggataccaaatggggcaaggagaggccactctacaagggtgcaaacttccccggtggggataaatcgttgggggccgcgacggcatctggtccagcccagcgtgtccactgaatggacccgaaggacagcaagtggctccagctggcgggcgggaatctttggaatacttccccgtgggaagaaacattcatccggcttgtattagaggccactcaattgggcagttcgcaaagggcggttttaagtcactggcacacaaattccattatcacagtgggcgtccttaaattcaggaacaaaacaggagttggcgggtcatccgctccttggtaacccccaagtggttgggcaaataccagtggggcgcataaattccttttggggcgatccaatttgggcaaagccctttcggtaaaccttccctatagagggttccaacggcacaatttcttccc

SEQ ID NO: 542266 - DNA, 757 bp, Homo sapiens
  misc_feature (10)..(10): n is a, c, g, or t
ttatggccgnggtaactacaaccttactattttccatcccatacattttgacagacctagttcaatgaatctgaggaggctactgagcagacagtcccagcctaacacgatcctgaacctttcacttaatctaacccttaattatggatcccctagctccctttaacttctaatcttggacggaaccgtctccatacaaccccctaaggaagaaccttcatttccgctaaatcccctttcaaccttatttccacattcaaagccgacccgggttaactttctttcctttccttcctaatggcctttaccctttttctaactgtgctctctagggctccccaagcaattttatccccaaacccaaccccttttacacacgttggccacatataagggccggaagagattttccgaatatgggctacacacaattctttgagaccgggccctataccaacttgggtggcgggctttgtcccatttcactatcctatccaaactacacaaaataccctcaccccccttatccccacacccaagctcacatttgtgccccacatggcgcacctcctttaggccctaatagcggcacacctcctatttaaaaccgggacggcgggctacctgccacttccccctttcccctatttggccacgcggagacccggatttaccttccacaacttcatcaccagtaaccaaattctccccaacgtgaacacaattcctaaatgggcctcatagcccaaaccctccc

SEQ ID NO: 542267 - DNA, 355 bp, Homo sapiens
gatttggtttgttcccactgtccctttataaatatttgtgtgctctcattttaaaaagagaaacaccagaaccatgtttttctgtggttggaccagtgctcactgcccttcccagtagcccagtcacacccatgaacattgcagcccctgccagttgtgctttgcagttcgcctttcctcagggacctccaaagtccccagcctctgaagccattggggagaatgcacagtgaattctgatgcttttgctggtacagacacttcccgtgcggtgctaaccgtcccctgtgtaatagtttatgttctaggatgaccaagtagaagaatactttgaaaaaattgataatgccttctg

SEQ ID NO: 542268 - DNA, 240 bp, Homo sapiens
tttttctccttgtccccatttaaaaaatcggaatagcccttaaaaaagatgctctatcaaaagatgtagtaaaagaataaaattcaatgaatactgctttaaaaatgctagctgaacaacaagtagatgctgttttatctgctggagaatcttctttattgttagctagttcaatgttaatgttaaaaagacttacaggaataaaacgtcctgcatttatgcctatgattcccacaatcg

SEQ ID NO: 542269 - DNA, 442 bp, Homo sapiens
cgctgtcacgactgacggctaggggaacacgatagcctccccatcctgacgtacgacgaaggtaaaagcggtggacgtgagtcatcctcttaggatatctggaggcggaaaagaatcagaactgctgcccaaaatagtgaagctgagccagatgaataagtccatctgatgtatattcggtgtatacaaaatgagcccagttgctcaacagtatggatgaaaaccttgctcatattatactgcgaaggctaagtgtcacccccttactctgactctggctgggccttgctaagggccaaggaaagacagagatataagagggggcagccagtccaaatgccaaaagaagaccagtgcttgcacctgaatagtatgaaataagacattataggacacttataaaaaaaaaggggaccacacaaactgactaggaccacagacc

SEQ ID NO: 542270 - DNA, 372 bp, Homo sapiens
ggagacggtacacctgtcaaagggtttatccttcacccatttatctagcacgtcatccagaggtaaaccaattatacatgtgtttgtattcagtaaaccagctatgacaatttatactaaacaaattgaactagaacccatttgaatcaggtattgaatttgtttatttccatttttcattattaatacaacggcctgactgtgctcaatcgtcaagctgcatgcatggacaacactggccagcccaaacagtgtcttaatcattcagcaaatggaactttaaggagtccttcatcattaaggtagtacaagtatttatcttgtccaactgatgtgtagcttgatctttaggggacaggaccaccagcaata

SEQ ID NO: 542271 - DNA, 421 bp, Homo sapiens
gcgccctggatgaccggagtacagcaccagtgccgggtacaggatgcaggtggtgcgggcagctggagatccagcttcgctcgaagggagagtcgagacggcgtgcaggcacatgatggtccagcttgcattatgtcggctcctcgtgaacccaagtccctttcagaccagtgcagtgagccgatcatctggcagcagacatcaattcccagtgtggtctcagatgcacgccgccacgaacctctgcgcgcgcatcggctcgctgattagctcccttctagctggcctcgccttggtccatggagcttcttgcacgtcccgtgctagtggttgggggcccagggcccgtcaggatggaaggctaggtgacgataggttcgtgcgtgcacctccattcctgcgctctaggaggcatgtggca

SEQ ID NO: 542272 - DNA, 756 bp, Homo sapiens
cgcggggcggggtgttgtgggcggggtgtgtgccgcggagttgcgttcgtgaccgggccgagtggacggaggctatcgagggggcggtggtggcgggagatatagcgcggggtgttgggcggcttgtggtggcgggggtaggggtacggcgcccggggggtggtggagagagggaggtggtcggccgcggttgggacgccggcgtagaagcgtccgcgtcatgcggggtgtctcggttgcccgcgcagtgtctttcagggggcggccgcggtgggccagtgatgttgcctcgctcccccccggtgtgggtgcgcgcgctggccccgataaccgcgctgcagtttctggcgatcaggtgggccgcctgtgtgcggggcccgcccccggcggtggtctactgttgtgatgttccagcgtcctcgaggtgccattgtggctgggggggccagaccgcccgtggtctgtggcgccgtgtgttctttgtcccccgcgcgtgggtccccatctgaagttggtcccccacacgattgacggtccgccaggcctgtgcgccgtcgttgagagataatagccccccaaggagctctctgaggcggctctcacgccccgaggagaaaccgcggggccgccccgcgccctattttgtagtcgcctagatcacgaacggtctagcgcgcccccataacggtgtcctcgccccccgtgctatcttcgcacagcccatgaagaagagagaacttctgtccatcaaaaacc

SEQ ID NO: 542273 - DNA, 112 bp, Homo sapiens
ccaggatctagcgaatcgtggtgctgctcgggaattatggtgctgctgggagaaactggcaaggagaagctcccgcgatactacaagaacatcggtctgggcttcaagacac

SEQ ID NO: 542274 - DNA, 1250 bp, Homo sapiens
  misc_feature (82)..(83): n is a, c, g, or t
  misc_feature (409)..(409): n is a, c, g, or t
  misc_feature (437)..(437): n is a, c, g, or t
  misc_feature (511)..(511): n is a, c, g, or t
  misc_feature (516)..(516): n is a, c, g, or t
  misc_feature (589)..(589): n is a, c, g, or t
  misc_feature (612)..(612): n is a, c, g, or t
  misc_feature (902)..(902): n is a, c, g, or t
  misc_feature (908)..(909): n is a, c, g, or t
gctggagtttgctggatgggccgagccgggtgcgcactggggagtggcggaggcagcggcggcggcggcggcggcggcggcnnggcggacagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcncccccccttccacccagtccctgcaggncccgcctcgtgtatccacagccagcatggcccatggcagtcccactggccgcatcgagggcttcagcaacgtcnaaggnagctgtatggcaagatcgccgaggccttccgacctgccaactgccgaggtgatgttctgcacacctgaacganccacaaagtggacagtggacaangctcctggggggccagatcgggctggaggacttcatcttcgcccacgtgaagggggcagcgcacaggaggtggacggtgttcaacgtcggaggatgcacttcgggcatcaccatcacaggacaccggggctggctacgcccttcatcaagcgcatcaaggagggcagcgtgatcgaccacatccactcatcagcgtgggcgacatgatcgaggccattaacgggcagagctgctgggtgccggcactacgaggtggcccggtgtcaaggagtgcccgaggcgtacttcangctgannctcaaggagctcgaaggcttcgaatgatcaggcagtgtaaagggggtggccgccctgggtctggcccacaaatgggcactggccgggtaccctgggggactccgatccggggcccggcacgggtgggaggatttgcctctgcttttgaagagaagcctttaaaggcggtctacctgcgagaatacctggttcagggacacgactggggcaccaggggactggaagacaaggacctgtatggcgagctgaaaaggggggaattgccacccaaaagcattagaatggggcccaggaccagggggaaagagccaacagagaacgcactgggccccgaaatggcc

SEQ ID NO: 542275 - DNA, 1249 bp, Homo sapiens
  misc_feature (82)..(83): n is a, c, g, or t
  misc_feature (409)..(409): n is a, c, g, or t
  misc_feature (418)..(418): n is a, c, g, or t
  misc_feature (422)..(422): n is a, c, g, or t
  misc_feature (436)..(436): n is a, c, g, or t
  misc_feature (438)..(438): n is a, c, g, or t
  misc_feature (447)..(447): n is a, c, g, or t
  misc_feature (450)..(450): n is a, c, g, or t
  misc_feature (458)..(458): n is a, c, g, or t
  misc_feature (489)..(489): n is a, c, g, or t
  misc_feature (491)..(491): n is a, c, g, or t
  misc_feature (510)..(510): n is a, c, g, or t
  misc_feature (588)..(588): n is a, c, g, or t
  misc_feature (611)..(611): n is a, c, g, or t
  misc_feature (901)..(901): n is a, c, g, or t
  misc_feature (907)..(908): n is a, c, g, or t
gctggagtttgctggatgggccgagccgggtgcgcactggggagtggcggaggcagcggcggcggcggcggcggcggcggcnnggcggacagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcnccccccctngccncgagggcgtggggngnggcggtggngtngcgggcgncggggtggggggtgggagtcgcggtgggggnangggggggttggaggagggngaggggggtgtatggcaagatcgccgaggccttccgacctgccaactgccgaggtgatgttctgcacacctgaacganccacaaagtggacagtggacaangctcctggggggccagatcgggctggaggacttcatcttcgcccacgtgaagggggcagcgcacaggaggtggacggtgttcaacgtcggaggatgcacttcgggcatcaccatcacaggacaccggggctggctacgcccttcatcaagcgcatcaaggagggcagcgtgatcgaccacatccactcatcagcgtgggcgacatgatcgaggccattaacgggcagagctgctgggtgccggcactacgaggtggcccggtgtcaaggagtgcccgaggcgtacttcangctgannctcaaggagctcgaaggcttcgaatgatcaggcagtgtaaagggggtggccgccctgggtctggcccacaaatgggcactggccgggtaccctgggggactccgatccggggcccggcacgggtgggaggatttgcctctgcttttgaagagaagcctttaaaggcggtctacctgcgagaatacctggttcagggacacgactggggcaccaggggactggaagacaaggacctgtatggcgagctgaaaaggggggaattgccacccaaaagcattagaatggggcccaggaccagggggaaagagccaacagagaacgcactgggccccgaaatggcc

SEQ ID NO: 542276 - DNA, 922 bp, Homo sapiens
  misc_feature (82)..(83): n is a, c, g, or t
  misc_feature (261)..(261): n is a, c, g, or t
  misc_feature (284)..(284): n is a, c, g, or t
  misc_feature (574)..(574): n is a, c, g, or t
  misc_feature (580)..(581): n is a, c, g, or t
gctggagtttgctggatgggccgagccgggtgcgcactggggagtggcggaggcagcggcggcggcggcggcggcggcggcnnggcggacagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttaggtgatgttctgcacacctgaacganccacaaagtggacagtggacaangctcctggggggccagatcgggctggaggacttcatcttcgcccacgtgaagggggcagcgcacaggaggtggacggtgttcaacgtcggaggatgcacttcgggcatcaccatcacaggacaccggggctggctacgcccttcatcaagcgcatcaaggagggcagcgtgatcgaccacatccactcatcagcgtgggcgacatgatcgaggccattaacgggcagagctgctgggtgccggcactacgaggtggcccggtgtcaaggagtgcccgaggcgtacttcangctgannctcaaggagctcgaaggcttcgaatgatcaggcagtgtaaagggggtggccgccctgggtctggcccacaaatgggcactggccgggtaccctgggggactccgatccggggcccggcacgggtgggaggatttgcctctgcttttgaagagaagcctttaaaggcggtctacctgcgagaatacctggttcagggacacgactggggcaccaggggactggaagacaaggacctgtatggcgagctgaaaaggggggaattgccacccaaaagcattagaatggggcccaggaccagggggaaagagccaacagagaacgcactgggccccgaaatggcc

SEQ ID NO: 542277 - DNA, 131 bp, Homo sapiens
tagccatataatcatcatagcctgccatagcctcacaacataagcaccacgcctcatcctctcaaagccagctgcctactgccaaatgctagtgatatcctctaccagccctcaggctctgtcataacgga

SEQ ID NO: 542278 - DNA, 838 bp, Homo sapiens
tgcctgtagtcccagctactcaggagactgaggtggaagaatcacttgagcctgggaggttgaggctgcagtgagctgtgtttataccactgcactccagcctgctgggtaacagagcaagactccatctcaaaaagaaaagaaaaaatgcctggcctcattatgtatgcaaagcaaaaaaaaaaaagttccgtgctgcaaatctatataagacaaatgattttgcgaaagcttggctactgtgcctacttgtaccaagtgtgggtctaccaaatgtgtcttcgtacactgggcaattcttataacttggattttctatggacagaagtttgattatatgtacaccattgtgcagagactcctggctcaagtgcttaatgtgctttccatttaacacatacgaattctatccattagtgctcccgaggtgtttgacttttgagccactcggaaattggtcacaccgagaagaaattgtatagacgaacctcacagggtgccttcatgggttcatcgtcttaaaaaagatcaacaggattacactatagaagcttcaagacagagagatgatagaataaaacaacttcccggtgggacctccttaatgtccagggtcagggagaagaaaaaaaggaggtggaacttgacaaggtgggcatcttagggtctccatataggcgtgttgtccctgtgtacccaccagttttgttgtgtaccccaaaggtgtgggaaagacctgcgcgcccggatcctcccctataatagaatgacgctccgcaatttaattgtcggaaataaggcccagtgatatacccggggttaggaactgcgcgcaaaa

SEQ ID NO: 542279 - DNA, 445 bp, Homo sapiens
  misc_feature (12)..(12): n is a, c, g, or t
  misc_feature (33)..(33): n is a, c, g, or t
  misc_feature (433)..(435): n is a, c, g, or t
tttttatcctanagtgtggccccttggtggggnaaaagctccccccattccctgctcctgaggagttgaactcccaatactggggcttgccccatgggtgctgcccacacccccagagagaggcgatgcaagcctgctccccaggcctgctctcccctccctcgacaaactggcccatctgttcccggggaaaaagaggggactctttcttcataaaagaaaacagtagtgggcacattttcctttagttatcctcaatatataagaaacttcaagaatggtagctttcaacagaaaaccatacaatgacctccagtacacacatacacacacacacacacacacacacacacaccccatttcactcagaatagtgcagggaaaactgagcaaaccacgagaccaagccaatgtctatgatgaagatgataannnaactgtggca

SEQ ID NO: 542280 - DNA, 1426 bp, Homo sapiens
  misc_feature (144)..(144): n is a, c, g, or t
acagaacctcgatacttgctccgtgacatgcttctatccagtggttgtatcatggacttatggtggccaccaaatatgagcgtgacgtgtctgtgctcctctagggacatcttctgagcatagtcagaccagtctctagggggntagatagtcaccgactcattggagacaatgtcagtccaccaaaaagggtctcgatgtgactacgcctgtctatcatgacgaccactcatcacctattacgactggtagaaccaccgcattgtaagaacgatcacatggcttccaagatatgatgtcctgttcactacgtccagatgtgacctaagtacgtccattgccagagagacccatcgaaagcccagatgtcgagtacgcttacatcctatcaactaggagtttagcgaatcaagtgcttcatggagcttacgaaagtatcttacccttgataacgccgttggaacttgtaccacaatggcttcggggaagctgcctcagtgttgggtcacatcgatgtgccctcacacttgctcatttgcattgcaactctattctcatagctcttggcgggttttgccgtgtgtcgctacgcaacaaacccatagtatctctttgtcggtgggctatcagtggccgatcccgtccaaccgttgcccccaggattttacccgggcttaccattcattccgcatggtattgatggaaaagccctgtggtgtcgtccccttcccagctaggaaaagtggggtgccccttgcagggccccccggttccgcttgggttgggttcatccaagggatgtcgccaacattagtgttaaccttggtgctccgttgggcaaacccgggtggaatccttgaaaatttattacccacatttgtttatgcgttccatgttgtcccccttggaatggaaagttacatgtccaagtgcatgaaaggtcgcatgggcccccttgtaccttttgcgaccatggggacacgaggaagcgactcgcgagagtgaacgtcgttccccgcgaaacgtggggttaaaatccccggtttcccacctaactccccaaaattctttcacttgtggatccgccagaagactcacttcggggggttggttcccctttcgcagcaaaggtggtcacgccagattgaacccccccattttggctgcttccggatccctaagccgcatgggtgggtcattggacgactcgtgggcgacaccactgggttcattccccaacgcctattcccttgtgtgcgacgtttcctggggttcctacgcgacaacgcacctcaggctggtgtttggaggggccagcgcacaaacttggcattcctttctggacgtgggcacccattggtgttcctctggtgcgcggacaccactcacgaccgctcctccgctctgcacggtcgcagcactcgca

SEQ ID NO: 542281 - DNA, 416 bp, Homo sapiens
atagatgtgcacatcttcaactttagtgactgtcttgtgtctgtacaaataaggatatccgtgaggaccgatgcatctcaccatcttgttatccttgacactctcctgcctttgatcttgtgtcctgtactctcttgcttctcctactacctctcaagttactgtttgtctcacatattccctcaaccttctcatggtagggacatgacaaagctaagggtgtgagggagtagtcatgggccctcaagttaaggatgagaaggtttgtatgtactacagctggaaaggtgttcggacacaacgcatgcagctctaggggccagctactttgtctcacacagcagatggtatgtccctttcctggtctttctgcttctctcattcttcatgctggctggcttatttgctcagttatg

SEQ ID NO: 542282 - DNA, 1006 bp, Homo sapiens
  misc_feature (978)..(978): n is a, c, g, or t
caagttgttcacgttgacgggtaccggactaaggccccggcatttggccttttccgtcgcgggcacacattccgaacacttcatggcccaggggtgaacaatctatcccttagttcatgtccggaatgcaagtcaaccagaagttgcaagccaaaatttaccaaaattgaattcgccctaaaatatcagtgtgttaaatgcactgtcctcacacaccgttactatcgaagtcccattcaaacctggacgacccctgtacataaacattagggccattctcaccaagttttctaaaagatgattttctaaacattaccaaggtctaaagtgctaatttccccacaaaaccagtttcttatcttgtttaaaatgagactggcttgacgataactccatgactcaccatgttatgtgctttaaggaattccaacgtgaaggagatgtataaggcaaccactaaatgtagaaaacaaatgctatgtattaggataatattctcccactgctattaacggtagaacaagcatgtgagattcttacatttcttctagtgtgccttagcaaatctgctgggcaaacgagtctagcttgttttgagaattcgaaaaacataatgtgtctctcaatcttgtcaattctaagcctcgctaaaggcacgaacacctatccacaccgtaatggacgtctggtagtgcctggagagaggcaaatgatcattggatgtcacaaaagctactagagaatagactaaaacaagaatttcaagcaaaactaacaaaaaattaaatccacaaaaaaatatcatttggtaaatgcactgtctcacacactttactactaagtcccattcaaaccatgacgaccctttacataaaattagggcattctcaccaagtttctaaagatgatttctaaacattcaccaaggtctaagtgctaattccccacaaaccatttcttatcttgtttaaatgaganctggctttagattaccatcacggtatta

SEQ ID NO: 542283 - DNA, 81 bp, Homo sapiens
aggattttcagtggctgtgaataagctaagaatggtaatgcagtttcaggggttagaaaatccaattcaaattagtcctca

SEQ ID NO: 542284 - DNA, 178 bp, Homo sapiens
cattgagcagtgcatacgcactcacgcacacttacacttgcactactctgctcatgcactccacactgtgtgcacacacgctacttgctcatacacgaactcattcgtgcactcacagtgcatttgctccacacaacttgcacacgttcatagcacacagttgcacgttttccacact

SEQ ID NO: 542285 - DNA, 921 bp, Homo sapiens
ggtgcctgcggacaggcccccaggtctagcggctttgtggagtggaacactggtgtatcctctccacagtccaggtgctgggaggccctccttgtgcttagagaggacacttccaaagctggggcgctcccaatggaggcaccagtggccagaatgtccacgcagagcacccaccccctgaaacctgaggccccacgtctgccatctgggatccccgagtcccacgaaatgctgttcagctggggcctacacgatctctccctgtccacaggtgacgtttcgcgtgccgtcaccccgcgagtgacgctgtcagcgccttttgatgcatcgagcgtgtaagccttcactcgtccgtcttggtgcgtctgccccctgttcctgtgatgaatgatccggtacttcctgaccctatgtccacagcctgtccctgggcgtggattcgacgtgatgggcatgccttgtggcccttcatcatctggctcgctcgtgggacaaggcgagactcactgctggagtcactgacgctgcacacggtctgggggccaccatagcccacctgcatgtgctggccgtgtcgccgtcgccttccgggcagcagggcatggggccccatcctgctgtggtgctacctgcaccacctgggcagccagccggccgtgcgccggtgccgccgctcatgtgcgaaggacgcgctggtaccccttctatgagaggtcccagttccacgccgtgggcccctgcgccattacccgtgggctccctcaccttcatgggggcctccactgtccctgcggggcacccctttctgcggcatgaacagcgggtgctgactgggtgccaactgggtgccaacatgatccccggtcttgcccgggtccctttactcatggctgggaggttcccgaggtgggggcgcccagg

SEQ ID NO: 542286 - DNA, 556 bp, Homo sapiens
atctctagagtcgcgctgccagagaagctgtgactggtcgtcgtgttacacgtcggacatgggtttaacaagcgggtgaacacggacaaaataatttctcccacaaaattatacccacacatccccagacagtataaatatatggtggagctaccattaatacacatcaccatttaatcaatcacttaataaaacaaatggtcaagtatccaaatattaagtaacacagctcaaagggcatataaaatattagatgtctgctcactccattagcagaaccccatttcttttttggcaagagaggtggggagggacaaaaaattcacattttcaaacaaaaatacgtgggtaaacacacttctgataagtaggggaacaaacttccaagaattccaggaagtacatgataacaataccaaagcatctctccctttaaaaacattatttacctaaataaaagacgcttatctacatgtgggcccaagacaagggcacctttgggttaaaaataattaatagccccctccaattcttttctcaggccctcccgtgtaat

SEQ ID NO: 542287 - DNA, 717 bp, Homo sapiens
ggtccggtcgagcccctgtccccacccttcctgagctgtccttttcccacaggcctctgggtggcatggtgtgcaaggcctggccgtggccttccttcctggccttagccacctggctctgtctgcagtcaggggcagtgctgctttcttatccatttccctggtaggcgggcccccctggcagcagtattgtaacggggctacaaggcagcgtgtgatgaaaggggcccatgcccagcctgtagctccactcacttcagtgacgctcactcacatagccccgcttgagggtccccctacctgttgaccatcgagtggtaatggctccatggggcccctctcgcaggacctcctggcccccaaactgattctgcccagtataatcgtgctcgtcctgcgctccactacagtcattgcttcttcagtcatgaagtgttggccactaggccccggggatccccattgctgctgtgggctcccatgtccctggggcagtgagtgctggtgcaggaaagtggagcgctaacgagcgggagtgccttcacatcaatctgttgaacccgcacacttggagggtgctgtggccgctgcacatccccgtttaccactcacttcgccttagcaggtcctgtgagaccgagtgacgagctgaaacgtgagggttgcagtggtgatcccgcccagactgtgctcaacgccccacatttgttcgcccat

SEQ ID NO: 542288 - DNA, 175 bp, Homo sapiens
agagaccccccggagcccttgaccctgaacgatcctgcatgtctgccatttgaatgtcgtgtggttacaggacccggtcagttcaagttatcaggggtccagcagctctgcggaggcatctggaacagaggagggggaggaagtgcccagtttcaccatggggcgatgacaatgt

SEQ ID NO: 542289 - DNA, 1615 bp, Homo sapiens
  misc_feature (1210)..(1210): n is a, c, g, or t
taggtttgagggggaatgctggagaattgtaaatgggtatggaaactatatcatataagtcaatgctacaggcgtgagtggtaaggaagtttttccaataaggaggtgtcatgagttgggtcgaagcggaatcgggggtatagctgttcgatattcataaacgacacagggcagtgttcaccaagtcgggctctctggtgcaccaaattatgttgttgtagcagttcagggcgacgatgctgcgtacataattgtagtgtaccctcaaggacagcattttgcacgtgggctagaagggtcgtccacattccatacaactccaattgtactagcgcgtatctccggactaaattgcaaacaaataacgcggccgcacagtgggagcccctaggcggcggcggttcatccacgacattgatcatagaaaaagccactgacaaaaattaacattactcgagaggcacagatacccccacagttagaagagacaaacacaagcggtatcccaaaaaacgcagggaggacgataaccaggaagaacgagagataccaacacaggacataaacaatagtcagcacgaagaaaaattacaacactaccagaacagtaaaaacggaggaccaccacaaaagcggggacgcgaccactagcaaacataggacgccaacgaagcatcagataacacacaaccaaagaacgaggagtagcatacacaataagacaagacaacagagacgaaacaaaacgacacgcacatacacaacccacgaggccaacccaaagagagaacaccacaaaactacacaaaaacacagaccaacgaagatataagcaacgtaatagacaagccaaaagaggacaagagagaacacaagacgagcaataacaaaactgacaaacacacgaaacaaacaaccaacgacaagcaagaccgaccgcaaacgaacgatgcaccacacccaaaccaagcacacaccacacacagacaccagagcacgccgcacgagaactcaacaacccagcggagacagaaacataagaccagtgagacaacaccaaacgcaatagagaagaccaacgacaaaacagcaaaacacgactaacactaacacaaaccgatgacacatagcagccacagatacagcaaacagaatagaagcacaagacacaaccaaaacgaaaagcaccgacccgaacaaacacacgcanctcacgacaaagagcaaatcataaaacaagaagatacatacaccgacagccacgcggagcaaggaggatagacagaacaaacaagacagagacgaaacaagaagcaagagatacatacacgtagagacacacacgaagacagaacaaacaagcacaacacaacaagcacaacacaatacagatacgaaggaaagagaccagagaaagagaacaagaacagaaacatcactacaaaacgacagagacacagaacacacaataaaccaaagcacacaagacacagacacaccaaatcaatcaaccaacgacacacaagacgaaacgacagacaacagcaacaagaacacacaataacaccagaaacaacagaacacaaacaacaacactcaccaagaaaagagacca

SEQ ID NO: 542290 - DNA, 227 bp, Homo sapiens
ttggcatacgatcccccaaagagcccgtctgcaccccagacccaggcctcaggcctccagctcctgggatcgggagtcatcccggcccagcacccccagcatcccctgtgtatggccccccgtgcaccattccttgtctcattccccgaatgatcctgtccccgctggccccttcacgtgtccagtgtctttgaggcgatcttgtgcatgggtacctgagcgtcgaa

SEQ ID NO: 542291 - DNA, 182 bp, Homo sapiens
acatcatgtcttttactgtccatgggttaaggctctaacacggccctgtaaaaactgagtaagtgagatgtaagagacatgagccaagtgctaaatggaggaagagggtaatggcagggcctaggaagggcagtagccaggctgcccaggagttacgaaatcaccagggccgggaatctgaa

SEQ ID NO: 542292 - DNA, 845 bp, Homo sapiens
ggtgccccctcaataattacaatgaggggaaagttttgggcgatgtttcaaccgggcaattggccgaccaaactgtccacctattaggccacaaatggcgcccctataagacccaacgggtcccaacttcccgttggccggcccgaattgggaccgactctcgcttaaaggggacttgcatggcgaaaacgcggaaaagggatccaggtttccgcccaactggagctctacgtctcgatgggtacccccttggcgctctaggcattcgttgattgctgtgatcccaattggcttcctaacatgtcgcgaaccactcggcgcgtccgccctaaggctcacaaacggggggtaggccatgactagcgcggatcacacttccggggttattgtcctgaggcctcctctacgtttacagcccagtttctcgttgacgagcccgtgtaccgagcacggggacccatgagactcaacaacgccggatggtaggctgccctgctgaagtaccatccacgcacctcccgacctgggataggggacgggtgtccgtaccgggaaatcgaaggaataagccacgaggaccggagctgcgggtgttatctctaaagctgctatcctagtgtcgcgagtctagcgtggacgggtagacgcacctgaatattcttgggtgttggttgggatagagtcaggatcgtcagccataaagtgccagtttgcttagttctcactgtctcctggtatgttgctgcctgctcctggggatcgcacaggcagcgcagggtaggggagagggaggttcctcgcaggtctcacgcccggtacaggattaccgccagcagcctcctgga

SEQ ID NO: 542293 - DNA, 504 bp, Homo sapiens
tagactgtcgacaggtaggagtgcagtggcaggatctatggctcatatgcaacttctagcctcccaggctcaagcatcctcccacctcagcctccgagtagctgggactgcaggcctgctccaccgcgcatggctaataattgtatatttttgtagatacggggtattgccatgttgcccaggctcttagtgattatcttaatggtgtctggaaactcatactgttgcatcttggtaggcaaaagctgctgtatctgttaccttgacatattttaaaacccaatttctattctaaaataatgaaaccatcttttgctggcattaaattctctagctttagatccttcaccttcctttagcttaagttgtcatatgatgacctctttttcttgaatcatattagagtctataggtatagcctttcttaggttaaaaattggagacagtctcactttgtcacccaggctggagtgtaataatggcacagtcatgacacaccgccgc

SEQ ID NO: 542294 - DNA, 500 bp, Homo sapiens
tagaggatccatcggccgcctttttttcccctcatgcaactcacagcttgctatttatcctctccctgtactgcagaccggagtgttgagatcaaggcatctcagggctgtgctccctctggaggctctaggggaggatccttcctgcctctcccagctcctgggggctccgggtgtccctgggcttgtagccgcatcactccagtctctgcctccatctccacgtggccttctcctctgtgtgtctcctcttctgtctcttagaaggacacctgccattgcatttagggcccaccctactccaggatgatcccatctccagatccttcccagccaacatttctaagtcctttccttggccctctgcttccttagaacttgccccagaccccaaatcagggaggaagattggaacctgcctcctgtctccttgctggctggtcttgcaataaagtctttcttttctcaaaggcagtaccagggtatggcttccgtgtaca

SEQ ID NO: 542295 - DNA, 400 bp, Homo sapiens
gtcttccattagtgtgttgactcacaagcagcacttttaagatctctgatttgcccacacatttgtgtaatgtggtctcagacaaacctgcgcattttctccatagaggcgtataaatgtggatttactttgtcacgtggtttgccgttggtcactcgtggcccaatcctttccccaatactggcagctttgtggccaacgttctctgggaaagctaggccctcaattttagactcgataccatgtggcccgtgtatggcacaggaaggtagcattgttgtgaatgagatcttcatgagccttggggggagatacttccctctcccaatcgcagaggggcttgtgcgcttcacaggagatggttgctgcgcatttaataactgtgcctgcgcgcgtgccg

SEQ ID NO: 542296 - DNA, 795 bp, Homo sapiens
ggtgagtcccccactggctgctctgaaaagccatctttgcatgtgcctcatccgcctccttgctcgccgtagcgcctccgccgtgcgtcctcctccgccgaccgcggaatctgccggcgagcttatatcgctcgagagatccctggaactcttcgccggttgctgtgtttaaatccccctggcaattcggatcaccggggatgcccgcaccatgttcagacgtcaggcgcgtaggacactcagcgttccgaaagtcacctagcaatggacgttgaaaggcagaagcaagggcgagtcgtgggacagacggcaggaagacatgggattagatgaatcgccgccgtcgctatacgtggaagtgcgtacatgtgaggacaaacctgggcgagccagggaggcctgatcacttgacgcgtagcacgacagcacagaacggacagaacggctgggcgaggacagacggacggacggaagcacgaacggtgactggtgacggaacgcaggatggacgactgaacgatgaggaacgcgtgagtcagctaccgggcaaagcgggcagctgaagatgatgaggatgacgatgtcgaataccaaagaatgaaggaaagacggacgaggatgactaggacggcaagaacaggagaagttgaatatagaaaaaagaaaggggggatgggcatagttgaccgcgattccggtctcaggaactgtaggttggcgcctttgattgaggggcacgccggcaaccggggggtgcccgggaatatgggggttcacgcaacaaagctgggatgg

SEQ ID NO: 542297 - DNA, 236 bp, Homo sapiens
tattttttcagggtttttcccccaggccttttttgtccccaaggtttgggattgggcagtggccctttccccatggaggtgcctttcccaggaaaaaaaaccctgggcccaggcaggggccgtgcctttaaatttttctttccccccaaagggtgggtcccaggttttggcccccccccgggcttttggaattttccgtgaattattttttattaaaccaaaaatgtccaggggga

SEQ ID NO: 542298 - DNA, 689 bp, Homo sapiens
ggttgttggcccccccccctttttgaaaccgcggctaccacaattttaatatcacttaacaccctgttatggtatttacatatacaccacatatcgcagatttataggggtgagacacaccatatatgagaatcgttcgcacaaggagattccaccacacaggttgtgtgtatacacacaataatgccacagcgcgcctttgttataaaacacgcagccgcgcgccacacgtataacttatatatacacgcggttctctataagagttatacgcgagaggccctcgtgggtgtgtcgagaattttgcgcacaccagaggcctgagagagacgcacacagagatgggtctacaccacacgcacagcgctgtatactctggagagccacccccgcgcgtaaaatttctcgcgccacagaggtgtcttctcgcgctctttgttctcgtgtctctgttctcaaacccggcacccggtttgagatcccgggaaatatatggccctccaataatgtggccccccactggtttctcctccagtaaccccgaaaggaatatatctcggtttcacattataagttggagctaaaatgcgtctttcccttcacagaaggattatcccgggcgatttacctccatgtgaaaaccctgataatttttttggaaattaaattaacccatttggaaaaaccca

SEQ ID NO: 542299 - DNA, 673 bp, Homo sapiens
tgacttcccgtgctgggcttttccattgtccccctggcctccaggctcctcctctgcctctccatggagtgggtggggaggtggtgggggccggcgtcccctgcgtgtgtgtgtgtgtgtgtgtgtgtgtgtgtgatgtatagaccgtgtgtttcccaagaagagcaggtgccacggtcctgccccgtcgtgccgagcgcagaattccctgttctcctgtgtctactaacaaggacatgggggtgggcggtgactctccgtatcctctcagagctcagagggtcctcgcgtgccagcggtccccccctagccgcgtcatcaggccggtggacaagctccatcttccattcgctggttattagggcagaatccgatggagcagctgcttccagaaaggtcatctggtctgctgatgttataaaattacttccgctgtgtcgctgagcaagtcacgctgtgggttcccccccttctccgctgtgttccatccctttcgtgaggacggagcgctggagtcagcggcgtgggttgctggagttaaccccatcctttccgtagttaaccacctttgtgtgcactattttcattcttattttggtgtgttgtttttctccggtgtggtgtggttccctaaactttattataccttcttgttcccccttttttccctttt

SEQ ID NO: 542300 - DNA, 238 bp, Homo sapiens
gcgaaaccccgtctctgctaaaaatacaaaaattagtcggtgtggtggtgcatgcctataatcccagctactcgggagtctgaggtgagagaatctacttgaacccaggaggcagaggttgcagtgagctgagattgcaccactgcactccagcctgggtaacagagcaagattccctcaaaaaaaaaacaattattttaaaataacaggccaggcgcggtggctcacgcagttttcc

SEQ ID NO: 542301 - DNA, 213 bp, Homo sapiens
gacaggcagtagtcgaactgctttgccttattttattcctcgagtcagtcgaaacacaaatcctcaggacagcttggttcagaagacagtggttccagggttcccattagatccattcttgaggtgtgttgactgtataccccaagagacagtaacggggcatcttcagtcccaccactccagcacacacaggtcctgtgtggatgccaatgc

SEQ ID NO: 542302 - DNA, 8434 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542303 - DNA, 8371 bp, Homo sapiens
tcccttcgtctaagaacaactggcattaatagtccatacaagcagactatggagcccaagaaggacaggaagcggatttcaggactgtgagcgggtggtaagaggacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542304 - DNA, 281 bp, Homo sapiens
atgcgatcgtgtggaggagctgaacagagctggaactggagcagaacggatccatgagccgagccgacttcgaggaaagggacgagtcgaagattcctgaaggcagagctctgacaggcggtgcccgccaatgctgcataggacctgggatgctgctggagctgaatcggatgccaccaaggctcggtccagcccagtaccgctggaaagtgaataaactccggaggggtcgcacgggacctgggctctctccacgaattctggcttgtatgccccaagga

SEQ ID NO: 542305 - DNA, 9835 bp, Homo sapiens
  misc_feature (7607)..(7607): n is a, c, g, or t
  misc_feature (7611)..(7612): n is a, c, g, or t
  misc_feature (7614)..(7614): n is a, c, g, or t
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtggggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgtctggaagagcaccgtcctcagnacanntnccagccagcctccgcccccagccagaggagaaaaggcaccgcaaagccacagctgagggcgacagcacgtgccccactccccagccacccttgatggctcactgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542306 - DNA, 412 bp, Homo sapiens
aatgtctctgcctagctaaaacacgtgcggatactatacagccatgaaaaagaatgaaatgatgtcctttagaggaacatggattcatctggagaccatcatcctaagtgaattaacagagggacagaaaaccaaataccacatgttctcatttataaatgagagctaaacattgagtacaggtgaacataaaaacaggtactacagacactggggactactggagagggtagaagggaagaggggaatggaccgaaaaactacccatcaggtactatgctctctcctgggcaacagggccatccatacccaaattcttagcatcacataatatacccatgtaacaaacctgcacttggaccccctgagtctataataaaattggaaattattttaaaaagaaaaagaaaaa

SEQ ID NO: 542307 - DNA, 87 bp, Homo sapiens
  misc_feature (45)..(45): n is a, c, g, or t
caacacccactacctaaaaaataccaaacatatgactgaactccncacacccaataggaccaatctatcaccctatagacagatcta

SEQ ID NO: 542308 - DNA, 10067 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatcagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542309 - DNA, 8678 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542310 - DNA, 10477 bp, Homo sapiens
  misc_feature (6274)..(6274): n is a, c, g, or t
  misc_feature (8249)..(8249): n is a, c, g, or t
  misc_feature (8253)..(8254): n is a, c, g, or t
  misc_feature (8256)..(8256): n is a, c, g, or t
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgctgcagcaaggggaaggatgcggtcagatcagccagtggcctgcaccccactggccctggggcagggagctgtcatagctcccagaggctcaggnaggcaagggaccggccaggctcctgtgcctcttaaatggtagccaccaggattccctgatctaggtgactccaacacctggcctcttatcccattagtgcctgcaatgtccccctcacccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgtctggaagagcaccgtcctcagnacanntnccagccagcctccgcccccagccagaggagaaaaggcaccgcaaagccacagctgagggcgacagcacgtgccccactccccagccacccttgatggctcactgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542311 - DNA, 126 bp, Homo sapiens
cgccagtaccggctgcccccgcataaattggtgctcgtccagtaaccccaggccgcccattccacccgcgggtcggtgacccatttccgcctcgcgcctgggggggggtcttggctcggggggggt

SEQ ID NO: 542312 - DNA, 109 bp, Homo sapiens
ctgctccgaatttgtacgaggagctcatgttgagcggccggggcccatcgattgttcaccagggtgggcttccaggtagtgttaccaatttgccctatagtttagccgt

SEQ ID NO: 542313 - DNA, 292 bp, Homo sapiens
  misc_feature (247)..(247): n is a, c, g, or t
gcgctcaatggaattcccctaacactaacgaaaacaaccacaggacgttgttaagaacccaggacaaaaggccaaataatttaacaaaagatattcttatggctctagtcacttaggaaacagcaaggcttataggagctgagaacccggaattatggacaaaacccaaaaaaaaaaaatgataatatcatgatagtattgagcatatgtaatattggattagggcccgccccaatgaccttatttnagattactggtatttggaccggcccgttttaagcgggggtggtac

SEQ ID NO: 542314 - DNA, 5187 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactggtgagagggctccctgggagggcgtggatgatggtgggaaaggagccccactgtggaagtctgacccccacatcgccccaccttccccagtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaa

SEQ ID NO: 542315 - DNA, 529 bp, Homo sapiens
gagcggtagaggcagttgacttaccccctgcagaccctccctgacgactcacccttcagcattcactgggcaccttcccggagcggacaactgactcccatgtcacgatattgggtgaatcttccatcctgacctgtgaggtgggtgttcatctcattacgctccatacacatttaacttctcgaagcgtgccaggctctgccgatggatgctggggataagcgggaacccttaggatcacctctgtccacgagaaggaagctgaggctctgagcggatgcacaaggacacccactggcaggtgccgagcagcggtgtcaggaacccggaccggagactacagcgacaacggttcctcgtcccagcccccactcctcgctgggccggctcactcgtcaagacacgacacgtgccacaatggacacgggccaggccaacggcgactgccctcacgccgtccgtggccacgacggaccacgcggtcccggcacgacccccgagaccgccacgactggaaccaccgagaacg

SEQ ID NO: 542316 - DNA, 6885 bp, Homo sapiens
  misc_feature (10)..(10): n is a, c, g, or t
  misc_feature (21)..(21): n is a, c, g, or t
  misc_feature (26)..(26): n is a, c, g, or t
  misc_feature (30)..(30): n is a, c, g, or t
  misc_feature (41)..(41): n is a, c, g, or t
  misc_feature (47)..(47): n is a, c, g, or t
  misc_feature (62)..(62): n is a, c, g, or t
  misc_feature (66)..(66): n is a, c, g, or t
  misc_feature (70)..(70): n is a, c, g, or t
  misc_feature (85)..(86): n is a, c, g, or t
  misc_feature (90)..(90): n is a, c, g, or t
  misc_feature (102)..(102): n is a, c, g, or t
  misc_feature (109)..(109): n is a, c, g, or t
  misc_feature (211)..(212): n is a, c, g, or t
  misc_feature (242)..(242): n is a, c, g, or t
  misc_feature (248)..(248): n is a, c, g, or t
  misc_feature (262)..(262): n is a, c, g, or t
  misc_feature (272)..(272): n is a, c, g, or t
  misc_feature (293)..(293): n is a, c, g, or t
  misc_feature (329)..(329): n is a, c, g, or t
  misc_feature (468)..(468): n is a, c, g, or t
gttttattcnatcccctcacnagatngacntcacggcaagnctcccnagaggttcccttatnaaantganggacagagggtcatnntcancatccctctacntgatctntgcttttcagcatctctctgctggggaagcccccccatagctccatcatgtctatggcaacggggaaaaacctccagtccattcccaagaaggtaagcaaannagaccctgtgagccttgcaagtgagcatgnaagggnctgaggattggggnaggagagagnggctaatctggaaggctctgnatgggggattccagcagaactccggcacttggttcntagtcttcccccagatcaaagaggaggtagtggcacagagctgggaaagacccttgctggggcttgagctccctatccccccaggcctgaccatttactaagagcccgttgaatacgtggaagagctaggagcagccgncagaggggctgtgcgccccaggagtgactggccttgttcccgcagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542317 - DNA, 169 bp, Homo sapiens
cctcaaggcgtccagtgctctctgtactaccatcactctccactgtacctcctgttttgggccacacactgctttgttcatttgtctgagatgtggcagaaccctgagtcccattccttagtagatttgcatccgtttgttaacgtcttaccattgccatttgcactgt

SEQ ID NO: 542318 - DNA, 6490 bp, Homo sapiens
acggctaggtacgaggctgggtgtgaatcggccgaggcgtaagtgcttcctcttcctgctgccataggtggcatgccgagcctgttcgataagccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacacttgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542319 - DNA, 9774 bp, Homo sapiens
  misc_feature (7546)..(7546): n is a, c, g, or t
  misc_feature (7550)..(7551): n is a, c, g, or t
  misc_feature (7553)..(7553): n is a, c, g, or t
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgtctggaagagcaccgtcctcagnacanntnccagccagcctccgcccccagccagaggagaaaaggcaccgcaaagccacagctgagggcgacagcacgtgccccactccccagccacccttgatggctcactgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542320 - DNA, 370 bp, Homo sapiens
tggctctgagcgaactgctaggtggcacccataaagcttgtgatgacaccaggaactacagatccccaaagatgttgtcacagcccttgtttcatggcagctctctaggtctggactccccaaagggttcatagtcgtcttccgtccttttttgccagcagcatggtgagtggggggtaggaaggggtgtttcagcactgtttgtgttacagctcttcgagtcccaccatttggcgggtcccgagttcttgtcccacatccagagagaatgaggtacacagatagttggagggttagcaaggcgaagaggggctttattgagcagtagcacagctctcaggagacccaaagtgggtggctcctttccaca

SEQ ID NO: 542321 - DNA, 345 bp, Homo sapiens
  misc_feature (15)..(15): n is a, c, g, or t
  misc_feature (214)..(214): n is a, c, g, or t
  misc_feature (248)..(248): n is a, c, g, or t
  misc_feature (328)..(328): n is a, c, g, or t
  misc_feature (343)..(343): n is a, c, g, or t
tgaaggtagagtttnctgttaacagaagcaacataaagcatggtgtctagtagagggatgcaaaaagggagagaattggttagctagggtgttttggtaaaggaccaatgatgtgcctcatggaaaagatccctattacactaggtggggctgctggccttgaaatgtcatgtgcttttcagaccaagggcagagagagatgctccctatggtnagggtgaccctctgttccttgaaaatcacaaagntgccctcccttgagctatatccctgggttactatgacattccctcatcttgccaaacaaggttacctccctggaactatnaaaatttcccatacntt

SEQ ID NO: 542322 - DNA, 846 bp, Homo sapiens
gcttaacgggtgtccgacgcgtcttcggaacccagttgggggggcgaagaagcgccaaagggcgatgtggagcggtacgttgcctccgtgctgggtctcaacccgtcggctccaccgaagtccatgaaagggttctaattttggcaagctggattatgaagcttaagaatatgatcttggctaaaaaatacatatgtacttacattaatggtgccagagagggatccccaagctcacagatttctggggtcttctttatgaacttggaagaaaacacagagaaagccggctgaaatggtacagggggttcagtggaaattaacccaacacaaaaagaacttggtggttgaagattggagaaattggtttggtaaaaatgatgttctgatggaagaagcaaaatactggggtcgaaagagcagcaaaaacttttgccaagaaggtctggccatttataaactaaagggacagcttctaaattgtgaaggggaagatgggtggcatataactttttgacttgattccgtccgaactttatgttagaaccgatggacggtcccatgtgaaccttcggggctaaggggacgttggatcgtccaaattacacattgcagggatgctggggcccccggccatgaggacagcaggacctagttagggtccagttacagggaatccggtgtggacaaccctacgggtccggagcctacgggtggagccgaaccgacggcccccaaacattgggggcaggaaaagatgccccaaaaatgcccacaactgggaggaaagctcggacccggggaaagggcccgggacgcccccagccaccccccgcgcctccacagc

SEQ ID NO: 542323 - DNA, 298 bp, Homo sapiens
cttatactttattgctcaactttaattaaaatgattgataataaccactttattaaaaacctaaggttttttttttttccgtaaacttgcccctttttttaacggggggggggatcctgtggtttttaattttccctatttttaagggttttggtggtttttgaggtttcatcgggttttgccttaactttttaaatgggtttttttaatcggtttacctaattttaaattcaaatttcccatttttaaatttagggcaaattttgggtttttgtttggggcttttgaattcttaaaa

SEQ ID NO: 542324 - DNA, 711 bp, Homo sapiens
  misc_feature (394)..(394): n is a, c, g, or t
  misc_feature (679)..(679): n is a, c, g, or t
gaccaggtgcaggcctgtggacgagcctgcttctaccagagtagaggattccctttggtgcgctatgcttacaatctaccaagagttaaagactgcaactgactgtgtgtgtacaccgttctcccccggtcaaccgaatagatcgagctgttttatgagagtggaaccctagttctcatctttcatctgggaaagcgacttctgtgaatcgactgcctggtgtcacttagaagaaaggcagtaggtggcaggttatatttctccataccagtcattcttccaagaggaacagggtgccctagagattatcaacagttggggtgagagagacatgcgaatggtccgaagcagagtgtattgatcgtgctttggaaacgaaatatatgcacgttgnacaccaaggcagtctataggctgtacgtaggcaggcaatataactggttaggtgtgttaatgcgtggagttctcgagttagagcaaagtcaaaaatattgatacgctgagttttggtttgattaatctcaaatgccgagccaaaggaattagaaatgcaatcaggactcgttttgaaagttatgtgtatctctgagaaaaaactgctaaatgttttgagaaatagtggtgaaatttgtctccctcagtaaacctttgaaaagggaaacataatcaattcgtgtgnccttaaacttttcttgaacccctttagagtgg

SEQ ID NO: 542325 - DNA, 92 bp, Homo sapiens
ggaaagccatattattgcaaataaataatagctgatttttcaacagacccagaagcagccagaagacaatggattagcttcttttaaataca

SEQ ID NO: 542326 - DNA, 651 bp, Homo sapiens
cagactagatctctaaggtccaagcgcccctcacctcgaggagattaaattttactgagatacagtagtgactttagggaccgaccgtggacgcaagggtcatgtcttaaatgccaaagaacaggccttcaccgaaaggatggcggtaagccagaataacaacgatgagcaaaagcgagcaggaactaaccaagaattcaaacaatctggataaagagcacggctcaaaaaggaggttggagctaaaagaagaggatgatgttaaaaggaatgtttaaaggaacaccacctacgaggaaataaagcaaagggaccaagacatgttactgttgctgaccgggtactacaaatgcatacaaaaggcttaagcctgaaagcctgattgcgaaacggaggatctccttctgggattaccaacgaatcgtgatcaatatgccagacatgaatatcgaactttatggggtcgaaacgggcctatttcagcaagtaaaatttgtcagaattgactaaatggccctcccaaaaaaaaaactcttttagaaagcaagatgacacaccttacaactgcatgcattcaaaaaaaagggtaattttccctaaattgcctgagctctaaagaaaacatttcagggaaggaggcttaaaaacaaa

SEQ ID NO: 542327 - DNA, 295 bp, Homo sapiens
cggaccgcaccaccctcctgtcaccccgcaaacccgctccccggccaacctcaggagaggatggggccacgggcgccccatggggtgctgtttgccccctccgccaccggccccaacctgccggcgggcaaaatgaagccacgcgagatcccgcttcagactccttagctggacgaacccgcgccattgagggccgcggggccaccacactggtcgcgtttgatgtccgcgttaggtcccccctcgcaccgtgatgacctctgagagtgagctgcacgtccccgcggtttcccac

SEQ ID NO: 542328 - DNA, 173 bp, Homo sapiens
  misc_feature (65)..(65): n is a, c, g, or t
  misc_feature (73)..(74): n is a, c, g, or t
ccgttttcacatacataacagcaattttatgacctgtatggccacagggagagcaaatgcaaatnaggaccanngtggaaaccccaacaaccaaacttgctgtgggggtcaagaaggaggaaaataacccacgggagcaacatattgacagagcaacctaaaatccactctgg

SEQ ID NO: 542329 - DNA, 498 bp, Homo sapiens
tacagcgtgacatgcccaatgcaggcagggatgctgtgtggtgatattgccaattgttcctggcgtggtactgggagggcaggcctcctaggtagaacaacccctcgacatccagcatggttccatctcccaccagagtcaccaggggagcctctcggccgtcacctgttactgaacgccttatcttgtacacatacgtctggcttgactcgtgtgccagttgccatcactgagcagggccgggggagacgaccttggttctgcctttgccacggtcgaggactgaagtggaggcggtccccgtgcaggtggagcacactggtactcagcttggttctgactgacgccacggtacgtagactcaggccgctggaggtgacacgtgcggatgcgttagctcaccccgtgagcttctttctgaccagccgcctgacttcaacacggccgactgacagacgggctgtctggtgtgagagcaacgtgatgagcgccgggaac

SEQ ID NO: 542330 - DNA, 111 bp, Homo sapiens
ccacttggtggcatggtcttggctggtacataagctttttcacttccaggtaatcctcattggttcactttggctcaggtggcctcagcaacaagtgcatggttccccgct

SEQ ID NO: 542331 - DNA, 554 bp, Homo sapiens
ataggcagtgatcgaactcgtgtacctgttggagtgttgttgcccaggctggagtagtggcaccatctctgctcactgcaacctccacctcctgggttcaagtgattcccctgcctcagccccctgagtagctgagattacaggcacccaccactatgccaggctattttttttttttaatagagacagggttttaccatgttggcaaggctggtctcaaacttctgacctcagatgatccacccatcggcctcccgaagtgctgggattacaggcatgggcaccacgcctggccagatttgcattttttttactgttatattgagtaatggtgctatgcacattcatgtacaagtatttgcttgagtatctgttttcacttcttttaggtatatgcctaggattgaaagtgctgagtcgtatcgtaattctgtgtttaactttcaaatgaggaacggcgaaactattttccaaagcagttgtaccagtttacattcctacctgtagagtatgagggttccaatttctccacatcctcaacaagcactccaaca

SEQ ID NO: 542332 - DNA, 141 bp, Homo sapiens
cccctttttgggggggccccccccccctttttttttttcccagggggggtttttttgggtcccccctttaggggggaattaaattcgccccttttgggggtttttttttccccttttttaaaaattcccccccaggcccca

SEQ ID NO: 542333 - DNA, 712 bp, Homo sapiens
  misc_feature (605)..(605): n is a, c, g, or t
ggcagcgagaggtcgcgggtgcagcgcacaggagaccagtgtcgggggcagcagctgcgagcacagaccccaagccgggtccagtccccgccagctcgccgggtggtgctcggagacggagatgcagctcccggccggagtgactacagcacgacccccggcagtgtacgctcttcagcaccaccccgggaggtaccaggatcatctagtgaccggaaattcctgatggagtgtctggaaactcacctgtgaccaaaatcactcccacaagggattctgtcccatccattccgggggtcatccatgcccttccagtgatgagccccccatgtgaagccagcctatgagccacctgcgtcaagtagcccagaagataagcgcggcgtgccgggtgacagagtcaccagtttgagatgtacatttagacagcacgcagccatcggtgttggagcacataccaaggggcccctcagggccttcctgggaggagtcccatcctagcacagtgccttatgaaagtgagtcatactgggcaggctgttggcgtggggtcgggacacctccatggcctttctccctctacttcgagggcaccgtgctccccntctctcttcgtgatcgactcgatgcagatacctccttgtgctctccatctgattgctacggagcttgccgatgcccagggtggacgtgaccgccgtgccagcacacc

SEQ ID NO: 542334 - DNA, 962 bp, Homo sapiens
ttcaggttttgcccaccgagtttgccgttctttgattggttctgtcacttcgcgctggtgccctttgtcccactgcggaacccgtgggctatgctcgtcccttttagaccttgggcctctcgtctggggttaactgggagaactcctgcgagcgtggcacgcggtgccccccggccgtgcccacaggtggtgccgcctcacagggcccacgttgtgttttgactcgccgccaccaacaggcattgtcttgtccccgccgcaatttgcttgttgctacagagcctcgctacctaccatgtgtgggtacgaacaccccgtgtgcgttgtgaacacttaacgggcctggaggcacgttcgtggagaggctccccccgcaatttggtggctgtgcccccccggcccgcccctgggggccgatcaccaggtgcgggcacccctcttgttctcgggccccgcgcccctgtttgtgttgcaagaccccaggcttcgtatccatagcgttggtactaccccccggaaatacttggtttctgttgggccggcccatgcggcgcgtgctactcctccctttgcaagcatcggcggcatccctctagcgcccttgatgccacgaccacagtcttctgaacgcccgccctttcttttctcacataatcattttccacaggcctgccactgttggcttccacccacccgggcacgcggagcacacaaagtcttctgtcttctctaacagaatggtgctctcaagaggacgaggctggatggtggagagagacctgctcgggacaccacgcttcgtgacggatctttctcggcccttggatcttcttccgggagagaggagaagacgacatcgacacgacgtgttcgatgtctcatgttattctgtaaaagtgttcgaaccctccttgcccccaaaaaaccaagtaatctttccccctgaacaaacatagacgcaa

SEQ ID NO: 542335 - DNA, 600 bp, Homo sapiens
  misc_feature (1)..(1): n is a, c, g, or t
  misc_feature (72)..(72): n is a, c, g, or t
  misc_feature (76)..(76): n is a, c, g, or t
  misc_feature (190)..(190): n is a, c, g, or t
  misc_feature (198)..(198): n is a, c, g, or t
  misc_feature (202)..(202): n is a, c, g, or t
  misc_feature (238)..(238): n is a, c, g, or t
  misc_feature (240)..(240): n is a, c, g, or t
  misc_feature (249)..(249): n is a, c, g, or t
  misc_feature (256)..(256): n is a, c, g, or t
  misc_feature (274)..(274): n is a, c, g, or t
  misc_feature (330)..(330): n is a, c, g, or t
  misc_feature (367)..(367): n is a, c, g, or t
  misc_feature (399)..(399): n is a, c, g, or t
  misc_feature (408)..(408): n is a, c, g, or t
  misc_feature (434)..(434): n is a, c, g, or t
  misc_feature (439)..(439): n is a, c, g, or t
  misc_feature (441)..(441): n is a, c, g, or t
  misc_feature (447)..(447): n is a, c, g, or t
  misc_feature (466)..(466): n is a, c, g, or t
  misc_feature (540)..(540): n is a, c, g, or t
  misc_feature (550)..(550): n is a, c, g, or t
  misc_feature (552)..(552): n is a, c, g, or t
nttaggctttctctattaagtaattaatcctaactatatccttgggctgatttggtttctgcccccacccgncagnctgacccttgtcccccttccccattccagctcaaggcacttaatattacaaagaaggcagtggctggctggagagatgggcctctagtcagaaatcccccagtgcaacttaagncaaacagngagnagtcaccttcctcttaggcccctccctgggttagcngncggccagancccagangtcttcagtaccacagtnggcttcggtatctccctagcccggtgaggggccccccggcgttctccctgcccgcnccgcgtctctcttccccctggcttcttcctggccgcncgtatggctctgccccttactttctgctctgngctgcctgnctcccggccgccagagttccctctgncccgngntcccgnagcctgccagggggccccngcagctttccggactggggggccggtggccccctgtggcctgctctgtcttttagcgtcacaagccaggagccngccccggggngntgctgttccgtgctggcctgtgtaggttactttgctcgttctattatc

SEQ ID NO: 542336 - DNA, 1074 bp, Homo sapiens
ggatatcaggacttccaataaataaagactgttaattcctaaaaaaaaaaaaaaaaaaaaaaaaaaaaaaaaaaaaaaaaaaaaaaaaaaaaaaaaaaaaaaaaaagaagaaagaagaaaagaacaaaaaaaacaaaagaaagacaacaacaacaaaagcgcaaagacacgaacaagagtgactgaagagatggaggatacaagtgcgagctgataagcacctcgctatcctacctcaacacatcactctcgcccatgcaccaaatgcgccgagccccaacagccaagccaaaggaaaaaaatacacaccaacaacaaggaacaaaaacaagagacacaacaaggacaacaacaacaaaaacacgacaactcgctcgacggggcgtagacgagggtgcaaacaaaccaagaagaaagaacgaaagaagaacgaaaggaaaaacagagaggagaagaacgaacgaacagcctcaaagagagagaggcaaccaagagaggcaagaccgagaacagcaactgaggactatagtacgcagagagagtaacaagaaacgctcacaaaagtgacggctacaaccagcagagagaaggggatagcgccggacgcaagagatgcagaaagatagagggacgcgaagagaccaactcaggtacgagaagcataatcgacccaggaagacaagagacgaatcatagacaccgccaaacatcaagagaagaaaagaaacgacaagaagaaaagagacacaccacaaacagaccaacgagaagacccaaacacagccaaaaaagacaaagaaagaaaaaagagagcagaggtagaagcgcaggaaaaaaaaagagacagcacaagaccaacccgcaaaaaaaaagaagcagaacaagaacgcaagcccacaaaacaagaagaaagaaagaacccacaaaagaaccacaatgcagaaacacgcaagaagaagaaagaaaaaaacacaacaaaaggaaagacagcaaagagacacaagcaacacaacgaccaacggacaccacaaaacaacaaaacagacaacaacgacaaaacaaccacagcacacc

SEQ ID NO: 542337 - DNA, 932 bp, Homo sapiens
tctctaagatgtgctttaaagtagatagtatactttacattgataaaaaaaaaatcaaatttggttcttcatttgtgtgtgcctgtgagtgttggtctgaaagtgaatgatagtggttgacgtgaatccgcattgtggtatcgattccatactatgcgatgaagtattagtgatactagccatgtaagtagcatggatggcatcctgtggaatgaatggggaaatctgcacctgaaggaacgtgtagaagattatagaagtagctcgcgtaatggaaaaaagtgccctgaatgtattagaacaaactgtacgaattgcttacttcttgtatcggcagacatacgtgaaaatcatattgggggatgtatactatgaagcaatggtctccatgtcttaagttggctgtaactaagtctgaaagaacgagaacacggttttgtaaccttagagtagccctactatatggttgtgctcatatagatccgctaaggtcggcacgtgtctccgagataagaggaggagagatgtttttaaaccctctttctgaagtttgtgtgacctgacatggggctaaatatgggatactaaaaacactaccttggggctaagaaagaaactaggcctgcggagtataaccggtggctcggccttatacgcaccaaaatcccggacggaccgtcgggggctgatcataccaccctggactccagacagcttgccccgcggcagtacaagggcgggggaccaaccccaccagaaccctaagggcacgggacacacagtcagtcggcggcaagcccaaacagacccaccgcgcgccacaacacaacaaaaaacgaggcacaacaccaacgggagcgcacgacagaccaacaccgccaccgcccaaccgccacgccacgcgagacaccacagcgcacggcgcaccgcac

SEQ ID NO: 542338 - DNA, 653 bp, Homo sapiens
tattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctc

SEQ ID NO: 542339 - DNA, 782 bp, Homo sapiens
cacattgctattttcatagtacctatttttgtcttaagaaaatgacattagtttgtaccttcactgatcttatcagaaaattctttaagtattaggcaactcttacactcttggcggcagaaaatagttttccaaattcaatttttcatttgaaaacttgaattttatctttcacaacatatgctgtgtaattgtttttcttgaagtgacacatttacttcattcattttagagaaaatgtccaccaaatacccaagtctgaacaaccatagtttgtctgttagtcattctttcaaataaaaatggtgttacatgaagcaaaaagcaactaattcagttcacaactcaaaggttcacgtaagtgcttttcctggagacaatgatcagacttcagagtgcaccagaagtactttatttctgtttcccattttaacacacaaaatgttagaaagtcttgcagtcaagggtcaagatttaattaaatgaagagtttttacagcttcattaaggagattcttaaataaatttggctttttattccttttcctacaattgtctggcagtgtaatgttttctacttcatgaattcaatgattattattattgttttgtgtccttgccttaatttgtgctaagtaccaggaattttacctaactttgttttataccaaatttggttccgtattacaatggacatggaacatgtcaacagagtgaaaaagacatcttagaattatcatgaaatagttttgagcccctgtgccctctcaaagtgtcccagg

SEQ ID NO: 542340 - DNA, 173 bp, Homo sapiens
taggaatccgtcaagataggaatccctttgccgtggcggtgccgagtttcgcctgaattctataatcacgtaacagcgagtactgtatgtatgtcggtaaactgttgtgacatttcatgaggactatcttgttgccataagaacttccagagagaatctatctctgaaaaaga

SEQ ID NO: 542341 - DNA, 405 bp, Homo sapiens
aaattccctgctgctcttaaatgtgccaaagccaatttcttctgtacgccgactcacaaatgtcttatgtcgcggtgaccagactcaatgtatggcattgttatttagcttcccctatagtatgtgtctatttcacagatagtcatagatgtaggtccgaaaaggcagggcctggcatggctgaacacttcagagttcatacttacgcttacggatggggattaattataatcagatgccctcacccttgtttaggtaatggccgctccacccgtcggcatgcattattctgccctaacatggctagtcacagcagcctgtgatgtgaatgtatgcatcaaagcacttacagttcatgcttatccaagtttaagtcgtttttcccctaatatccaataagatagt

SEQ ID NO: 542342 - DNA, 177 bp, Homo sapiens
gggtacccctcaccaatgaccctgtcctcacaaaaaaaaaaaaaaaaaaagggaagggccaactcttttaagaataaaaaagtttttaaattaattcctaagaatgtgctttagttagtttttattttaagaagaagttttaaaccttctctatatttttaaattgttgggtgtctc

SEQ ID NO: 542343 - DNA, 872 bp, Homo sapiens
  misc_feature (305)..(306): n is a, c, g, or t
  misc_feature (381)..(381): n is a, c, g, or t
  misc_feature (427)..(427): n is a, c, g, or t
  misc_feature (441)..(441): n is a, c, g, or t
  misc_feature (554)..(554): n is a, c, g, or t
  misc_feature (594)..(594): n is a, c, g, or t
  misc_feature (602)..(602): n is a, c, g, or t
  misc_feature (604)..(604): n is a, c, g, or t
  misc_feature (850)..(850): n is a, c, g, or t
tcacccaggcatctcctccatatttatcctccatcccttccatcatcaccattttttttaccaaactccttccatcccttcttcttcatcatttcctccttcatctcctccttctccccatcgccatcccctattcatattgacaaattaaaataataaatacaattcattaattcaaaaaatcatcaaatactaccctaatcaaaatatatccatcacttaatataaaaaccaaaaaatttaatactgcataccaattttctaatatatttactattaataaattacttccattcactttcaannctttttttttttataaatcaagaaaacaattcctcttgttccccttcaatagcatttcaagttgagttaaaaaanaattttgccattaattttacctctattaaaacaaagactacattanaaacttcatcattngtaaaggacgcagctacaagggaacagtatctatcactaagagtggcatcaaatgtcagccctggagttccatgataccacactaacacatcttttttccttctatctatctnggtaaagacctacaggaaaactactgtcgaaatcctctangtgaatangngtgacctggtgtttcacaagcaatccagaggtacgctacgaagtctgtggacattcctcagtgttcagaagttgaatgcatgacctgcaatggggagagttatcgaggtctcatggatcatacagaatcaggcaagatttgtcagcgctgggatcatcagacaccacaccggcacaaattcttgcctgaaagatatcccgacaagggctttgatgataattattgccgcaatcccgatggccagcngaggccatggtgctatactctt

SEQ ID NO: 542344 - DNA, 270 bp, Homo sapiens
  misc_feature (206)..(206): n is a, c, g, or t
  misc_feature (268)..(268): n is a, c, g, or t
catggcccctttgaacacctgctggttattatacagcagccacgtggcatggccatcacctgtggaatagcacagagtaacacacctggttctgagtctcgatgcttcatgcattggttatcagttcattcaggcactgcacggtctagtcaatattctccgggcttagcaaagatccccgtaacttcttaacatatctgctccanagctcttgaggccagaaccctcttcctccttgctggtcttccagatagtcacggatgatgtntg

SEQ ID NO: 542345 - DNA, 365 bp, Homo sapiens
cgtcgacctgaaactgaggaagtctggtcagttatttttactagttgagaatagaacatagtttacatacttgcctacccactagaagagtggttagggagccagaaccacctccccagcattgctgcccagcaccttctgctcacctgtgctacctcaaaacatggcagcaaatctttctgcccatcttgacctctcctactggcatgggctccctggttcttttctggcaaacctgaggcagataggacattacatgactccctagctagggttttccttatgcatgcatttgtgcctgtgtgtgttgtttgtgtgtggggtatgtgtgtgtatgtctgtcacttcagattgtgcgtcgacgc

SEQ ID NO: 542346 - DNA, 5486 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaaaaaaaaaaaaaaaaaaaaaaaaaaaaaaaagggggggggggaaaaatttccgaggggcccatctcccgttttttggacaggggcgcccctaatgagaggcgatttataacgacaaagagcggggccggcgttttaaacaacgttcgtgagtggggaaaaacggtacgtggcgattcttgggagagcggaaaccctattctgggggggtgaaattatttggccaactcaccctaaagaaaaattttaacgcgctttcagggtaaatttacaactttcacggtgatttagggtgttaaccaacgctcatatatatggctgccggtaaaacaaggttggctacaccgaagtattagttttttagaaatttttttaccagaacgttggtataa

SEQ ID NO: 542347 - DNA, 211 bp, Homo sapiens
acggagtcttgccctattgcccaggccgtagtgcagtgtgattacacgcgtgagccaccatgtttggccagaatattcttttttgtaaaattttaatctttaatttcattgtcttgaagagttttatatctaattatattttccatttctccttgagttaattttgtacaaacagtcaataaagattacaagactagtttaagtaaattaa

SEQ ID NO: 542348 - DNA, 5440 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaaaaaaaaaaaaaaaaaaaaaaaaaaaaaaaaaaaaaaggggggaaaaaaaagaaaaattcacacttagaagggagccaaaagaataaaagataacacacggggcgtcctgtgtggagaaaggtggcgccgccatagggggagaggctctatattacaccgcaagcggcctgtggcgccggcaggtaggtgtacacacggtcgtggcggtgggataaacatctgcgaagcggtggcgagcctctttggtgagaggagaccaattacgttctggggaggcggaagcagctaatggggcgcagaacatctacctgcaaggaggaagcacctccaagggcgtcggaga

SEQ ID NO: 542349 - DNA, 5524 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgctgctgggtcaggtggtccagacggctgtggacctgcagctgtggacacacagggacagccacgtccactttggcctggaggacgtgcccctgctgacatggctcctgggctgcctgtccctggtccttgtggtggtgaccaatgagatcgtgaagctacatgagattcgggtccgagtccgctaccagaagcgacagaagctgcagtttgaaactaagctgggcatgaactctcccttctgagccactggctgtggtggctgtagttgcccccgtccctggggctaaagccagacccatttctgaacaggggagtttgtatcatgaatgtttccaggtttgctcctgcacccgtggcactggaaacccagctccccgtgtcagaccccgctgtcttcctgagccctggggctcactgtggaggagctgacggcctgggcccttggccagtcctggctcttccctgggcctcaccagggacactcttgaatgtatggcctcaggcgctccctagagggggcctaaaccccctcacctgtgagctaccccctttagggatcccttgcccccttggagatcccttgccccccagtgcctctgctcgtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaatacctgtggctggtctgtaaggccactccagggtctgcccacccccggcggtggctggcaaagggaggcctaaaccttcctccatctacgcgggtgggtccctcaggtctggctcaggcgagacccctagggtcaggggtccccatgtcacagaggcaaacacacagcccagtcacgtggaatggtgttttcattggtgttagttgggggaagaggttaatggttacagagccagggcctgggccaatggggtcaggctctacctgccctaaggaggggagtcggggattctggtgggggccaaaacccccaccccaaaggtggcctcataaggcaggtgatagaaaaaaattccttttaaattgatcaaataaatgtgaaaattaaaaaaaaaaatctgagggggggggccggaccccaatatcgc

SEQ ID NO: 542350 - DNA, 102 bp, Homo sapiens
tggacgggggggaagggaaatatacacttggctttaatattaaatacttgggcggatgctttggaaattgttaatgccaaagtcttcgccggaggggtcccg

SEQ ID NO: 542351 - DNA, 664 bp, Homo sapiens
gttttgtggtgggaggacagttgggtaagtagacctacagaacctgtaggtgggctgtgtggcacttgtgtagaaagtttactaagagaaaagtcctgtttcaactaatgccagttgtcttaggggcttaagaccaggggctgtctttgctgtgagcaggggtcaaggtattgcagcctccagtgcagacagggctctgtaaacctctggccgtagcccggcggagttgttggctgaacacaaccagagtttggctgcctcagggggaggaggcctcactgaccctcaggtgggggccttctaggtcttgaggcccagactccaccaagcaggggcttgactccttagaaaaatgctggcttgtggctacactttaatttcccttcattttgtgtagagccaagggttgggttaggctaaaacatgatattgttcttttagaagactaggtcggtgtgcaaatttgtctagtatccaaataaaagctgggtgttgctgaaggtttagtttgttgaagtttagatcttatcattacgtcttgttaagggtatgcccagtttagataacccgtcctcccaccacaaacgtgggatccgtgcacgttaacgattactaggacatcggatacctctttgttgtgtttttcttttctttttttgtgttt

SEQ ID NO: 542352 - DNA, 5754 bp, Homo sapiens
  misc_feature (884)..(884): n is a, c, g, or t
ttggtgtggttttgtctccgttttggtttattgttttttggtgtctgtgttcgttccttatctatctgtgttgtgtccctggttccgatgtgcgtgtgttccttgacgtttctcgttgttcgtgtcattttgttgtgtttgcttatctatatgtgttttctaatttttggctgttattgtccttgtgtttttggctcacctgggctcctggtcttttttttttgccctgttttggcttggttcttgttctcgcgtattttttgccctcttgtctagttgttgccgttggcgggggaaattccctttgtttcacgttgtcgttgttacttgctctttgctcgttggctatattttcctggtttattgctctttagattgtctgtggtgcccgttgttcttgttttttctctctctggtgttctattcctgttttccactctctgttcttggtggaccctttttttcttttcttgttttcctcctttcggttcttttgtcccatgttttctggtgtgtcctacatggtccttctcgcttggtctcgacttccatatgggggtctttgtttttcttagctccttctcgttctcttgttgttgttccgttctcttttgctgcttttttttgttggtctcgtgttttcctcgcttgtatagccttgtgcgtgtggtgcttggctatggttcttgttgtgtcttctgctgttcgtcttccctggggtctgtgcctcatgctcctgtttccccttccaaggggtcggtggcccgtaaatgtttggacacaccgattaccgcgcgggtcgcctttcctgtgttgacccctcgtagtagatgatgagagagagtgaccctatgtgttgccaacttttttgtgttttttcgttntttttttcacgtggaatggtgttttcattggtgttagttgggggaagaggttaatggttacagagccagggcctgggccaatggggtcaggctctccctgccctcaggtgggcagtcggggctcctgctgtggtccgaagcccctcccccattgtgtcctctcaggcagttgatagaataaattccatttaaaatatatgcatttctctctgcttagaaaataacatttacaattgaaaagttaggacttgtgggatctgttaaccccactgcctcccacccctgctagccctgcctcagtgagggaaggcgggggcaggagctgcctgggcaccaccgctgtgtatttacatgtcctctgtacacctacggagagggggcccggccagacacacgcctcctccagcctctcagggcctgggcaggatggtgggtggcaagaggcattcccttggcacaacttgggacatgggctggggggtacagagaaagcacccccaaagccccacccctacttcctccctgaggagagagctcttaccagggtccctgtccaggagcagggctgtcctgctcaatcgatcaaaccctgggaggggctttgctgagatgcagcggaggtccctcgctagtcaggttctaaggtgggctgccccacaagagctgtggtgcccacagccgcgggctgagtgggaaggggccctgctaggaggggcacttcagcctgaccagcccttggcccgtccctagggtggcaggggcctcttctgtgctggggcaaaggcagtggacttcggcaggtcacagtgggcactgctggagggctcagtccagcatggcgtccagctggtcagccagggcgtcgaacatggtgctgatgtcatccagaatgtgcttggtggaggcgctgggggtgccctcttgctccttggtgccaatgctcttctctgcggctctcagtgcagctgccagggacgagctggtctgctccagtctctgctgggcctggcctgggcccacagtcccagtgctctcaggccgtggaggaggcactgggcgggggccgagccggggcgctagcttagggccagaaaatgccagctgggtgcaggccaccgacacaggcttgggggctgttcctgctccgggcaccttgaggagggcagcaggggcggccgggggttctgtctccccattccaccgactagctgctgagctttccagacctggccctgggcagggcggcactggaggctgcatggcggggctgggagcaaggggggttggaactccttgggctggaaggctgctgggctcgggctggggaaggctagaagctggaggagactcgccaggagttggggaaggcagtggggcagcggggccaggcgtggcactggccactccgaaggccagcagtgcggtctgcagtggctctctctcccggcacttgggcctccgcttaacagtgtctgattccgtgaggttgaaatcgaggccggggggcacgggtgtctctcggggcggggggccagcgggcttcgggcgctgtttgatggtcaggttcccttcctctgcaaacggcagcccttccccagagctgccccgagatgggggcgtcccctcagggcctggctcctcctcctccgtgtctgacgcgggcccagccggggcaggtgggccagggggctctgaggggccagcaggttcactcagtgttcgccttcggggccctgtggccccttccttgggccctgggctcccatctagtggaggtggctccgggctggggccagagacggagctgaggcgcttggggggcgggggcggggggcctttgcgccgggcccgcagggcaaaggactggctgcgaggagtcccccgagctggggttggggtcacgctaggactggtccggacaagggcactgcgtcctggccgccgggtaagggtagcataactgcctagggtgctgcccactggcccttcggcctccccctcagcatccccctctgtgggccaggcggcttaggctgtgggaccggcgcttaggtcgaggcgggtctgggggagtggcagggggcccggccaagtaggagaaggcccagggtgcgccaggaggtggccctggggccgggctagagggtgagccctgggggtacataaaaacatagggtgggggtccttggccaggaagtgaagaacaaagcttaggggccgctctgtgccctctgggaggttcctctcctggggggggctgggatctccaccgctgggctgtggggcaggctgttcctgtgagtggccagacccccgtgagcgtgccccgatgctctcctggctgggagagcgggcaggtgggagggggagtggttcagggccaccccctgccatggccgcctgtagctctgggcttagttcgctgccctggaaggtgaggagccgtgggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgttgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542353 - DNA, 4322 bp, Homo sapiens
  misc_feature (4224)..(4224): n is a, c, g, or t
  misc_feature (4254)..(4254): n is a, c, g, or t
  misc_feature (4289)..(4289): n is a, c, g, or t
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggagatgctgagcctgtcccaggaccagcagaacccctcctgcatccagtttgatgactccaactggcagctgcacctcacctccctcaaacccctgggcctcaatgtgctgctgaacctgtgtgatgccagcgtcaccgagcgcctgtgccgattctccgaccacctgtgcaacattgccctgcaagagagccacagcgccgtgctgcccgtccatgtgccctggggcctctgcgagcttgcccgcctcattggcttcactcctggggccaaggagcttttcaagcaggagaaccatctggcgctgtaccgcctccccagtgccgagacaatgaaggagacatcgctggggcggctctcctgtgtcaccaagcggcggcctcccctcagccacatagatcagcctcttcattaaagacaccaccaccagcacagagcagatgctgtcccatggcaccgctgatgtggtcttagaggcctgcacagacttctgggacggagctgacatctaccctctctcgggatctgacagaaagaaagtgctggacttctaccagcgagcctgcctgtctgggtattgctctgccttcgcctacaagcccatgaactgcgccctgtcctctcagctcaatggcaagtgcatcgagctggtacaggtgcccggccaaagcagcatcttcaccatgtgcgagctgcccagcaccatccccatcaagcagaacgcccgccgcagcagctggagctctgacgaagggatcggggaggtgctggagaaggaagactgcatgcaggccctgagcggccagatcttcatgggcatggtgtcctcccagtaccaggcccggctggacatcgtgcgcctcattgatgggcttgtcaacgcctgcatccgctttgtctacttctctttggaggatgagctcaaaagcaaggtgtttgcagaaaaaatgggcctggagacaggctggaactgccacatctccctcacacccaatggtgacatgcctggctccgagatccccccctccagccccagccacgcaggctccctgcatgatgacctgaatcaggtgtcccgagatgatgcagaagggctcctcctcatggaggaggagggccactcggacctcatcagcttccagcctacggacagcgacatccccagcttcctggaggactccaaccgggccaagctgccccggggtatccaccaagtgcggccccacctgcagaacattgacaacgtgcccctgctagtgccccttttcaccgactgcaccccagagaccatgtgtgagatgataaagatcatgcaagagtacggggaggtgacctgctgcctgggcagctctgccaacctgcggaacagctgcctcttcctccagagcgacatcagcattgccctggatcccctgtacccatcccgttgctcctgggagacctttggctacgccaccagcatcagcatggcccaggcctcggatggcctttctcccctgcagctgtcagggcagctcaacagcctgccctgttccctgacctttcgccaggaggagaccatcagcatcatccggcttatcgaacaggctcggcatgccacctatggcatccgtaagtgcttcctcttcctgctgcagtgccagctgactcttgtggtcatccagttcctttcttgcctggtccagctgccgccactcctgagtaccaccgacatcctgtggctgtcctgcttttgctaccctctgctcagcatctctctgctggggaagcccccccatagctccatcatgtctatggcaacggggaaaaacctccagtccattcccaagaagacccagcactacttcctgctctgcttcctgctcaagttcagcctcaccatcagctcctgcctcatctgctttggcttcacactgcagagcttctgtgacagctcccgggaccgcaacctcaccaactgctcctccgtcatgctgcccagcaacgacgacagggctccagcctggtttgaggactttgccaatggactgctgtcggctcagaagctcacggccgccctgattgtcctgcacactgtcttcatttccatcacccatgtgcatcgcaccaagcccctgtggagaaagagccccttgaccaacctctggtgggccgtgacagtgcctgtggtgtgagtattgctaggatggagggcggagtgtgggctggggaggagagggccttctgcagggctaggatcggagggcgggaccggggccagtggtttaactgtaccctgcctgagctaactggtgnactgggaagagcagggaaggaagcaagcantgtcgggttcacacggggcccggcaacttctgcangctgctgggtcaagtgggtccaaaacgggttgg

SEQ ID NO: 542354 - DNA, 843 bp, Homo sapiens
cctgcccgtccaatccagcgtctattcgtactctcctcgctatcccattgccgttgcactgccctccatcttcccttctactgtccatcttatcatcccacgatgacacatgattagatcacaccacatacaggctgcattgcgtcgaggtacaaccggccttacacatggcgcttgcgtgttgccacttgctagacgcttgtgactcccaggccagactgctgctgcaacaggattgtattgtctgctacatctcagatgcgccacgaattattctcacagagctggcgatactcactgtgccagaatattcattgctcaatggctcatactagacctgggtcatgtccgtcccactatataaacgtgcggttgtccttgttcccgggatacatttaaaatcagatacatagctcacagcgcaatccacatcacatatacaatatccaataggaaaggagcactagccggactgacctgcttgggaagtatagcagactgcagttcatgtcacatctcgtccccgcggtcccctgaaaagccaattctgtctgttgatgccgaaaaggctcctatagcaaccactttaggactaggatccttggcttgaggtggtattgtataggacgccgatgcgttcgctattaaccagacctacgctattcaaacgaggtgctaatcaatagacttcatcggcttcatttggcataaacacatgctatgtttgtacttttcacccgcagaatagcagattctaaggcatcacgtggtttgcaccccccggcttgccacaattcgcacactaacagccccgcttcattttctctctaacccgacccttgc

SEQ ID NO: 542355 - DNA, 107 bp, Homo sapiens
aattttttgtgcatgtagtgagagactgaagtctcattacattcttttgcatatggatatctagtttttccagcaccatttattgaagacagtacctttttcccaat

SEQ ID NO: 542356 - DNA, 2324 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaagacccagcctgggatggagagcgacccctacgaagcagaggactttgtgtgtgactaccacctggtgggtccctggacacggccttgaagccaaccttctttggaggagcaacagcagcagccttggccgacgcgtccaactcccaaggctgccgtggagggcaggggggtggtgcttgcctggatgtggccccgagtgcctcccctccctccctctgtgggggagtctcccgcctgaacctgaagatggagcagggcccccgcttcgccctggagcctcttcctgtgcctggctcaagctggctgcctgtcagtcttggggaatctggcccaggtctcctcagcctctgccccagttctgggagaagtttctactggtgtatattttttactggaaatgagccttttaggaatgaatgtagactggtttgtattaaaatgtgtcaattgctaagaaa

SEQ ID NO: 542357 - DNA, 417 bp, Homo sapiens
tattaaaaaaaaatgtaactaattaaaaagggggtcaccaaaaaaaagcaaaaatgtaggtattttcccaatgtcaccctccctccattaaaaaatgactcataatcccgggaggagtgacctcccctccgaagtaatggaaaactgttatttattggcagggaaatcccatctggtggtgtagctagaggtcttaatcccccttctggccacgtattagaggttcgctcagggctggccactttttggaccacctgggggttcccacgtctgcccctgtgtcccagagagagtctcatccgattacaagggcagttttgcgtggccagctggcaggaccccattgcccacgcgatgggctgtgtactcttggggggaactgatttccaaagggtccatgtcctctatagtcatctg

SEQ ID NO: 542358 - DNA, 2263 bp, Homo sapiens
  misc_feature (2018)..(2018): n is a, c, g, or t
  misc_feature (2245)..(2245): n is a, c, g, or t
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggatgacgagcacatcgtcctggagccgggagacctcttcccccccttctcccctccaccctcaccccggggagaagtggagagagggccacagagcccccagcagcaccggcttttccgtgtccttgagacccctgtgattgacaacatcagatggtgcctggacatggccctgtcccgaccagtcactgccctggacaatgagcggttcacagtgcagtcggtgatgctacactatgctgtgcccgtggtcctggccggcttcctcatcaccaatgccctgcgcttcatcttcagtgccccgggggtcacttcctggcagtacaccctcctccagctccaggtgaatggcgtcctgcccatcctccccctgctctttccagtcctctgggttctggcaactgcctgtggagaggcccgtgtcctggcccagatgagcaaggcctcacccagctccctgctggctaagttctcagaggatactctcagcagctatacggaggctgtctcctctcaggaaatgctgcgctgcatttggggccacttcctgagggtgctcggggggacatcgccaacgctgagccacagttccagcctgctgcacagcctgggctctgtcacggtcctgtgctgtgtggacaaacaggggatcctgtcatggccaaatcccagcccagagactgtactgttcttcagcgggaaggtggagccccctcacagcagccatgaggacctcaccgatggcctatccacccgctccttctgccatcccgagccccatgaacgagacgccctcctggctggctccctgaacaacaccctgcacctttccaatgagcaggagcgtggcgactggcctggcgaggctcccaagccccccgagccctattcacaccacaaagcgcatggccgcagcaaacacccatctggctccaacgtgagcttcagcagggacaccgagggtggtgaagaagagcccagcaaggtgacgggagggggtggcacggggcagccacaccctcggccacaggctgtcctggcctccctggccagcctggcctcacaaggtctaaaagagcaggcgtctctgccctctgtcccagcacctccaggctaggccagtggtccctgaggcnctccccaagtctgctgcgaagtaggtggagcctccccctacccttccattcttgtaatcgcaatcactggtgtccctactggaaccttccaaatatacacagcccggagctccctcttagagatgttctctggccacagaagatccctcaactgtgtcctctttggtctggccacccctctttttagctcctgccagtgtcatgagatatattaatagtcatagaanagacaggagcccagaagg

SEQ ID NO: 542359 - DNA, 171 bp, Homo sapiens
ctagccccctgacatcttccgtttccgccgtttgctagggctgctgacgtgtgggctccgcagggggtgctaccatgcgctgccacttctggaaaaggggcaggttgaaacaggtgggtcaggaaaggcctcactgagtgggacatggaaggaaggcacttgaaagagctg

SEQ ID NO: 542360 - DNA, 971 bp, Homo sapiens
actttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcatgcctgcagtactcttggcccatggacctgaaggagaagcacctgggcgagcctccctcagccctgggcctgtccacgcggaaggccctcagcgtcctgaaggagcagctggaggcagtgctggaaggacatctcagggagcggaagaagtgtctgacgtggaaggaggtgtggagaagcagcttcctccaccacagtaaccgctgctcctgcttccactggccgggggcctcactcatgctactggccgtgctgctgctgctgggctgctgcgggggacagccagccgggagccgtggggtggggctggtgaatgcctcggccttgttcctgttactgcttctcaaccttgtgctcatcgggcggcaagaccggctgaagcgtcgggaggtagagcggaggctgcgagggatcattgaccaaatccaagatgccctcagggatggcagggagatccagtggcccagtgccatgtatccagacctccacatgccttttgcgccatcctggtccttgcactgggcctacagagacggacacctggtcaacctgccagtcagcctgctggttgaaggagacatcatagctttgaggcctggccaggaatcgtttgcttctctgagggggatcaaggacacggaaaagccggtgctgctgggggctctgtggccctctctccacttctccccggggtgagggtggaggggagaagggggggaag

SEQ ID NO: 542361 - DNA, 185 bp, Homo sapiens
tgatctacagtgcatcataatcatatgccttatcagcgttggatcctctatcagatcgaactgcagtgcctgcaagtcagagtcactgtacgacgttgtacagagacatgaccgtgattgccctgtcgaaactccacagctcttaaaaataagcacttatccctaacatggccttatcttggtgt

SEQ ID NO: 542362 - DNA, 219 bp, Homo sapiens
gtgatgtctttggtaacaggcggggtaagcattagccgcagtacctttcactatatttaacctttccttatgagcatgcctgtgttgggtagacagtgcagggtaataatgcacttgctggttgattgtcagatcattgggctgttacatatgtcagttcagttgtatacaatctgcactgcaggcttatgcggacggacgacactgttttcactgtta

SEQ ID NO: 542363 - DNA, 2670 bp, Homo sapiens
  misc_feature (1)..(1): n is a, c, g, or t
  misc_feature (442)..(442): n is a, c, g, or t
  misc_feature (446)..(447): n is a, c, g, or t
  misc_feature (449)..(449): n is a, c, g, or t
ntgccctttctgggccaccccggggccgactccggctggaccgccgtggaggggatgtcagccccccctgcatgcccccctagctctggcttattcctgcctggaagtgaggacctggccagctgtagctgggccttctccgttctccagtccctcgatggccatcagctccggacccttggccagccggcgcccgccttcgctgagggcctccccctgcagcaggccccgccgaagctccgccagccgcttcacccccagcatgagcttcttctgatgcccgagcttgttgaccccaatctcctgcagctcctcccaggtgaggtcggccaccagccccatggagtcgtagccgctgctcaccagctgcttgtggtactgtggcagccccagtgcacacagccactccagcaggtccgtctggaagagcaccgtcctcagnacanntnccagccagcctccgcccccagccagaggagaaaaggcaccgcaaagccacagctgagggcgacagcacgtgccccactccccagccacccttgatggctcactgggatgtagctgggcagccactcggcgatgctgagctgagcgatctctgaggcgatcttcttcctgtgcccaggcttggtcaccccgatggccgtcaggtcctcaggtgtcatgcggctgatggtaggcacatcatagccggcctgcagaaagtgggcagtgtagccctccagctggaactcgcttagccagttatgaatggcctgcgcgtccttcccctccagcagctgttctggccgcacgtcctgggtgaagatctgctccccagagcggcagttggccagagggcggtggctcaggttgtctgccagggacggcgggtggagtcctggcagcacctggtcctctccagcagagggcagtggctgggcgttctcaatcaggaggccagggccatggccattagtgccctcagagctctgcccgctgccggcactgcggatgctgcccacgctgccctcactgcccacactattcctgtcacctgctgggctgtctgggctgaggcccacccgaggaagctggctgtaggtaagagggtgcgggggttcttcggcaggaggctgcggtgtccgggagaagcctgggcgcaggggggtgggtgcggaggggaggcgggctgcagggatgcccacccgcttgctgaccacctcgacaatgcccggggggaagtagcctatgcggtctgtgcccctctggctctcgtggatgtggcccttccagcggccgtcgggatgctgttctagcaccgtgatgacatcccctgcccggacattgagagcagtgggatcgtggaggttccagaaatccttgagcgctcggaccttcaggatccctgaggcctcccgcagtagctgcttgatttcccggctggcctgggaggtggtgaactgattcactatgtccagcgccgtctggttatacgtattccggatgttcacgtccacacctccctccagaagcagccgcaccacctcggtcttgccatacagtgcggcctcgtggagcgccgtacccgtcttggtctggcggttgatctcgatcccagctctcaggagctgcctgatgacttctctgtggccattcttggcagccaagtgcaggggcgtggtgtagttggggtcacacgggtctttggcctcaccctccagcagtgccacacataagtggctgttcagaagcagctgggccaccttgagtcggccaaattcacaggccaggtccaggggcgtcttcttggccttgttgaccaggcatgggttggactgatgctggaggagcatttctgacacctcataatgtccatactgtgcagccaggtgcagggggatctgtccgtccagcgaggcggcattgacagccgcagaggcgcgcagcagcagcctcacaggctccagccggccctgccaggctgcgtagtgcagcgggcgcatgccattgctgtccttgatgtcaacagtggcctgagcctctagcagcaaggctatgagctccaggctgccccccaaagcagcgtggtggagggcagagaatccatcagcatcctggtagttcacgttgagcctctttgtggagcccaggagctttgtcttgtggccttgaccttcgccaccagtttctgcacaccggtcacatctccattcttgacggcgaggatcaggtcctgttcacgacccatactggctcctgggctgagctctacactcaggagtccagggcaaaggcaggcaacgggtccaagctggggcgtcagggcgccatgccacagccccttggagggctcccggttccgggggagcaagtctggtgtcccaggcagtgggctcctcgtcaggtactgagggatactcccaaaggtgctccgtgaactgccaccacacgaaggaaagctaatctttgagggggtgaaggctacatggaaatctggatggatatcagcttgtggcttccgacagctccaggatgggctgggactgggcacaccaatcttcccggcttggctgtggaacaccagtgcccacccagagagcagccagcattcccttgggcctcaggcagcagcggtgcactggtctcagggctctctcccgccgcccgccgggtccggctgcctgctcg

SEQ ID NO: 542364 - DNA, 1200 bp, Homo sapiens
  misc_feature (491)..(491): n is a, c, g, or t
  misc_feature (494)..(494): n is a, c, g, or t
  misc_feature (551)..(551): n is a, c, g, or t
  misc_feature (624)..(624): n is a, c, g, or t
gccaatctctcgcacttctgttcttcctgacgggtccgccgttcgcgtttctctgccggtcgacaatggaggaagagatcggcgtcgctggtcattgacaatggcttccggctatgttgcaaacgcgtggcttttgactggggactgatcgcttcacaccgagaccgttgtgtccattcgcatcgatcgggcgtcgcgccagagatccatgggccagttcaatggggtgcgtgcactgggtgaccgacgtacaggtagcgtccatgagcgtggggccgatcggaggtgctcccaagatgtcaaggcccgatgagccaagttcgcattggaacgcgcatgaacacgtaacgcaccgagtatgatgtcattggccagtctgatacaacctagacttggtgaagcgaccatgggtatggaacgtatgctcggacagccaacaacgcttgctagcgacaggagtctgggcgtcggttgggcacgccgcgtatggnagncgatccgcagcatgactgggtgggagcccgagggccccgcccctgaacccgcaaggncccaaccagaagagacggatcggactcaggattgactgttgtcgagagccttcagacatcccccggcacatcngtacgtgtgcccattccagggcctgttgcttgtgcccttctttacgcgcttcttgggccggcacccactgggcgatttgtgcatgtgacgtccttggagaccggggtcacgccaacactggtgccccatcttacgaagggcttacgcccgtctccccaagccagtccttgcgtcttggaccttggctgggccggggacctgtacgaatacctcattgaagatcctccatagagcgagggtacaggttcacaaccaagggcgagacgggaaatcgtgcgcgaacttccggggaaactgggctacgtcgcccgggattctcagcccggatgggccccgcggatatatcctctttttttgcgaaaaagtttcaaatgtcccaaggcccggtttcaccatggacaagacgggtccccggtacccgaacgcgggtctacacccctacacgggggaagacacctgcggaccccaagaaccttctaccacaaagagaggagaccccaaacgttgccacagcgcatccggagcccacataccgcttcacaggcagagagaccgcgcaccagaaaaacctccggg

SEQ ID NO: 542365 - DNA, 1351 bp, Homo sapiens
tgtttctccttttatcatgtgtatctgtcggtgggtctctctttgacagtgcggagtgtgcctcgttgtgttgtctgtgcttgttactactctatggtgtccccttgtggcgggctctctgtgtctgcccaagtattgggggcacaccctttattttggccggtaccagttttgtggtacgaacaccgtgtaaacaatcttgttataatttgtgcccccgccgtgataacacaattgggggaacccctcttatagtctcctccgggggttcaatggcgtgcgacgaaaccagcttgtagaatatgctcccctgttaagtggtgttccccctttttgggagatgttagagcaaaaccgggggggaaaacctccttgggaatttgccgttccgagcgccctttttgtgtaaaagaccactgcaaagaattttcttatgagggtgaatccgcactattacacactgttaaatgttaaacactgggggatagccttttgcacataccacgtgttaggtgctccccggtgtgcccaagtaccccgttgcgtacgaaagcttcacttccactgggaggtcatttcccctctccccaagtgcctttttttggaaaaaggggaaacccccattaaattgaaggaggatatcccccgggggtataaagcggtttataggaaaaaggtgttctgttcattcaacacccaaacccctcttgccacaccacggaatagttgttatattggagagatgaacccttgggtacaatatgtgaagaagaattgttgggaagaacgcctcttaagtgcacttttttacagttgtccacactctgggaagccactctggaaggaaccaccacccacaaagaggaaaagcgttctttggaatatgaacgccaagggtgccacacccgctgtttttagcccacgcccaccacagcgctgttgcacaccacaacacaggtgaaagaaatgtagcccctcggagtcacaaaccacctattataaatgtggaaaactacccaaggaaaggttttccacttaataacttttataaagtcactttgaagggcttctggcttctcgtggcttttgtgggttaaagtaacttgtctggccaaccacggagatgcctggagtttcacaatcccacgcacgggcctcacctacattgacggtatttgaaatttgaacacacgaatgttttggctctcggctgggtctggtggctcaccacacccgtaaatccccgccctttgggaggctgagcccggaggatcacttgaggtcacggaatttgagacccgtgtgccaaacactagcacagacctcatctcccaaaaaataaaaaaataaa

SEQ ID NO: 542366 - DNA, 320 bp, Homo sapiens
ccttcacgcacatacccgtggccacctgagacctgctccacgacccttccatgtagagccgagagtttgccccaacccttccccaggcccagtgctttatacatatttacaaggggtttcttggcctgcagctttatttgcgatagtgtcgaggcagtatacagactacagctgtgctggaagtgtgggtagtacccggacagctcagtcctgccagcagccgcaaagagccgaggctgccaggcccatttatgtccctcatgtctctagattttctcgtcacccagcctcaaaaatatatgtgtctgcacccctcagtc

SEQ ID NO: 542367 - DNA, 325 bp, Homo sapiens
agaaatgttaatcagattgtctttctgaaatttgtattatcagctttgtaattgaggaatatacagccaatttcttcggatggcggcattctcaaggaattaattccttattgttcagaaaatctagaataatttcttcattcctggccttgctgttacctgcctggtcagcattctctttttagtgatgtaactatattatcattatttcaaaaaataccaggtacccacctcttcccactattttttctttaagttgactgcattatctttaaattgtttttaattccaaattaataaatgatacattgagaatttcttaaaa

SEQ ID NO: 542368 - DNA, 394 bp, Homo sapiens
tgttcccttgtctcagcctcccgagtagctgggactacaggcgctgccaccacgcctggctaattttttttggtatttttagtagagacggggtttcactgtgttagccaggatggtctcaatcttctggcctcctgatctacccgcctcagcctccagaagtgctgggattacaggcgtgagccaccatgccgggccaggagctaaacggttttaaagaggtaaaagttaagactcatggtgagtatattttagtttcattttctgacttttatgcctttatggtctgggaaaagacatagtaatttgggagtacttaaactttattttctaaatattaagccccattttacggcagtgtggctggtccatggcagtgccaagattagaagta

SEQ ID NO: 542369 - DNA, 520 bp, Homo sapiens
  misc_feature (386)..(386): n is a, c, g, or t
  misc_feature (396)..(396): n is a, c, g, or t
  misc_feature (430)..(430): n is a, c, g, or t
  misc_feature (444)..(445): n is a, c, g, or t
  misc_feature (467)..(467): n is a, c, g, or t
  misc_feature (482)..(482): n is a, c, g, or t
  misc_feature (491)..(491): n is a, c, g, or t
  misc_feature (496)..(496): n is a, c, g, or t
aactggatcctgcaccagtgcactcaagacgtctcaacactgcttcttgagccacacccgcatcctcaaggtgggtgacttctggctggcgcgggagtacggatcccctcttgaaggcctacacccccgctccttggtgaccctgtggttccgcgccccagaacttctgctttgttcccaaaggaatactccacggccgtggacatgtggtcactgggttgcatcttcggggagctgctgactcagaagctctgttcccgggaagtcagatatcgatcagatcaacaaggtgttcaaggatctggggacccctagtgagaaaatctggcccggctacagcgagctcccagcagtcaagaagatgaccttcagcgagcacccctacnacaacctccncaagcacttcggggctctgctctcagaccagggnttcgacctcatgannaagttcctgacctacttccccnggaggaggatcagcnctgaggacngcctnaagcatgagtatttccctgaatac

SEQ ID NO: 542370 - DNA, 301 bp, Homo sapiens
  misc_feature (28)..(29): n is a, c, g, or t
  misc_feature (31)..(31): n is a, c, g, or t
gtgaataagctgagtcccataccacacnngnaaggttttaataaatctaatcctatttctacttaaagtatggttttcagacagtgctggtgcttctgcttcttaagttcatcaagggaatgaggagtcttgtccttctcctcctctttaaaatcttttccactttctccttcaggattaaagattttgctgcacaattgttaatttgtaaggttaaatttggacaaatattcaaagcacacataggcatataagtaaggagaaaaatgttccaggggagtaggttgggcagtgacaggac

SEQ ID NO: 542371 - DNA, 455 bp, Homo sapiens
tcctcggtcctgcagctctctctgatgatgagtgctactgttcttaaatgctggtatgtcccggacgtttgttctttctgatgttcagacgtgtttggagtttcttccttctggtggatttgtggtctcactggcttcaggagtgaagctgcagactttcacagtgagtattacacctcttaaggcagcgcgtctggagttactcattcctcccatgggttcatggtctcggtggcctcaggattgaggctgcagagtttcacgaagagtgttacagctcataaactcagtgtgtacccaaagaatgagcagcagcaagttacctcaaagatcaaaaaaaacaaaactcccatagcgtgagggtggaagagaacctgagccagttgccactactaagcgcaggaagcctgtttttattcccttttctgacccaacccacatcctgctgatgtggc

SEQ ID NO: 542372 - DNA, 143 bp, Homo sapiens
gccccgcatccaataggcatcctgcccgaatcaaccctgcactcctctcattctctcgttatgcagcttcctacactattaaagtttaccgcaagcatcaccccatcatactctttcacctacagcaccgatcctacctccat

SEQ ID NO: 542373 - DNA, 205 bp, Homo sapiens
aatgataggtcatgccagagccagtggtccgggccgacaccaaagaggagttctgaatccaaatagcagacagatgagatccgggtggtggtctagtacgagtgtggggctaagttttgtcccgaatttctgggtgaggcactgtcgccttcccggggtgaaggacatcaaggaccattggtgtccccggaagattgcgtggtgg

SEQ ID NO: 542374 - DNA, 655 bp, Homo sapiens
cttagttaaaaacagaaagttaatctttctgaaagacagttggaaagttgatcaccgggtgcaagggttgattggaatcttaggaagcaaacccacagagacaccaggaaggatgtggcatctctggtaaacttgaaacaaggcatgcacttacaggttccctattattaacctcattttggacataaagtggctggattaatttcctgtggctgctgtaacaaatcaccataaacgtagtagtttaaaatgacagaaatgtattttctggcagttttgaaggccagaagtctgaagtctgatagtatcactgggcccaaataaaggtgttggcagggtactccctctgtaggttctatagaagaagacattccttgcctctttcagcttctggtgagagcaggcactccttggcttgtggctgcatccctgcagccttcaacgccagcatcttcaggtctctctctgctccatcttcacatcaccttctcctctgtatgcagtaaaatctcctccttcatccctcttataaggtacatgtgattacctgtagtgcctacccagataatctaggataaactccctatctcataatacttaatcacatctgcaaggacctccctccctttttgctatatcaggaaatacgcacagg

SEQ ID NO: 542375 - DNA, 845 bp, Homo sapiens
  misc_feature (41)..(41): n is a, c, g, or t
cgacaaaggaggcctaaattgagttgcatacggtgtcgcanagggacctttctattaagcccttgatttttatggattatggaaaggaaataaggcacaaccccagctttttctttctttagagttcatcagctgttgatgtggttcttttttgtgtttaaacaaaagaaagtgcaactatccaaacctacctaaattataggagtaatatttccccttctggctgatttttaaagtataccatacctcatacagtactttaccagccagcttaaatggagataaagttgaaatcactagaagatgcccatgacctttccaaatcgcaccccatgtgttctgaaactgttcgctgactaataccctgcatctgtgatccatgaactatgtggttttgaatcggatgtagacccttagtactactacttgagctaaacttctgcctggttcataatttttaaagtgtgtagttaatatgcactgttatcgtcctttcttccacttcttaaccacgtatgtgcccactttgccaaaccaaaatgctcataatcacgtaatagtcctataaaagatgttaacctctgtttagtcacttgagctgatcttgctctaaccttaaaattttgtgattattgacctctgttgcatttatttctaaagccccccccaaattatctagccgctttcgaatatcaacattaccctggtgtattcactgctgtatgcattattgttctttgttgctgttttatgccttcatattagccaatatgaaattctgtgaaaaaaaaccctttgatccttaaaaaaaataaaaccaccccccccttctgtagcagacacac

SEQ ID NO: 542376 - DNA, 355 bp, Homo sapiens
tgcacgagtccaacttccattcttaccagtatgtgcccatttgcaaaacaaacatgctactacttattaatacacctataccctacttctaacctgcctgttcttatgctgatcttgctctaaccttaaaattttgtgattattgacctctgttgcatttatttctaaagccccccccaaattatctagccgctttcgaatatcaacattaccctggtgtattcactgctgtatgcattattgttctttgttgctgttttatgccttcatattagccaatatgaaattctgtgaaaaaaaaccctttgatccttaaaaaaaataaaaccaccccccccttctgtagcagacacac

SEQ ID NO: 542377 - DNA, 1226 bp, Homo sapiens
  misc_feature (1219)..(1219): n is a, c, g, or t
agcggactgacgtccctgcggggctcctcctgagcgtccctcctgccagccaggtcgcagccgcagcggcggccgcagctcttagcccacacaggacttgtaaactcttactgcacccttctctccattaggagcttttcctccctccttccccccaacccctctgtcctcctcactttggggaatttaatgctttctttagcatctttttgtgtgcgtgatctaggggaggagacaccccagagctccaactagctctcagctgaattctacttttgtttttatgtcttcctcgcctcctctcgtgtccctcttatctgactgatctgcgaagtctgatgcttctgccagagggagaggaataaatagatgttgctgcttccgaaggcttagacgttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctatttagagctacacagaagacctatttccggaacaattacaactatgtcattcgggctanagtaaag

SEQ ID NO: 542378 - DNA, 1174 bp, Homo sapiens
  misc_feature (1167)..(1167): n is a, c, g, or t
agcggactgacgtccctgcggggctcctcctgagcgtccctcctgccagccaggtcgcagccgcagcggcggccgcagctcttagcccacacaggacttgtaaactcttactgcacccttctctccattaggagcttttcctccctccttccccccaacccctctgtcctcctcactttggggaatttaatgctttctttagcatctttttgtgtgcgtgatctaggggaggagacaccccagagctccaactagctctcagctgaattctacttttgtttttatgtcttcctcgcctcctctcgtgtccctcttatctgactgatctgcgaagtctgatgcttctgccagagggagaggaataaatagatgttgctgcttccgaaggcttagacgttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctatttagagctacacagaagacctatttccggaacaattacaactatgtcattcgggctanagtaaag

SEQ ID NO: 542379 - DNA, 229 bp, Homo sapiens
gatctagaggtccctggcgtacggacgcatcaagctgttggatggccgggtaagcaactgatggcagatcagcaagcgcgcaccgagcaggatttcgtgatgttcagccacccgaacctctttgtcagcgatgtcgcggaatacgcgcaaaacatcggcgcgcaagcggatggcaagaaggtcctggctttctttcccaagctcgacccgcgcagggcgtccgtagcgg

SEQ ID NO: 542380 - DNA, 955 bp, Homo sapiens
  misc_feature (88)..(88): n is a, c, g, or t
caaatggttgcacgagtcgtggtccctagagtcatgccctctgcgtgcctgtgccgaatctggggcatagtatgcgtatacgcatatnttgggagagttgacacgcggaaaggtttaccagatcaaagccgggtgtgaataacggggcctaactttaatgtcagcgccctagttgagtttgagtgccccactttgagagcctcgccaacgtttgtaaaacttgtggttgcaaacgcagaggatattttcggggaaactgtgcccaaataaggttgtgccaaagggaactgtgggaacacgagaaagagtggggtccccgattcaacggtaacttcaagtggggaactcctgtgaggaaaccacaggagtaaggacccaacaatctgtgttagaaggagaaaacatgggacaatgctgaacaatgtggtcaagttaccaaagaacactgcccaatccaagggggacattctcccccgcccccaagtgatgaaaagccaaggatggtgccagaggaatggccccccccgcccggctggttacacgccagaataagtgtcacgaaaagcccatcctactccagatggcgcacccccagagaagagaggatcgtctccccgcgccaagaagttcaagcgtgtctcacatccacatctcatcgctcaccggaggcagccgctgcggcctataatctgcgtcacgacgccccaagtcgtcacgcgccagacattgtggaccaaacatcgtgcgtgcccaacatccagatcggaaatgtacaagaggaatgggcgaaacttaatccccagcggccacccgtctgcgacaagatttcccccaggggcagtctaacaggagacggcctgtttccccgccgaccagcaaacgagacctaccaacaaccaaatagaaggcaaaggggggcaaaaataaaaagagggaggcccacaaaaaacaaaac

SEQ ID NO: 542381 - DNA, 140 bp, Homo sapiens
agcatctcccactgcagcctccaagtgacacagtacatgccagcacccctggctaatttttaaaatttttttttgtagagacgtggtctcactatgttacttaggctggtcttgaattcctgggcttaagggacccttgg

SEQ ID NO: 542382 - DNA, 249 bp, Homo sapiens
gagaatggcgtgaacccaggaggcagagcttgcattgagccaagatcacgccaccgcactccagcctgggtgacagagcgagactccatcccccgaaaaaaaaaggacaaaaaaaatttgtgtcacacaggccagatgcagtggctcatgcttataatcccagcattttgaaaggcaaggtaagaggatcgcttgagcttgagtctgaggccgcagtgagctatgaccacaccactgcacccagtctgg

SEQ ID NO: 542383 - DNA, 255 bp, Homo sapiens
agtctggagacgacgtgccagaaaatggccacctcgaaaaggggaaggggaaaagaagggaggaacaggtcataagcctcggacctcaggtggcttaagggagaaaatgtatttggtgtctgccatatctttgaatccttcaatgacacttttgtccatgtcactgatctttctggcagggaaaccatcttccgtgtgactggtgggatgaaggaaaggaaacccagaatgaatccaaccattgctgctattttg

SEQ ID NO: 542384 - DNA, 124 bp, Homo sapiens
caaaattggataaacttaaagctgagcttgaaacgttggtatcaccatttgatatcttccttgtgggaaattttgagaccagcaaggaccattgtgactattcatttgatgccccaggacaaca

SEQ ID NO: 542385 - DNA, 323 bp, Homo sapiens
  misc_feature (140)..(141): n is a, c, g, or t
  misc_feature (204)..(204): n is a, c, g, or t
  misc_feature (226)..(226): n is a, c, g, or t
  misc_feature (262)..(262): n is a, c, g, or t
  misc_feature (264)..(264): n is a, c, g, or t
  misc_feature (270)..(270): n is a, c, g, or t
  misc_feature (272)..(272): n is a, c, g, or t
  misc_feature (274)..(274): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (310)..(310): n is a, c, g, or t
  misc_feature (316)..(316): n is a, c, g, or t
gtccagcccccagctgtgggggcccatggccattttccttttggggttgcaaagatgatgaaagctgtgtggcccccccccccaccttgcccccggccccccaaagtgtccccattggaccaaagactgaccccccccanntggggtgcccaggggcagggccggccccccagggagggggcctgcattggctgcaaggatgancaaagaacaaggacaaaggccnggccctgaggccctggagacagctgttccccttgcncncacgcncncnctcatgntcncncccccagagatatattaaagcccnagtttntttttga

SEQ ID NO: 542386 - DNA, 335 bp, Homo sapiens
acatctctgtatgcctccacgtatccagtggctatgggggtgcagtggtttcggcgagtggcttatcgcctgggtggaggaagcagctactcgtatagtcagtggtcttgtgtgttggaggtggcttcatggtccacgcagtggcagagccattgcgtggtgggctcagctactgttggacggcggcagttccaccatccagtacaccgatcaactcctcctccagcgggaagagctataagcgactagagtgcgtctgttagctctcggtcccacagtcctcaggcccctctctggctgcagagccctctcctcatgttgcctttcggagaaga

SEQ ID NO: 542387 - DNA, 547 bp, Homo sapiens
gatctagaggatccctccggttcgcgaagactgttggccaatgatatatgaaaaaatgctcacatcagtaatcatcaggtaaatacaaatcaaaactacaatgagatagcaccttaccacagttaggataactattattaaaaacacaaacaacagaagatggcaaggatgcggagaaaagggaactcttatacactgggatggaaattagtaaagccattatgaaaaacagtacggagatttctcaaaacactaaaaatagaactactacatacttcagcaatcccactactggctatttatccaaaggaaaagaattcagtattatcaaagggatacatacactcacctgtttaccacagcactatttacaaaagcaaggatatagaatcaacctaagtatccatcaatgagcagagagataaagaaaacgtggcatgtatacacaatggaatgctattcagccagaaagaagaataaaatgtttgcagcaacatgggtgaagctggaggtcattatgttaagtgaaataagccatgccaagcag

SEQ ID NO: 542388 - DNA, 348 bp, Homo sapiens
  misc_feature (4)..(4): n is a, c, g, or t
  misc_feature (101)..(101): n is a, c, g, or t
  misc_feature (109)..(109): n is a, c, g, or t
  misc_feature (201)..(202): n is a, c, g, or t
  misc_feature (262)..(262): n is a, c, g, or t
  misc_feature (268)..(268): n is a, c, g, or t
  misc_feature (318)..(318): n is a, c, g, or t
  misc_feature (331)..(331): n is a, c, g, or t
  misc_feature (335)..(335): n is a, c, g, or t
tttntatataactctatagttgggttgttgtaaaatcctttaacataattgacaaaaattccatatgattaaataccgaaaataaagtactgtgttaaacnattatagntatttgcccactcatgtttacagcagcattattcacaatagccaagggatgggggcaacccaaacgtccaccaacagatggatgggtaaccnnatgtggtaaatacatgcagtgggatattattccgccttaacatggcggggcatcctatcncattcnacaatatgggtggaccttgggggcattatgttaagtgaaatatgtcagcnacaaaagggcaantccngtatggttccctt

SEQ ID NO: 542389 - DNA, 132 bp, Homo sapiens
atatctattgctgtgtatatattaatacgcgatgcgcgatgtctggcgttgtatcacgtcacccagcaagtggtcgcagtaagcttcccctgcaggccctaggtctgactcttaacctcacactatcatatg

SEQ ID NO: 542390 - DNA, 336 bp, Homo sapiens
ttcttttcatgttgtcctctattcatgccctcacttccttctttacctcacttatacataatttccgagttcagcccttatgatcagtcatcgtatgctcttcagctctctggctcttctctccttccttatactctgtagggaaaactccagccctggtgaattgaactctctgcttcctccagggactgtagctggccagctgaacatgactgggacaaaaaacaagggcgtggtaagtgacctaaacaaacacatgcatagtcaaccaactaaactttactccctctacctcattcaagcatgtaggaaaacctataacagacactgctgtgg

SEQ ID NO: 542391 - DNA, 439 bp, Homo sapiens
gttctagccatagaaagactgtatgcaccgtagtgcctatttacacagaaggagcttcgagagaagggatgtagctcgtttctcactacgtgccctgtcctagcctcgctctaggacccaggactaggctgctaagttcccgtccagtcttcagagcaagtactgtgttagtcatgcacacacatacctatcaaaccttggagttagcaaagaattgccccagctctgggcaccctgtgccaccctggtcctgtggatccccttcgtcccacctggtccaccccagatgctgaggatgggggagctcaggcggggcctcatgctctcggggatgggaatgtgtttttctcccagacttgttttatatggctctgcttgaagggctgggagatgaggtgggtctggatcttttctcagagcgtctccattctatggtagt

SEQ ID NO: 542392 - DNA, 951 bp, Homo sapiens
catatcagagcacttcatcgcctacaagaagttccccatgaggttccaagtgtgtgacttgctagtggtcagatccaaggatgagtcgtaggatgagttgggggtatatctcactcgagcagctgtgttacaccgtttggcgcaagatatttctgagacatttaatcattgccaatggcctcacgttcggtgtctagagctcaccagctaggtgatggcgggactataactggtagccatgagcggaatgtagataaggattatcagtgctctaaagtgcatggttatcagttgtggaaaatcaatcgtgctattcatggtacttgacgaatactactatcaaagaactactgttcttggcagaaaggaccagcatgctcgtagagagcgagtccaaaatgtaaactacgtcgtaccccagactacttcatgtactgaaattgtcagactcgaagagtatgccatgaaccatgatatctgagctaatggaattgggatgaggaatgagtactgacaaagtgtcagaaaaatagttacccatcccaaaactttgttgcaccattgcaccaaaaatgattgtgcccctctttagaaataacaatagacgtcttggtcatccaacacggcggtgaacccctgtttaggaactgaacccagtgtcataggtattgcagaacgcgacatttggtggggcaacaaaaacaaggtttggacatagtcggatcaagcgtagtgccactattagctcctactgagagaccgccgataaacagcagtacccttacacactcgtgagtaaactttaactgcattagaagtgcgctaccagcatgcgtggaaagaaactacaccccggggatagaattataatcatttacagaacgtgcatgaggataaagggcgcattgcggagagcaaaaaactaagtcagtacaaacaaccaagataaga

SEQ ID NO: 542393 - DNA, 1174 bp, Homo sapiens
cagcgactaccgcaagaagttgcttgaacacaaggagatcgacggccgtcttaacggagttacagggaacaattaaaagaacttaccacagcagtactgcaacagtctgaaacactgatctgcaggccctacagagtgttgggcagcatcgtgggtgacagtgcttaacacagttaactgaagacaaaacttcacttgttaaacgctacccaactggacccaagactatgttgtagggttgtcgtccgacacgcttgaccaacaacgtacacgctgaccgccatggaaccaacgacgttgctcttgggatactgactacagctacactactcactgacgactacttctcgcccgagacgacggtggactccaactgcgtttactacaccactgtactcactgacggaccccttgggacactgttttcttacttcctgacgcacttcgcgcagggctcatcaagcaaccagaatcctggcgcacattcaacgcagccaggtgcatcagcaattcacctactatacgacaacctcagaagatttcattatacagcgctgtcaggcacatcacataaccatcctacacacagggcctgtattcgtgtactactgggaccccacccaggtactggggacacaaacacatctatggccacagaagccggttgcgtagcccagcctggacctgcaacatttcttcacaagggttggtatctaagttcctacatgtcagacccaagtttacatctgggtgaccacgctgccacggtccgacccacggcagacaatcgttcactttcattgatcagcacgactcgactcaaaccatggccatcactcttccactgcgcctgcacactagcactgctaacagcgagcggacgcaccggagtctactcatgacgcggaacccttccacgcttgacacgacagaggaacttccgactgaaaacgcgttaacactggccggttatccctggaaatacaaatgggaatgggaccttggagtaactccggcagtatagcgctataccacaggtaccacctgtgccataacaccctggatagccagaataaacttggagactccctgccagaactgccgtccagggccaatcttgagctcacacatcccaactggactctggccacttatccacccacgcaatagatca

SEQ ID NO: 542394 - DNA, 228 bp, Homo sapiens
acaggcacaagtaccaaggctgcacatgagtagcagcggggctgggcctggcccacaaagccatttttccctcctaggcctccctgtttgtgatgggagtgggctgatgccaagatctctgacatgctctggagacatttaccccattgtcttggcgattaatatttggctccttgttacttatttgaatttctctccagaaaatgggtttttcttttttattgcacc

SEQ ID NO: 542395 - DNA, 823 bp, Homo sapiens
gctccactgactgatagagcgaacggcgaccatggtgcccggagtgtgccctggtgggcccgatgccgtactggagtgttgcgcctcggtgtggcgccgagctgctcctgctgctcatcccggtggcctgcgtgcagtgagcctccccggagctgcttgttctcagaacacaaacaaaacctgtgaagagtgctgaagcaacgtctcctgtcttttggtgcaacactaacaatggcttgtcttggactacccagttacaagcgtttgccacctggttccctttgtaaattgagctctgcacgctggggagttttgttgggtgaacttatgaggcgctgatcatcactcatgtcggtagctcgggggaaccctcctcctgggcattgacatctgcttgactgctgctgctgcagtgaggacagaggagccggaagccggacaaggagtgagtgagaagtgccatgcgttgacgggaggagaggcgggatactgaaggagcgaacggagagccaagatgaagacaaggaccatgatgaccatcctgaagaaaaatatggactgtttcgagcagaacaacccgtatgctagatttctggacaatcgaactataagcgctccaggcacatcacgttccgaatgctttcctcgtgacgtgctgcacggctcctgaaggccaagcacagcgggagaccacggttggccatttgcggtcttctgacctttgacagttgacctgccaacattcgcgggccgggcgggcgagaggtgaccttaaggacggacttcctcttgaatggtgccttactcctgtcttctgtttagt

SEQ ID NO: 542396 - DNA, 771 bp, Homo sapiens
  misc_feature (328)..(328): n is a, c, g, or t
  misc_feature (618)..(618): n is a, c, g, or t
ggctggtaccggtccgccgcgctctgatcagagtgtctgtgtcaccatgggaacgattaagttttccacggtgcaaaccagcctcggggagcttcaggatcaatgagttactagctcatgagggaaatgtataaatatttaagtacatacctactatctgtacagagtgactctcattgacccagagaactgcgtgtaaaatattatttattcacagagttacacgagagaaccgaatcgtaaattcagtacgtgtttagtacgattctagttgtggaggaggtactgtaagggtgtcatgaggcaaagcaatattggttagtccaanggtcgactcacagagactgtgatgtatagcaggcattgaacgacattcgatggtttgggatacctaaattagagaagtgcattagagatgcaagatatcaagaaagagcacgttgtgggctaagcagtttgcaagttcatatttctctgagaacagggagtgttccttcaataagcaattccgccgaaaggtagatcttggtacatgttgtgtcaattgttagagggatgctaatgattgaactgctggagggacgcagatcgacagggtgcgcttaagcaggtcatagntagtgggtgaagcctagagcaataggaccagttgccatcgaaattcgagttccgattcgattgcaggtcaaaagtgtgattggaggaaccgtcactatgctgacccaagccaaatggtgcatggaggcaccgtaagtccattggacagcaagg

SEQ ID NO: 542397 - DNA, 144 bp, Homo sapiens
gtcctggacagcagctagcaactctctgggcaccccctccctccaacgcagtctcgtgggatcagctttcttatgctccaggctccgacttaaaggggaagcctgaggcactatagcacctgacctcaccccagccccaccttg

SEQ ID NO: 542398 - DNA, 585 bp, Homo sapiens
  misc_feature (435)..(435): n is a, c, g, or t
tgggttggactcaggattaaaaaaggggaacggggaaggtgacagcagtcggtgggagcgagacatcccccaaagttcacaaggtggccgagaacttggatggcacttggtggttttttaaaaagtcatgcccaaatatgaggagatggctttggtcacaggagaatgtacctcttggcaatccgtaaaagcacaccccacctttcttctctaagggaaaatgggcccagtaccttctccacaatgtcacaacacaggggagaggtagatagctatggcttccggtgtgtaaataatgtaatggcaaaattttttataattcttcgccttaatatctttttaaattgggattataacttatggaattagattagagcctctggtggccccccactttccccctttttagggtcccccaactctgtgagaatgttntggaagggctttaggggatcatcccgtggagagtggggactgaaaggcacgccagggcttttacccttgataacacattgatatgtgaaacccagtgggaaataaaaagtgtgcaccagcctgtataagaaaacaaaacaaaacaacggg

SEQ ID NO: 542399 - DNA, 1061 bp, Homo sapiens
aaagaacataaaaccaaatagttcagtagactcaaaatgcaagcgttggtgagggtatggagaaaagggaacccttttacacttggtgtgaatgtaaattagtacagacattgtggaaaacagtttgtagagcttcctcaataaaaacacatatgatccagcaatcccactactgggtatatatccaaaggaaatgaaatcagtatgttgaagagatacttccacgttcactgaagcattgttcacaatcgccaagacatcaacctaagtgtccatcaacagaagatagatagggctgagcgcggtggcccacgcctgtaatcccagcactttgggaggccaaggcaggtggatcatttgaggtcagaagttcttgaccagcctggccaacatgatgaaaccccgtctctacaaaagatacaaaaattagccaggcatcttggagggcgcctgtaatcccacctactcgggctgaagtgagaatggcttgaacccaggaagtggagatttcagtgagctgagattccgccactgcagtccagcctgagcgacaagagtgagaagagtgagacttcatctcaaaaaaaaaaagggtacatctaccaagggaactattattaaccttaaaagagggaaataactgatttacaacaaccatggattggacctgggaggacactattgctagtgaacataagacaggatctccacttggcatatggaatccacaaatttgaactcacaacgccagaaggggtagaacacggggggttcacagggcactggaaagcgacgggcgacaacaatgcgggcaacaccgtggggccaacgggggaccaaaaggtcaaggtacaccacgggaagtaaaaccagttccgggaaaaccgtgatgtgatccacaaggggtgaaccagcctacaggggaacaccggcgacacttggccggacgcataatcctaccaggggaaacaacaaaccggcaacagagcgccaacaaccaagacgcagaagggcacaccaaccacccaagcggcaccatctacaacaccccgcacccacca

SEQ ID NO: 542400 - DNA, 263 bp, Homo sapiens
  misc_feature (15)..(15): n is a, c, g, or t
agctcggttcccgtnctacagcacgccgaactttccggcgctgatgaccttgcccctggtgtttgtagagcatcgacagttgggtggcgctgcggccaagggcgcacgcgtcaattacctgcgcaacctgtgggtagaccaggtgcggccgttgccggggattgaagtgctgacctcggatgacccgcgactgtactgcgggatcacagccttcaagttcatcgggcgtgatcagcagatgatggtggaaacactatgtagga

SEQ ID NO: 542401 - DNA, 193 bp, Homo sapiens
ttctgactaggtgacctctaaagtctcctttcctctgtaaggtcgttattagtgtcacttatgggtgatatagtttatcttacttaagaaagagaatatgagtgtaaggacggaatgcctagatataaaatccacggacattgagagaagcggtggtcggggcccagacacaagggactgtcttataattact

SEQ ID NO: 542402 - DNA, 416 bp, Homo sapiens
tatcccttatctgaaatacttgggactagtagaagcatcttggatttgggatgtttttccaaattttggaatacctgcatacacacaataagatatcttggagatgggacccaagtttaaacacaaattcacttgtttcatatataccttatgcacatagcttgaaggtaactttatataacattatttttaataattttgtgcattgagaccaagtttgcataccttgaaccatcagaaagcaaaggtgtcattatctcagccactcatgtgggtaatttgtggttggttgatgtcaccatcattcctgactgaatgtatatgctaccaataagcagttattttcttatacttattcatgcataagtacttaacagtaaaaaatatgacataactcgcataggaacaaggatggc

SEQ ID NO: 542403 - DNA, 278 bp, Homo sapiens
aattggtctttttccaagggcacggggcaaggacacccgtgttgagctccgcccacccctcccccttatttttccagggccgtacaggtgcggggggctcccttcacaatagtcctccttttgttcctgcccccttaacacacagtgaaaagtaagggtggggcctttccagtcagacaaacttaagatcacatcctggcaagcccccttgcttgctgtgtggcattgggcaagtaactttacctttctggacttgtgataataaaagttcctacctc

SEQ ID NO: 542404 - DNA, 139 bp, Homo sapiens
tgagcataggctaaacatgtagctatgcgtgtagtaggctacaacactaggttgtgtaagcattctcagaacatgtccccgcactaagtaacacatgactatattagagtcaggtcctggctctacaatttactaacag

SEQ ID NO: 542405 - DNA, 351 bp, Homo sapiens
actctgagagaagtgcatggtctagtaggcgcagctggagtctgctcaagtatagattcagagaccgcattatgtcctccatctctgatgcagtcaactcgtaaacgatactaccagcctggactcagtggatcacacatatgttccctggcagcaccactgtatatcgtttgccatatgtgctcgttagaacgttgtgccatctcacactacatagctgtgtgaatgaatctttccttgcgctaaagactttacaggtatgcctggtttagcagggcaagtagtcacttcgaccactacacctggaagcctcataccgtataagttgttagccatagctgtaaattcatt

SEQ ID NO: 542406 - DNA, 140 bp, Homo sapiens
tggggttctggacctccatggggttcctcgactcatcatccaaccctcgcctgggaccccggtcatctatccatgcctcgcctgggaccccggtcatcagccatgcctcgcctgggaccccggtcatcatccatgcctcg

SEQ ID NO: 542407 - DNA, 324 bp, Homo sapiens
aggcgggaccagtcccggcgtgcagtgaggggggcgggggtgtctttccagaaggtcacgtggaaatgtctcgggattggggtcccggagggcccgtgaagcgggtttggctccggaggtgcattttctcatcatcctggctataccacaaggagcaagggggtagagagccgggcaagcaggctctctaccttcttcttcttctcctcctcatcctcaggcagctccagaccctcctgggtaactgagaccaggctcttcccatcaaattcctggagcggcggcacacagtactcgtcagggggctcggtcatatataccagg

SEQ ID NO: 542408 - DNA, 454 bp, Homo sapiens
tttctttcgccctgcgctgcctctggtttggagatgttcgagcttcctcagacaatccacatgcgggtatgcccagggacggctggtactgcacgcgttggctgctgtgcgtgcctgggcgctggcgtggccgatgccgtggtgttcgtgtttgccatgagacttcatcaaggtgaagttcatccacgaccagacctccccaaaccccaagtacagaggattcttccacggggttagggagattgtgcgggaacaagggctgaaggggacgtaccatggcctcacagccactgtcctgaatcagggctcgaaccaggccatccgcttcttcgtcattgacctccctgcgcattggtaccgaggggacaaccccaacaagcccatgaaccctctgatcactggggtcttcggagctattgcaggcgcagccagtgtctttggaaacactcctctg

SEQ ID NO: 542409 - DNA, 296 bp, Homo sapiens
gtggccgggtggggcagctcagcctgtaatcccaacactttgggaggatgaggcagatggatcacttgaggccaggagttcaagaccagcctggccaacatggtgaaaccctgtctctactaaaaatacaaaaataaacccggtgtggtggcacacacccgtaatcccagctgctagaaagcctgaggaacgagaatcgcttgaatcccagaagtggagttgagtggagtcagtgagctgagatagtgccactgcactccagcctgggtgccccagcaagcaagactcggtctcaa

SEQ ID NO: 542410 - DNA, 417 bp, Homo sapiens
tatatgacctaacttgtgattcttttattcataaaagctaatgggaaacggatccctgattaagctgatgactagacctacaattaattttcctgcagtatatgcacagtcattgtaccagcaatattaaaagcatatgtaatcattttatttataaatctatcctttaaaaggacatacgttttaggatgtcatcattttgatgtgcactcatgtcaatgttgataatcatgctgttcattatacatttcagtgtaacacagcagattcacttcaattgcctatatagcccacgtatattatgtagtctattagcaactgttcttcaaaaaaatgacattcaaaacaatagtttcatgtagagaaacattagtggatgttaattgtctccccaactatatttatgggtgttcagcg

SEQ ID NO: 542411 - DNA, 300 bp, Homo sapiens
aaatgcccccctttttacccttcggcaggggaaaggcatgccctgaagggcgggatccaaaaggaagatttggggccagattcccttcttcttttcccctctccgggcttcccttttttcccagggatgatgatggaaataaaatggcgggggtgatgcctggacccaagggggtgttcctcccccctccgggtcccttccttagtttcccccggggtaaaaataatcccggggggggggtttgctttggaaaacccccgtttctctccttgaatgataaagaattaaatttgtttccca

SEQ ID NO: 542412 - DNA, 699 bp, Homo sapiens
agactttgcgttagatacactatgtctcaaacatagaggacgcttacaagaaatcatgatacatgctctaatctgagcgcagcaggagaaccgttaagattaccaccttatgcctactacaaatgcaagcaccagttctcgaaatattacatcaccttcactataaacagctctgatacagctatctcctgctagctcttcgctatactgctgctcacggggatcacatgacacatctcgatagcggaagctcgaagcatgagtgcatgctcattaagtcaccccacgcagacaagcaagacgtgaatgatttatagggaaatgatcacatgctagattgagactttctgatgagcaagctccatgcctgtgtgaacctagattagaatgtcagtttgatatcaacggagaggactacctgtaggagagatcacttgtcacaagatgtgcgaacgagaccgggcactatgaccaactcactgccaagaggtacttgtacggagttaggcgacgcaaagcagccatggattgttcacggctctatcagtgcgaaacttgcccttgcaatcatcgacgacaatgtgactaggaaagagcctaatggtagtctctatgacccaacttgacaaagaatggtgagtttcaagccacacttggactggtcaccactgctattgctcggagcccaggagcattcgg

SEQ ID NO: 542413 - DNA, 566 bp, Homo sapiens
agctcttctcatcttcttccctcacacttcctctcactcaaataagaaccttccaaaaatgtgtccacctgggcccctgccctgggactcatggatttggagttgtggccacacggttgagggctgcagtgtccagtggaatggggcaattgcgggcctgggggcccttggcctgtccgtggcgggagcatctgcaaggaggagccccagagtccagggagcactgtggggagctccttagagctgaactcacccggcgtcaactcatcaaccctccacccatggacaggggtgcccccagcacaggagaggactcagccctctgcccccacgcacggtgggtgcctgtcaccctgtcctgcccagcggcccgagggcagcagtgggtgtgagggcagcccccggcctcccaagagcagctgagaggatccctgcgggaatccgggcttcgggtgcatgcgatctgatctgagttgtttctgacagtgacagagtgacaatctataagtatctcaagatcaaatggttaaataaaacataagaaatttaaaacgattaaaaaaaaa

SEQ ID NO: 542414 - DNA, 253 bp, Homo sapiens
aatggagatgtcagaacagggagtatacacgcctccatgggttcatatatatcaagagctcagcagacagaccaacgaaagcgtcccctattatgaaaggggtgtgttatcgggttgaaatgtgtctcctgtctccaaatacatatgtagaagccttaacctatagtactacaaaatgagatcttgctaggagatagggtctttacagaggtcatcaagttaaaatgaggtcgttagaatgggccccaattca

SEQ ID NO: 542415 - DNA, 277 bp, Homo sapiens
cacaccactgagtcttccatataaagatcatattcctgctccaagtggccattactgagctgagagatgtcgttgccgcagtgaggacctataggcacatgtaggttgaatgaaactctagttctacctggaagcccagacaagggatgggtcagtgagcaagactctcttcctagtctcaggccatacctgtggcgccctgatcctattctcatgacattggacctgggcagatgtgacaaattcagagaactatgattttgactcaggtggtgtg

SEQ ID NO: 542416 - DNA, 423 bp, Homo sapiens
  misc_feature (28)..(28): n is a, c, g, or t
tgtatgatatagttaattggagcatgtntcatagtggtacatttataattagtgaaatcttagatctgatgaaatagatatgatttctaagagtgcgaaagtttagtgttatagacagtttgcaggactttttattttgtaggtacttaaattttgaggacttaattattctctaataaagtgattgacaaggattaatgtataaattataccttgtcagtctgaacaatctgcagtttggacattgattcaaattcatttaggctgaataaattttgataaactaagtaagttttgacagctatttaaatattgggaaaggggatattcaacatttttcttacatcctgagagctttgttacatttagttatttgagacccattgggttctgttttctgtttcagcatgttgctgtaatggt

SEQ ID NO: 542417 - DNA, 255 bp, Homo sapiens
acgcccctgattctcgcgcgggtggcgcttccttcggtgcatgagtcggtggcctgcagtcttgttcgcggttaggcgtacggccggggctatgggttgactgcgtaggctgctggtttctctcctccctcgtctggggctccggggtgtcggtgtgccttgtggtcagaagtgggccagggcatttttaatctcagagcgaaagcctataatcactgcgcccgctcataaggggatggccatggctaggttaat

SEQ ID NO: 542418 - DNA, 351 bp, Homo sapiens
ttcatatccagcgctttcatgcggcagcaggtagcaaagccagaaagcaagtctaacaggatctaagatgaccatcaggagaaggagtttgagactgtgtatgcaacccccaattagacccccgttttactcgtgatctggaagaatgtatcgtggcttcatacttttcacagtcacagtgtctctctagaccccgtggattcagcaaccctaaggccacataatctataggcatgaaatgcgctcgactatgattcatgtcgagtgctttaatcccccatgccacagtgggaactccccaccattgttaatattggcatgaaggcgctggacatgagggtaccgagctcg

SEQ ID NO: 542419 - DNA, 166 bp, Homo sapiens
  misc_feature (34)..(34): n is a, c, g, or t
  misc_feature (42)..(42): n is a, c, g, or t
cggagtttgctaaggtttggtaagtcgccatgancccctagnctaaacagtgctctacccccgcaggtaatacttgaggcactacctaaatagttttcggagagaaccagctatataccagtttgattagcctttcacccctatccacagccgtggggtaggaggt

SEQ ID NO: 542420 - DNA, 856 bp, Homo sapiens
ggatgtagtggatacgtctgcggtgggtctcttccttcgctaacgcctcccggctctcgtcagacctcccgccggccgtctccgttaacaactggaacaccatgccttcaagttaagtggcagagtgtctgatggagagatatgtgtgaaagtagatgtggaaattgcgaaactaaactgtgactgattaggcacatgttggaagattcgggaagggatgatgacaggagatgatgaccctagttccgtcgtaacgaaagtgtgaatgcgagaatatattaaaaaaggtcattcagtggtgcaaccaacagaaggatgagccatcctcctcactgaagatgatgaggaacaatggaaaatgtgaagtagatgatagtccctgtgggggagccaagaattcctgaaagtagaccagggaacactttttgaggctcattgctggttgcaaagctaatttagacatcgaaggttgcttgatgtgacagtgcagactgtggccgactatgatcagggggagaaaagctcctggggagattcgaaaagaacttctgtatcaaaatgtttgtactggacaggagggaagccggtacggcaacgagaaaccagtggggtgcaagcaaatgaagtgttggggcggcatgggaaactggtaggatgtccaaatacactgggcggccgactatacaatggatattgacgacggtcacaatggcggcagccaggtttgagaaattgcccgcaggggatggggccatccacctcggcagtttcagaagaaaacctgttctggggcaaaaaccgctcaagagcgggaccccttagagcagcgcctgcgacaacgcacacgggtgacaaa

SEQ ID NO: 542421 - DNA, 342 bp, Homo sapiens
tgagctcctgttcggcacacaggaaaaatgaggtcgcaccaacaaactgaaggatggtaaatgttgaggattttattgccaatgaaagcggctgtcactgggagctgaaaaggtgatggaaagctgaaaagcggataaggtgggtaggtacctgaagtctggccatctacggcagctggattcttctccaaagttatactgtcaagctgtccctctgaagccaagccacttctctttgacatccagccgtagtctctgctcctctccaactgagtatgagggagatgtttcctattatccttcataatgtgccatgaacatatgaaaaaacataaaaacatg

SEQ ID NO: 542422 - DNA, 226 bp, Homo sapiens
attcatagcggtgagccatcattcaattgcggtggtggtggtagatggtgacggtggtcatggtggtggtgatggtgatggtgagtgatggatggtagatagtgagtaggtggtgatggtgatgatggtgatggtggtggtggtgatggtgatggtaggtgatgacggtggtgatggtgatggtggcactaggtgatggtgtgatgcttgtggtggtgatgatagt

SEQ ID NO: 542423 - DNA, 331 bp, Homo sapiens
ccagaaatccaataattacaaataaaatttacactgtggctgggcatggtggctcatgcttgtaaccccagcactttgggagactgaggcgggcagacaacttgaggtcaagggtgtgagaccaccctggctaacatggtgaaatcccacctctactaaaaaaatacaaaaattagccaggcgcagtggagcgtgcctataatcccagctacacaggaggctgaggcaggagaattgcttgaacccgggaggtggaggttgcagcgagccgagatcgcgccatgaacttcagcctgggcaacagagtgagattctgccctgcagattcccc

SEQ ID NO: 542424 - DNA, 326 bp, Homo sapiens
  misc_feature (15)..(15): n is a, c, g, or t
tcaagattggccgtngtgtgactgatatggtggtggtggtgataacggtgatggtgatggaggtgacttgcacatgtttgaggtgcttctgacagggaaacacctgtcagtgggaacaccacaggggaaacaccaacgagagtcgtcatgatacgtggtgaagacgagctcacgacgtgattcaaatcttgtgggtcacctgtcacacggggggtgtgcgtacgagacggacaggtgacaacagagactgacgatcatgtgaagaacacggatggaactaatatggaagactcccactatttaagcagttaaactagactgactga

SEQ ID NO: 542425 - DNA, 140 bp, Homo sapiens
gagtagggagggtactaaagatagccagcatacatagctcccagcagcatacctatacactacaacgccccaacacacataacagacatagcacacacataagtactagtacaggtacagctaagactaactagaagata

SEQ ID NO: 542426 - DNA, 141 bp, Homo sapiens
  misc_feature (27)..(27): n is a, c, g, or t
  misc_feature (35)..(35): n is a, c, g, or t
  misc_feature (115)..(115): n is a, c, g, or t
  misc_feature (117)..(117): n is a, c, g, or t
cagttggtaagccaggtgggcaaaganctactgcncctggcctacagcgagccgtgcgtcctgcggggggcgctgctggacgtctgcttggagcagggcaagacctgccacagcntnggccagctggcactcgaccccagc

SEQ ID NO: 542427 - DNA, 306 bp, Homo sapiens
ctgtttctttaagccagtacatatattatgcctgcctaagtctgaactggggctgtatttcagctagttgtatgaattattgatatttagttatgatagctaatgtttaatgtgtttggatctgcacagttaggttgttgcacaatagtcatttcacaaaatctgagtaattggtcaaatattaaaagaaagatattcttcctgttaggaataacgttgtcagtctaagtggccattacatcctctttttgatttacatcatacagatactttagaaagttgttgtggtgttgtatgccaagaaaa

SEQ ID NO: 542428 - DNA, 1190 bp, Homo sapiens
  misc_feature (447)..(447): n is a, c, g, or t
  misc_feature (685)..(685): n is a, c, g, or t
catagattacaacggtgatggcgggcaagcggtccggctggagccgggcggctctcctaccagctcctactactactggaatccgaaggaaagaaatcagccacgccgaatcgctgtgagagaacaactactggtgcttagtggaaggaccgagccgatatatagagcctattctcctaaggaagactatcgaatgaccgcatgataccacctaatactataaacgaacgaagtaacgcgccaaataataataatgacgatgtttaagctcaaggagggggagtagctacgagcaagctagggaacttgggtccagagccgcgtagcgtgtcagggcgcttaatacacaacttgacgcgaagatagctggctcggaaatgctaccgaatcggaagatatgatagaaggatctaacaggactggatagctatggaatccagaagcacngcgtaagaaaattcggatgtaccaagcgcaatttcaaaatgcgactataccctactccgaaggcgattaataccaacactagcttacctcggaacattgcgtacttgaaggacaggctgagaagaccagaaaagcaacatcgtgattagccggtacaacttgaaatggacacataactatacaatgcaaaccgccgagaaaataccgcaaattacctccgattggataataaacatgncagcatgaataaaaaatcggggcctacaacctgccaagaggaagaacgatggaaaagattaattacgacgaaaatgtacatcagaaggggtggagaccgcgaaatgatcccagggagatcactggaaaatcgaaagggaaaggctgagacgacgaaatgatagcctaagggaagttaagagagacaaaaatacaaacaacttcttcgaagaatagggcaaacggcagccaatacgaggggctaacctaccgcgatggccgttcacctgcgaaacgcaggacgatggggacggcatccaactaataaagaacagctatctaaactctgcgaggcatcagcgggaacacagccatgcaatttcataataaaggggccatggaacattaaagtaatactacctattaaaacttcggggactggaataaagcccaggctcgaaggaattgactggaccacctttggccccggaggcatgaatttgttcacgaaggtcccaatgaagggc

SEQ ID NO: 542429 - DNA, 142 bp, Homo sapiens
cgtagtggtatgcgaacttagccttatccaaatacccgtcatatacctagaatccgtacataccaagttgcaccatcgagaaggtatgcgcatgagctggcaggacgaattcaggcagtggtttcccatcacccgcgacaag

SEQ ID NO: 542430 - DNA, 136 bp, Homo sapiens
tcgagctcggtaccgattccatccaacgccgctgactgcagtcagcggtggatgcatgtcagcggcgttggatgcatgtcagcggcgttggatggagtcagcggcgttggatggagtcagcggcgttggatgcagt

SEQ ID NO: 542431 - DNA, 1126 bp, Homo sapiens
tacggcactgttagagccctcttgtcatgtagacattagcatattaaagtttctgaattgtctagccagaatgaatcctggttaacttcatgcaaaccatttattaaactgatttaatcacaaaaccttttctaaattgtacacatctttaagaagtgttactctggagaatcatcattaaccataattgaagtggtgactctagttcctgctgaatatttgagagtttcgtacatcctctctgttgaatttgtggcacagacactcatctaacatttactgagctgttctatgctggaagcttatttaatctcctcatgaacttcatgaggtagatgctattattccaatcttaaagatgagaaaatagacttaaggaggttacgtatctaaacccaaggtcacatagctagttagtagcagacctaggatttgaactccgctctatttcattctaggcccaagctcttatacattgtgctttgctacctgtgtgcttaacttagttcatcatgtcacttttccatttaaaaccttctagtagcttcatattgcacttggtctaatatccaaacttcttatttcgggtcttcaaagccctgcatgatctgatttcttttctacttctctgaatgctttctgtgtttcagcgttttctggctctctctgttctgtagattcatacatgagagacccattgctgcctttgcacctttatactgctgttctttggccccattcccagtcctacttgcatggccagttcttcatgtttttcgtctcaaatatcagttccccagaaaggtctgcttaagaaagacctagctaagtagaagccccagaaaagttcagcctcaattacgtggttgcactgtcttgaaagtgcttaccaacgaccccaaagtatttatcgtaagcttagatggtctctcttctcccattagaatgtaagctttatggtataacagattctatctgtcctggtagcccaaccgaagtcctcaggaacaaagtgtaatacatggtgtgtcataagacatcgaatgactgatgactgacaggaagaaatgggaatataaggacatggtaaataaattaggaaggatcaggaacttaaaatgtaaat

SEQ ID NO: 542432 - DNA, 204 bp, Homo sapiens
agcagattcagaactctgagtatttacataagagtgaaattactggctcatatagtcactattaataactgtttgaggaaaggcagaaaaactgttattccaaagatggctgtaacatcatcaacaatagggttccaatttctccacatccttaccgacacttgtaattgttgatcttttttcttattaatttattaccatctt

SEQ ID NO: 542433 - DNA, 1396 bp, Homo sapiens
ggcaaatggagtgtccgctggtgcccgggcctgcaccatggagcgtgccggaccttcatcgacatcagtgaagatagtatcattggctgtctgagcttcgtgctaatcttgaaatctaaagaggagctgcaccatttgcacgaagagaactcggagagggtggcacttcactgttagattgtgagctcatacattcattggaagcctggggatgtgtgtctgaatcgggaggcactcgatgtaatgcatgttgaaccggtgctgactgaacaagagtgggtagtcccttatctcgtgtggatccgtggtaaacccatggactagaggcgatagtaaggcgtttgagatctgcaaagaccgttatgtgccactaggctggtcaaaaattgttcgtctgtaagggtgaatcgacccccagatgcatctggaagactaggcagcatggattaaagcagactcttttttcctcaacgggaatgggtatcataagaatagtagctaccttgttaagggatcaccatcgacggtggtatttggctaagacccttaatttagaaagtgtggtccatgccattgcatctgttggggggccgattgtcaagttatcattctctcaaaatcatggaatgcttgggtaatcccacccggtgtaagaccaagttgtgcactttggaccttgggaacttgggaccagtgctctaactccactggtaaagagagcacaagggccactagcactctttttttaaaggtaacttaacctttgaattgaaggggcgacttatggttgggacctttggttggagcaaaggcaagttggagtagacctttggtaacaaaagaggtccctaccgggttgtgcacaatttgtgacgttcggggaaaatgctaacaatcggcatggaagcgcacccaaattttggcttattccccccaatggggctgccagacagctcttggcagttggccccccacaccaggtgttggtcaattccggttaccggaggcccatttcgaagagggaattccctagacacgtgggcacttttacaatatttaaagagggcaaaccattttggttatcgtatttatattacaaccgcaagtttcaaatggtttaagtggggcacgggggcgggagacgtttaattttcacgatggaaattcatttttgtgtaagaccacatattgtgtgggtgaaagtgtggtctaaaaatatgaggcccattcgatatatgggttcaaggcctggttgattacgggaaggtaaactaaagggagcagttacaggttggagtgtcaagcatgtggccatggttgtgcgagtgtaacgtagagaaaattatggggggacaactgagtgtgagaactatatattaggagctttaaagggaaa

SEQ ID NO: 542434 - DNA, 178 bp, Homo sapiens
gtagggggaggaacgaggaggaggagtactctgacagcagcagcagcagctgatggggatgtggcgccctccggagtgcgcagcctccgctcccacgcccggagccgctggttgtgaacgaggccaatgcctaaatatgatacgacacgctatagagacgttggagagaaaaatggtc

SEQ ID NO: 542435 - DNA, 213 bp, Homo sapiens
ctggttatgcattactgataacattgttacagaagaatggcagcttactccaggtgctggagttgagaatggatatacctgattatcctagcttgctagatgatagatactgcttcatcatcatggaaccgatccgcacacgggacggtgcgtcttaccataaactccacaccaaccgtatacgcgaacgtccaaacaaaacaaaaaaacaag

SEQ ID NO: 542436 - DNA, 412 bp, Homo sapiens
tgaggattgtaacccatatattgcatgggggtccccaatctgaagtcagttaattaactaatttcacagcgtggttatggcaaaatcaataagaagcgaattgctttgcacgataacgctttgattgctcgatctcttggtaaatacggcatcatctgcatggaggatttgattcatgagatctatactggtggaaaacgcttcaaagaggccaataacttcctgtggcccttccaattgttttctcccccaggtggaatgaaaaaaaagacccccccttttgtagaaggtggagatgctggccacagggagggcccgatccacaggcttattagaagaatgaactaaggtgtctaccctgattatttttttaagctggttggttaataaacagtacctgctttccaattta

SEQ ID NO: 542437 - DNA, 782 bp, Homo sapiens
  misc_feature (650)..(650): n is a, c, g, or t
tgaactgtgctcgatgtgcggattgtggccgcggtgcgcccatggcgctctggctgcatgcctgtggctgcctggtgttttttgtcgttggctggcgtgtggtgtgctgtgctgtgcagcggcggagcagcagtgtcccgctggttgctgtggtcgagtagaccgggacttgttgggctcctgcggccgacactccatgaaggccacatacaccagctgacttgcaggctactactacctaactatagatcccgcccttggagctggggtcccaggaatgtgctgctgttcctgcagtgacaagctgagcattgaggatttcacaggcatatggcggttgtgtttggaaacaagcaggacagcgcctttttctaacctaggagaatgccctggaccttggccccctcctacactggttgcttccttgccgtcgacttggtatgcagtcatgcacctctagaccatctatacctgcaggagaagctcggggccagccccttgcattgtggaccttggccaccctgcgggagcttgaatgctcaagtgccagcctccctgctctggtgctcattcggctgccctacaaagccacgctcatggtctgaatggcacccaggggaagttcctcacaatggcaacgaatagggttntcggggcagtgaccttagaacaactcaagtccgaagaatttccataaacagggggcctacaaagggggtacgcgcttcccgtggtgcgccttaatatacccgtggtgggcgaggggtatagcacacgtttaa

SEQ ID NO: 542438 - DNA, 208 bp, Homo sapiens
gtatcaagtctgatcatcagctttggggaggttggagtggctgtgggtcctagggagcactttgcacatggagagcaagcaatatagatgtttatgcacctccaaacattcccgacctttgatggttccactctcacttgcataagcctaatgtaggtcatctggcatttaacattcacctaccattctatccacggtaacaccacag

SEQ ID NO: 542439 - DNA, 493 bp, Homo sapiens
gagctcggtaccgagagatccctaacagtttcagtgaatgctgacacgatgctagcaccagttcagcgtgagaatttgctaataaatcttttcgtgatactacaaactgcttccgtttatactgtccaaatggtcctgcccaacctaagggaagagaaaacagccctgagtttcctggaggaaattcccaagtcaatgtgctccctctttacaaggaaataggggcagagagagcaagttccagcctcaaagaaagaaggattaacggatagtgaatatgctgctacatctttcttacgagggctggccacccttacaaaggaactacatccttaaaccacaggtagttttcagcgtggcagtagctcacactgtttcttgcggcagagggcctgggctcctcctggagaatctaacaccagcggtagtggggcagggcacggtttggctctgacatcttgtgcaagtcattgttcctcttgatcacggggcc

SEQ ID NO: 542440 - DNA, 305 bp, Homo sapiens
caggagctagctgggcgcggtggctcacacccgtggtcccaacattttgggagaccaaggtgggaggaatgcttgagttgtaggagttcaaaccagcctggcaaatatggcaagaccccatctctctaaaaaaaaaaaaaaatcagccgagcatcatatcacatgcctgtagtcccagctactctggaggctgagatgaagactgcttgagccagggagggcaaggctgccgtgagccaagatcacaccaccacaccctagccagggagacagagcaagactctctctcaaaacaaacaaccaaa

SEQ ID NO: 542441 - DNA, 296 bp, Homo sapiens
gctccaggattaggcagctatcggttcacggcgtctatggccctcaaaatcattttctttttcttttctttttttcttggagacgtgtctcaccctgtcacccaggctggagtgcagtgtcatgatctcagctcactgcaacctccacctccttggtttaagtgatcctcccacctcagcctcccaagtagctgggactacaggtgtgtgccaccatgcccagctattttttggtatttttagtagagacaaggtttcaccatgctgtccaggctggtattgaaccggatagcttg

SEQ ID NO: 542442 - DNA, 999 bp, Homo sapiens
agcggagtcagtgtgtcggattctgtactcggatgaggcggagtaaagggatttgagcgagccagtggccggattattctatttcccctctgtctatcgcggccggcatctctttggagcgcttctgacactctcgatgcgggtaggcatggcgggattgcgccggggagcactctggtctcctagttcccatcttgcgcatcggtacggttcctttcaggacgccgaaacacggtcgcgcggccgcggcagtgggcgggaggaaggcgccatggatgttggcacgcggagcggtggaggtagaaacgtagctgcagcatccgtccctgtgcggggtcggcccggatcctgtatctggctcggaacatgatgtgaagaggtactcgggttatgtatttctggggacacgctgtatctatagctggacttatgcactggggatgccatttgcaagttagttctgtcaaggcggtagggttccattaggcatcaatcactgggtcgttcctcgtcatgctccagcaagtctgggcttgcacgggatcgtacccaggaccgggttgatcgcaaggctgctgaggaagacatgtctaggaaggaaaggtgcactcctggtgtctgcagtcataccctgtgaggtgagatcattgactcctgctgcgtctagaaagcttgaacattcaatgtattctgaaatggtctgcaatgggtgcgacgaattcaaggagggcactctgaagaaatctagttaattcaggtgttcttttcatggataagaaggaatcctggattgacgtgactttgaaggcttgtcctgatgtttcaatggtgggtcttgaatgaccctattgttgggttgggggcaaagatacctggggatcatggatggatgttgagttgcttgaactagctatatttgaggagtcccgcgcttggttgctgaaacgtattggacggggatggtcatgagtgggttgaacggaaggcgaaaagtcatgg

SEQ ID NO: 542443 - DNA, 167 bp, Homo sapiens
tggacagcactggacagcacagaggaggtggacagcacagaggaggtggacagcacagaggaggtggacagcacagaggggtggacagtacagaggaggtggacagcacaaggaggaactctcgatcaagatgcccaaccctgtgatcagaacctcctccctcctct

SEQ ID NO: 542444 - DNA, 107 bp, Homo sapiens
  misc_feature (9)..(9): n is a, c, g, or t
  misc_feature (34)..(34): n is a, c, g, or t
  misc_feature (47)..(47): n is a, c, g, or t
  misc_feature (69)..(71): n is a, c, g, or t
aagttgatncccgggggagaaatgagaattagcntaattgctgccgntaatgtgtttttgaggaacgtnnnattttctttcatgtcgctgatcatattaccgagttc

SEQ ID NO: 542445 - DNA, 386 bp, Homo sapiens
  misc_feature (148)..(148): n is a, c, g, or t
  misc_feature (290)..(290): n is a, c, g, or t
  misc_feature (338)..(338): n is a, c, g, or t
gattcagagtctcactctgttgcccaggctggagtacaatggcgtgatcttggctcactgcaacctccacctcccaggttcaagtgattcttctgcctcagcctcccaagtagctgggatccacaggtgtatgccaccatgcccagcnaattttttgtatttttttagtagagacagggcttcgcatgtcggtgcaggctggtcttgaactcctgacctcaggtggatccgcctgccttggcctcccaaagtggctgggattacaggtgtgagccaccgcacccggcctnccatttagttttaaatgtaccagagggcacaaacacaccaattcttgncattaatttataaaaaaaaatggctagggtgggtctctctccctttgg

SEQ ID NO: 542446 - DNA, 399 bp, Homo sapiens
gttgcacagttattgtgtttatagcatatataacagtaaaaacatgacaactatgtcacaaaagacggaagtaaaggaactgtaaactacactgttaagttctgacattatacattaacggaataatattttaacagtggaatgtgattaaataaaggtatatcttgtagaactaggacaacctaatattaaaaattttcggttataggccgggcacagtggctcatgcctgtaatgccagtgacacgggtggattgcttgagctcaggagttcgagactaccctggacaaactggtgaaaatacgcctacaaaatatacaaaaattagccgtgtgtagtagcataccaaaagcctgttatcccagctattcggcaagttaaggcacgaaaatcacgtg

SEQ ID NO: 542447 - DNA, 450 bp, Homo sapiens
gccggggctgaactcctgatctcaggtgatctgtccaccttgacctcccaaaatgctgggattataggcgtgagccgctgcacccagcctaaattttttttaagtgacagagtctcactctgttactgaggctggagtgcagtggtgcaattacagctcactgcaaccttgaactcctgggctcaagcgatcctcccgcctcagtcttcagagtacatgggactacagacatgtaccaccacgcccagccaatttttcaatttttttttttttttttttttttttttttttttggaaaaaaattctcgctcgtgttccccgggcgtggagtgccagggtgtgatcggggcctcaggtgtccctcgtgcctcccgggtttaagcatttctgttgtcacagcctcccaagttgttgggcccacgggcactgtggcacgcgaattcgccgggg

SEQ ID NO: 542448 - DNA, 128 bp, Homo sapiens
caaatccatacagacatgtagaacctaatcacgggaagcgggaaacacagttcccctccgcatcattccgggggatggtcaagtatacctattatctctctctctctctctctttttctctcctctgc

SEQ ID NO: 542449 - DNA, 832 bp, Homo sapiens
gaaaaccaggaactggccaacagccgtatggcacagactgtgatgaaactgcaggccagtaacttcagagggctgtgcggaccaatgagcgcctctaggtggccctgaggagccttcctgaggaggtagtgcgggagacgggggagtaccgcatgtctgctaggcccaattctcactgctctacaacgatgtctctgtcgaagtgaagacccagttagaacgaggctcggggcctgctgcctgtgccacaatatagtaatctcccgcatcggctgcgaacactactcgagtcacatgtggattgagctgagccgagactggggactgcagtaagtaagctatcggcaaccagaggtcatttcaggctggaggcacaacgctggcccagcgtacgacaaggatgtatgagcatgcttgcgcatcgagtttgagcaagaatctggtcggtgccaaaccgacgcatggccgggtgcccattctaaactcgttgatgatgcgccacctgattcagtagtcttcaaaatcgccactagaccaccatgcttaaaagggtgatcgcccagcgtatacatgcggagacgcttcgagaagtacaagctgagatttggcaagctccgggcccaggccactggcatctgcccaattccaccccgcaaactgggcagcctagaggattctggcagtcagtggcccgagccctagtggtaaagagggagggtggggccaggcctgtcagtaccccgacatagagagaggagatggtccagtgctgggacacactatacacttcatgaagaacgggaggtggtccctctgaagaggacttcgggtt

SEQ ID NO: 542450 - DNA, 174 bp, Homo sapiens
caactctaaaggagaccctccgatatttatatcgatcgatctctcgatctctattgatacttatgtatatatatataatattactgcttaattaacctaagatataatatattataacttaatggtattattcttagaattcttattagaattattcttcttattagaataata

SEQ ID NO: 542451 - DNA, 85 bp, Homo sapiens
gacagcagcttctacatctgcagtgcggccccccgaccgggggcgagggagcagtacttcgggccgggcaccaggctcacggtca

SEQ ID NO: 542452 - DNA, 189 bp, Homo sapiens
tcactttcacacacatgagcatctagtacaaatgacagctcatttcccaccacaaacacatggaggccagaacgacatcaggtatagcagtttctcaaaagtgctgaagaaaaaaaaactgtcaaataagacttctatagccagcaaaattatccttcataaatcgaggtggaggtgtagaaattgaca

SEQ ID NO: 542453 - DNA, 134 bp, Homo sapiens
  misc_feature (30)..(30): n is a, c, g, or t
atttgcaaaacattcactgttttcttcaanactggtacactctcaaagttagtctcgccaattaatcatcaaccacacttctacatactttgaaggaaacagaagccaaactgtacaatggttcaattttgatc

SEQ ID NO: 542454 - DNA, 562 bp, Homo sapiens
gcagaagagttcatttgagggcagtgttgggctgtagacggaaccaggaggaggagcttgacctgcagaggcatcatgaggcagaggttggctctatagggccacgggagccaggaattgtgcccaggagcagctcacttgaaagataatattgggcgaacgtgacagagcatcaggcattaagattctcatagggacagcgcaacgtagatccctcacatgcatggttcacaatggggttgcatgctccctaatgagaatctaatgctgctgatgatctgagagaaggcagagttcaggcaggaatgtgagcaatggggagtagctgtaaacaccagatgaagcttccctcattcaacaccattcacctccggctgtgtggctcccttacagttccatagctccggcgtaggggaccctgcccaagtacatccagaaaggaccttccacaccagtcttcatagtggtcaagtgcagcagccacttagctaccaaggcatatcccacaggtggcatttcatcacaaatcaacactaagtggtactttgcgtcatagtgaggc

SEQ ID NO: 542455 - DNA, 407 bp, Homo sapiens
tctatcgcatcatcaggctgcaaatttttcaaacttttatgctttgcttctgttttaaacataagttccatttccaaatcatatctttgtgaatacataaaacaatgcttttcacaacacccaagtcacctcttgaacactttgctggttagaaatttctcctgccagataacctaaatcatctctctcaagttcaaatttccacagatctctagggcaggggcaaaatgccaccagtctctttgctaaagcataacaagagtcaccttagctccagttcccaacaagttcctcatctctatttgagaccactaggcctggacttcattgtccatatcactatcatcattttggtcaaagtattcaacaagtctctagtaagttccaaactttccacatcttcctgt

SEQ ID NO: 542456 - DNA, 113 bp, Homo sapiens
actgtcaggattacccacattcgctgcattcattgggcttctcacctgtgtgagttctctagtgctggatcagtggggcaatttggttgaaggtcctcccacacagtagcgaa

SEQ ID NO: 542457 - DNA, 762 bp, Homo sapiens
tgcagtggctcatgcctgtaatcccagcactttgggaggccaaggcaggctgatcacctgaggtcaggagtttgagaccagcctggccaacacggtggaaccccgtttctactaaaaatacaaaaaaaaaaaataatttagccagatgtggtggagggcacctgtaatcccaactacttgggaggctgaggcaggagaatggcttgaaccttggaggcggaggctgcagtgagccgagatcgtgccactgcactccagcctgggcaagaagaatgagactccatctcaaaaaaaaaaaagctgggccacaggtagcccctgaagcaacctccaacccttgtttcctaaaatgtccctggctggaatacccgaccaacttcggacttcattttccatgtattatgccagggctctcggagaggatcaagcaactgagagttaccaggggattgaaccacccttttggggcaacaacactgacccaagacggcacggagagaaggacatgtgggtacgtcccccacatttctccctatgtgttaaaaattccttatgggctacgcggaataccagaaacctaatctcataagatactattagattgaggtacaacatagcgtcgcaacttgcgctttattcgggacccttttccgatggcctgtgatcacgcgcgctaacattggcttatgcccgggggaattacccccatcttggaagctccacactaaggggcccctatcaacaataccgtgtgtctggcca

SEQ ID NO: 542458 - DNA, 1091 bp, Homo sapiens
gggtccgtgtgtgtgtgggcagcatagttgttgcttggtcttccccgtgtgtcgcgaggtgttgtttcctgctcgttctctgatttcaggtcttgcctgtgttctgcttgtcgtggccgggttgcactgtcggttttgtccctatttataggtgggcgttgcggccgccctggctgtgtgggccccctcgttttgttcgttgtttgtgtggggtttttggcatggttttactggtttttctagtgctgtctgtcggggttgtggtatctcctcttttgtgtgttgtctctgggttccatgtggtcctcgtttggcctttcctcttcttttcgtgtctgtttttttgtttatctggttactttcctgtagtttctcgcgtctagtgtgtgagctcaattttatttttgtgggttcataagtcttggctatcgggttttagccttagttgtatactcaaacgcttaaactgtgggcattatatcattttgtttttgccaccttgcaagtgtcctaatccccaaagtcccgttgaagcctcccgaatgaagtttatccttgtggaagaactgtttaccctgattccttttgctaactgtactagatccggatttggggcgcttgtatgctcgcgactgagctacttgttcattttttgatacacggcataccagctacagtatctgtgtgggattactctgttcaaaacgtcgttctccacagaactagtcttttcgaccaatctgaactgttttcaccactctttcaccaactttgtctcttatgtgtcttgtcactgtctaaatttaggtgtgtactactaaataggtcaccctattgtcactggttcgttgcaagtaaatgctacaaccttggtacgaccaagtggacgtgcactctgatgatgtgatagagacgctttgactgatatacgagtacatgttgattgtgtagaatgtttatgaatataattgttcctgtgtttttactaagttggggatattgttgttgttttacggcaacttaatttgattgcatttaaatggtttttatgtaatagaaatcacgcaaaatagtgataggacttacaaata

SEQ ID NO: 542459 - DNA, 103 bp, Homo sapiens
gaagtgtgatgcttgctgcagaactgctaatacactagacctcattgagttgtaccttttaaatgggtgacttgtatgatatgtgaattctctctccaatcca

SEQ ID NO: 542460 - DNA, 574 bp, Homo sapiens
atcttgaagtagacttgagagagagtattttattagattagctagtgtttatgaaatacgcctatttaaataaataattaccaattttattttcctatgactttttcaagtcatgttgctcctaatttctcttaaagcttcctgtggttatatggtcctcactgttgactcctcttagagactttcacaacaaggcctatttaaccagagtgagagatgctggccctttccttatataccagttggaatgaacaccttcactttgttctttagcagattaaactatgtgtaaaaaataggtctgctggaggcaactacgtattatatacagatctttacactatatgttgttttggtacctgagctcttatcttctattttgcatcttttaaataattgcaaataaatccaaacttacgggcacatcagggtcttgattgttctgtgaattagggatcatgattgaccattatgcctccgagttcttggattttagcaaatcttgactggcgttccaaatatttgtatgtacacgtatttatatatcacacagaacaataaaaacaaccaaata

SEQ ID NO: 542461 - DNA, 414 bp, Homo sapiens
  misc_feature (14)..(14): n is a, c, g, or t
aggtatacccgaanatcttgtggatcaaggaaatggaaaatttaagtctgcatgattctctgttggggtgaacggacactgtgcagcagtattcatgcatcatactcaactcccactgctttctgaagcatgctacagggcaaatctaaaggagacatttatttgcctggcctgacaaaacaatcccaatgagatggtcacagaagtctgcaaagagtcttgcagggacaaacccagctgtgcctacatcaatgactgcaggagctagggcgtggagactggcactcagtgcatcagggccgaacggatggttgcaacgtacacaggcaagcagccacacagtgcaacgattcacattggcttaccatcgacgtcagagaacatcagccatacggcaacccctggccttggtga

SEQ ID NO: 542462 - DNA, 664 bp, Homo sapiens
gctgaccttcagcgcctcggactccagcgccatggcgccctccaggaagttcttcgttgggggaacactggaagatgaactgggcggaacgcagagtctgggtggagctcatcggcactgctgaacgcggccaaggtgccgggccgacagccgaggctggtttgtgcatccccctactgccgtatactcgacgtgtcgcccggcgagaagcatagatcccaagagttgctggtgggcgtgcgttcagacactgctcacaaatgtggactaattggggcatttgactggaggagagtcagccgctggcactgatcagaagatctgcggaggccacgtggtgtggtcctggggcgcacctcagcagaaggacaggcgatagtctattggaggaagtcctagatggagactagatgtgggtcagccaaaggtgtgccctagtgctgctgagccaggagccggagctccgagagtagaatcgcacctgccagtatgggcgatgagagcgtacgatcgacacaggcgagagcgtgtgccagtcacttggagcagaaggttggttgctacaggagccacgcacaaaggaggtctatcagccagcattcactgttgcaaggactggggagccacaggtcggtccctgtgcctgatgcatgcctcgtgtagg

SEQ ID NO: 542463 - DNA, 922 bp, Homo sapiens
  misc_feature (922)..(922): n is a, c, g, or t
aaggaaatcttaaaatgtcctggaagtgtggattaagcaatgccgcctagaagcaatggttctgtcaatcatcagatgtagtggaagcataggagtcaagactgcttgttgaaacctttcttttgatagttactgaactgcgttggcttaaaggtaaatggaagcaatgtgctaatgttccacaagttattgaccggtatgaattgccatgtgtagtgaggtatttccctttacttgtggtgggccttggttccctctatgccctggtaatacaagtcagagcttccgggcagtggaatccgatctattgtttgttgccagaacagtgcaccctgtatggtctccgtgtctaatgtgtgggaaaatgtttattgcatgtgcaaggagtaatccgagtatttatagacagatagcatcacaataaattccatgcgtgggccgatgctcgtaatgaagataccaaggaattgcattgacgaatagatggttgggggggggctatgaacccgtgaagagacttttccaataacgcaccatcgttggggaaggggcgacccccagggggttgctgcactgattgggcggagcaggggcccagtcaaaaccgctggtgtcctgcagacccgggggccacccccaggaaaaaaaagtcgcgggcctgagcaggggctcaacaaatccgaaggtcggggggcccatgggtctaaccaggagtcccaggagcctataatccccccgcggggagagatagccagcgaacataagaccacggacacccccgacgcacgcgcctatgggggacgtggccagcggccccagcaggccaccgaaacactgtgcgccctcagtctaaacccaaactaggggacacgtcgtcacacacaatagatgagttacccgcaccatcaaagtatgtacatcn

SEQ ID NO: 542464 - DNA, 733 bp, Homo sapiens
  misc_feature (3)..(3): n is a, c, g, or t
  misc_feature (63)..(63): n is a, c, g, or t
  misc_feature (70)..(70): n is a, c, g, or t
  misc_feature (88)..(89): n is a, c, g, or t
  misc_feature (94)..(94): n is a, c, g, or t
  misc_feature (97)..(97): n is a, c, g, or t
  misc_feature (105)..(105): n is a, c, g, or t
  misc_feature (107)..(107): n is a, c, g, or t
  misc_feature (114)..(114): n is a, c, g, or t
  misc_feature (116)..(117): n is a, c, g, or t
  misc_feature (167)..(168): n is a, c, g, or t
  misc_feature (180)..(180): n is a, c, g, or t
  misc_feature (203)..(203): n is a, c, g, or t
  misc_feature (210)..(210): n is a, c, g, or t
  misc_feature (233)..(233): n is a, c, g, or t
  misc_feature (255)..(255): n is a, c, g, or t
  misc_feature (267)..(267): n is a, c, g, or t
  misc_feature (285)..(285): n is a, c, g, or t
  misc_feature (288)..(288): n is a, c, g, or t
  misc_feature (300)..(300): n is a, c, g, or t
  misc_feature (357)..(357): n is a, c, g, or t
  misc_feature (409)..(409): n is a, c, g, or t
  misc_feature (437)..(437): n is a, c, g, or t
  misc_feature (446)..(446): n is a, c, g, or t
  misc_feature (490)..(490): n is a, c, g, or t
  misc_feature (501)..(501): n is a, c, g, or t
  misc_feature (715)..(715): n is a, c, g, or t
gcnggggcctgtggcagcccatagccagtggcggttagggctgaagcacagggcgttgatgangtccccnccatctagcgtgtcacgnngtttnccnccgttganancccatancnnggcctggccatccttgcctccagaggcccagagggatccatctggggggnnagtgaccgtgtncagatagcctgtgtggccaatgnggttggnctccagcttgcagtgagccaggntccataccttgaccagcttgtnccagccacaggngaggatgatagggttgcngcngtggggcgagangcggacacaagacacccactctgagtggctctcatcctggacagtgtatttgcacanacccagggtattccatagcttgatggttttatctcgagatccagaaacaatntgccggttgtcagaggagaaggccacantcagcacanccttggtatggcccacaaatcgcctcgtggtggtgcccgttgtnagaacccagangcgcagggttccatcccaggagcctgaaagggcaaactggccatctgaggagataaccacatcactaacaaagtgggagttacccgcagagcacgctgtggaattccatagttggtctcatccctggtcagtttccacatgatgatggtcttatctcgagagggggagaggatcatgtccgggaactgcggggtagtagcgatctgggttaccnagccgttgtggcccttga

SEQ ID NO: 542465 - DNA, 1477 bp, Homo sapiens
  misc_feature (395)..(395): n is a, c, g, or t
  misc_feature (501)..(501): n is a, c, g, or t
gatcgggttctgcggtcccgctagtttggactactatggcttacatatccgctcgtatgagtacgagaaacgcgtatctcgaggcgtacttcatgtatccaaggcctctcgaatacagtccacttccgccattactcctcgtctcgcctaagctacactcgtcactgggcgcaactctatttctctcatcgagctccatcatccatgacattcatgcgtgaactcatgtacaacgataatcgagtacgcgtcgggtgaagataccatatctggtctagaacatatcccattgcacgctgccccatagattccctgtacgtacgcatacttattattgcccatccgcacatgtccgcgtaacgcgcaatcccgtttaaccatgcacatggagtacnacatgtgttcgtaacccgtaatgcccacgttgcctcttttaaaccaatgctaacattttcatatcttcgtgcgcgagctttccatgatgttactgggaacaccgcnttaaacttggaagttgtttcgagccctgcatcgtggaacaggggccgggttagcaatgaacaacttacctttttccatttattcgctccggcgtgaaaacaatttatagcgttctaccgcacgggcgcaagttataagttccgccccgtaagggaagacctcaaccggggacggcacaggtctttgccccgtaagggataccgcattgtgtcacaccagattaaacgcacacgaacgtttcgggaccggttgacgctggaccggccttccctgccatttttccgcaaaagcggcaccacacttccaattatgcaagaatgacctcacaaaagttcataagttataaaccaatttgcgaacactaagagggaagttgataacataataggcccaccatgacaaattggcacgactttggaaacacgccctaaggccacttttaaggggccttcttagggaaaagacaaaaagaattggcttagatatatccccaacgggggcaccctttttgttgagcacttccatttacacacttggacctcctttgaagagccttgtcttatgcccccgggaacaaccggggggaagcgcctcacactaaacttcattcagtggttcgaaaactttggccctcttgtgcaaaggaaatcctctcggctgtgtaccccttaaagaaactcgaacagggaaaacgtttcgaataggccttaaattccgaatcgccataaggaatacggtgtgatggaaacccaaccgcgttatggagaacaattatctctttttcgcaaacaaatgagagcctgggggcgcgatgtgggaatcttctagaggcacgcgggcaattgttgtgcggccatccgggcgcgccagttacggatataaattctcctcccgttttctttgaagaaaaagggcgcgcattatcaaacctctcacgtacgaagttggccacacaggaacactcttacacagggaa

SEQ ID NO: 542466 - DNA, 218 bp, Homo sapiens
  misc_feature (20)..(21): n is a, c, g, or t
  misc_feature (155)..(155): n is a, c, g, or t
  misc_feature (189)..(189): n is a, c, g, or t
gtaccttcatcagtgtaaannatattcacactgcttacaaatactgataataagcacacacaattattaaaggtgtaaaaggtttcagtaacaattaacagtttaatgcacatagaatcctagtacaacattagagaatatatattctctataancacatatggaagatgtataagaattattcactanagccataagcaagtattatcaaatttgaa

SEQ ID NO: 542467 - DNA, 141 bp, Homo sapiens
ggtatctcctctgctgtccggaatggcttggggcgtgggcggtgtgcccatggccatcatggagctgggatgccacgcgatgtcctcaaatgaccttgttctgccctggcccttcctgtcctggcctccagtgtggcacca

SEQ ID NO: 542468 - DNA, 127 bp, Homo sapiens
cactcatgcccagctcttatggttttaatttgtaattctctgataattattgatgttgaacatttgtcatatattttttggcaattttttttcttcttttaaaaattttgtttttagccataaggcc

SEQ ID NO: 542469 - DNA, 494 bp, Homo sapiens
cccagagggtaccagagatcttggagcatcacggttgggcgcgcggtcacgcgtgtaatccagcacttggggaggcgaggcaggcaaatcacctgaggtcgggagttcaagaccagcctgaccaacttggagaaaccccatctctactaaaactacaaaattagccaggcatggtggtgcatgcctgtaatcccagctactcaggaggctgaggcaggagaatcgcttgaacccgggaggcagaggctgtggtgagccaagatcatgccattgcactccagcctgggcaacaagagcgagactccatctcaaaaaaaaaaaaaaaaaattttccttaccagcagaaccaagagtgcaaccgggttgaacggagcccttaaatagatgtgaaacctacggggaaaattctttaaggcccgtgtcacagagcccccaaagagcagggcctaaattccggcaagggttcccagtaaaatggtctcaaaggctgagcg

SEQ ID NO: 542470 - DNA, 377 bp, Homo sapiens
  misc_feature (77)..(77): n is a, c, g, or t
  misc_feature (168)..(168): n is a, c, g, or t
aaagcactatggtgtgtgtggacaacagtgagtatatgcggaatggagacttcttacccaccaagctgcaggcccancaagatgctgtcaacatagtttgtcattcaaagacccacagcaaccctaagaacaacgtaaaccttatcacactaactaataactataaantgctgaccacactcaccccagacactaaccatatcctatccaagctacatactatccaacccaaagacaagatcaccttctacacgagcatccacataacccatctaactctgaaacaccaacaaagcaagaatcacaagatgcgcatcattacctttatagaaaacccagtaaaaaacaatgagaaaaatgaaataaacacagaaaag

SEQ ID NO: 542471 - DNA, 132 bp, Homo sapiens
ggcaggacactggcacaagagatattctggaaaagcccttcaggcaactctgagaacactaattgggtgagagggagaggggggcaggacccctccccagttctaggagtccttgcccacgccaccctggcc

SEQ ID NO: 542472 - DNA, 215 bp, Homo sapiens
caacgtgacttctttttactctcaccaacttcaacactttgggctctgcccaactcccacttaccgtgccgtgacgacgacgggacacggactacctgactttactcgtggactacgacacggtacaactggattactattgaggacctgggacgacgacggtggggacacggactgagggactccatcatagacgatcgacccatggcacgggc

SEQ ID NO: 542473 - DNA, 560 bp, Homo sapiens
tggtcgatctagagatccgaaaatgaatagaggcaggtctgggctcggctgccaggctggagtgagtggcatgccctccacctcctgggttcaagcaattcttggagctcagcctcccaagcagctggaattacaggtgtgcgccaccatgtccagctaattttttaatatttttagtagacagagtttctctatgctggccaggacagtctcaaacttctggcctcaagggatccacccgcctcagcctcccatagtgctgggaaaacaggcgtgagccactgtgcccagccagactcaacatttctaaccaatggtaatgttaaccattaaggaacacgtgtagaataccaaactagtaacaagtggttagctctagaaatgaaaagaaaaattgggattgaaaattgggattgaacaatacttccctttaaagattctggcaatatggaagcataatgtcacaatacctgaatcttacaggctatattattcactcattctcatatcaaaatcaccctttttggagattcataccattcagttattccaatactccc

SEQ ID NO: 542474 - DNA, 427 bp, Homo sapiens
gagcgaggcgcctcagaggactcccgctggggctttcgagtagcatcgcgcctcattggtatatggttagtgtgttggttagtaggcctagatatgaggagcgttatggagtggaagtgaaatcacatggctaggccggaggtcattagagagggctgagagggcccctgttaggggtcatgggctgggtttaactatatgatcggcatgtgattggtgggtcattcatgtgttgtcgtgccaggtcagcaggcttcatcagcacagtgtgcacacacgtcaggcttggcattcaaggcgcacagcgcatttctcaggcatgtcagtcagcacattcagcacattgtgcaagcatgctaagtgtcagcagggcacaggtcatggttgcatcattgctcagggtggcgcgcatgccaaatcgcaacag

SEQ ID NO: 542475 - DNA, 410 bp, Homo sapiens
cttttacgtacattacacacatacaccccacctcttcatataccttttatacacatacaggacacacacacaccccttacacgcgcaccctatatacacatgttgtgcacgtgcacactctacacatacacccacacccatttctcatatacaaacacacaaaacccactctatacatatgtgcacacccatttcacatacacataccacacacacacactccacacatacacccacacacactcttaaaccttccacacacatttgtgaggttccacacaccgacacccacaacccacaccccacttcacacatacacccacacttcaacacaatcccttcaaacataaacccacacacctttccccccctcacaaacacatacattttatcacacacacacacacaca

SEQ ID NO: 542476 - DNA, 339 bp, Homo sapiens
ctgtgaaaatctttcttttattactgtctcatgtggcaaaataacattttatacaaataagtcacctagtttactttggtcacttagacaataaaaactggaatgtgattttgggggaagcgggaaggaggaggaatgacatatcatgtcattgatgttttcttattttctgtaaaaaatagattttcaggaaaaaatcttttcttttacaatcttcaatgactttacacggtcctttgtaataccattggtaaatccatcttcaccaaattcttcttgaggcttgattcgttctgttacttggattgtgagttacacattggttcattgattaggctc

SEQ ID NO: 542477 - DNA, 843 bp, Homo sapiens
  misc_feature (353)..(353): n is a, c, g, or t
cagagttgcgccgatggagccggggccgcagagaagcacttaacagcgtgttgcatgcagccgtagaggacagtgggcagtgcgtctgaggaagacgtaaccgggctgtgattggcaccgtcgctcctatctgaagaggtcgccgcacgaagcgtgagggaatgtctcgccgtcgtgatcgtcttcgctcaggaatagactcaagtatgcgtggactggagatgaggtaaagaagatatgtatgcaacgtttcatcaaaattgatggcaaggttcgaggggactgtcacagtaccctgcgtggattcagtggatgtcagtcagacatcgagaagacgaggtgaacatgttcgngccgtggtcgtatgacactcaagggccgttttgcgtgttcaccgggatcacatttggacagaggcgaaagtacagagttgtgcaaaggtgaggaagattactgtgggagtgaagggaatccctcaccgtggtgactcatgatgctcgaaccgatccgggtacccagatcctgtcatcgaaggtgaacggatactgtgcagattgatttagggactggcaagataatcaactttatcaaatttgatacaggcaattcgtgtatggtgatgggtggagccaaacgtcggtcgtgtaggtgtgatcaccaagagggagaagacatccgggttcttgggatgtggtgcatgtgaacggatgccaagtgggaactagcttttgcacgaggctttacaacattgtatgtcattgggcaatggtaataaaccttgggattcccgtgccagggggaaagggcattcgacttactgttgctgacgagagagatacgagg

SEQ ID NO: 542478 - DNA, 901 bp, Homo sapiens
caggaggcgggcggcccgggcgcgagcgggcccccatggacgcccccagcacggggcggctgagaaccccgacgtcgcgtgcccagtcccggtccggcgcgccacgccgagggatctctggacaggacaagactccgaagctactcccccagcacacagcccgggacccacaaacccagctgaaaaaagaaagacacaaggagcgaagagaggggaaaagaacgaacagaagggaaaaaggaagaaaaggagggagggaaaagaagacacagaaagaggaagaagcaaaggcagaaagaggagagagagaaaagaagaaaaagaaagaggagcggggagaaagacaagaagaggagaagacagagcgaaagaaacgagcggcagcagaagcaaccaaacagacaaagaacaaacaccgccggcacaccacagacaaaaagcagagagagagaaagacgagaacacaaagaaagaagagaaaacaacgacaaaacccaaaccagacacacgagagaagccagcagcaaaaggcagcagcaacaaggaagagagaagaacaggagacggcaaaagacgcaacggagaggaggagacaacaacaagagagaagacacaagaccagcaaaaacagaaagaaccacaccaagcaaaagaagcaggacaaggcagcgcgagggacagcaagacaggaagagaacacgaaagagacgagaagaagagcagacgacgagcgggacgagagaagaagaaaaaacgaccgaggaaggaagcaagagacgagaagcacaacagaaagaggcacagaaggaacacgaacgacgaaacaccccccagacacagccagcacaaagacaaagagaaaaagaacaaaacaaagcaggacagaggaggaaggcaacca

SEQ ID NO: 542479 - DNA, 238 bp, Homo sapiens
gggggggggggggagaaccccccccccccccccccccgggggggggggggggtttttttttccccccagggggcccccggggggggcggggggttttttttttttggggttttttccccccccccccccccgggagggggattttcaaaagaaaaccaccgttttttttttttttatgggggtggggcccccccctttttttttttcccccctaaaatttttttttttttggggaaga

SEQ ID NO: 542480 - DNA, 247 bp, Homo sapiens
agaacccaccatggcgctgtctgctgccgacaagaccaacgtcaaggccgtctgcggtaagggctgtgcgcacgctggcgagtatggtgcggatgccctgaagaggatgtttctgtgcttcctgaccaccaagtacctacttgcctgactataccctgagccacggcatcatgccaggttaagggccacggatcgatggtgaccgacgcacttaccaacgccgtggcgcacgtggacgacatgccca

SEQ ID NO: 542481 - DNA, 263 bp, Homo sapiens
gttagtggttgtgggtagagagtctggaggtgaccctgcagacgggcagatgctggagagaagcaaaggcctttatttcacttggggtgtcacagccttttgatgtgtgaggttcgcccttcttattaagcgaattatttccagccacaagaaaccttgaaagattcctacttgagggtgcctgggtgggactttttaaagttgaaccttgaaacccttggcaatccaacttaacacgttgggtgggattccaggcatttagg

SEQ ID NO: 542482 - DNA, 701 bp, Homo sapiens
tgcggcacacgacatcgtgggtgtagaaaacataataacgagcgtactccgtctagcaaaaacgccacctctgctggtgtgacaaataaaggacaacagttctttaagccccccgcactccttttcttagcagagggctgcacactatatatataagtagaaaggaaatctgatattttggtctctgcgtcgtcttgtgtcccccccacaacatgatttttgaagaaggaccagaagctttttgatgacgcgcagatatactatgtgagggatatctcgcgacacatatctcgctggtctctccacacgcccccttcaagaaaaggggttggtagatatatttcgacagcatcatcatattgtgtcgagcagagagatacttcgcccctgccacggcaccttttggtgcgcaagactattcgaaagagatatgggtgtcctttacatcacacgagatgtggccgcgtcacacgcataatatcttgtatagagagtcacacaaggggcgctctagtcaaaccgcgcatgcacatcacatacctcaagatagagaggggtgcaaccactgataatgcgcgagagcggtgaaatagatatttgatagcggcgagagcctctctgcatgagcgagtcgcctttgatgtttctgaaacaacacatttggcagtccaccgaagggcggcccaacaaatagcagaaaa

SEQ ID NO: 542483 - DNA, 209 bp, Homo sapiens
tgaaactagctgtcttggctagccacctagtaacccctcggagatccgtaagcgaactcttcggactagtgagccctgatgcctttttgccagccatactactatatggcatccagtctctcgtggcgattgattatgcttgtgtgaggtaatcatggtggcatcacccaataaagggaacacatttgcactttatcttctcatcattt

SEQ ID NO: 542484 - DNA, 816 bp, Homo sapiens
ggctgctgggcctgatctgtctgtctcgtttctgtactgcttctgccctgacatcccggctcccggtgcgcccgctgcgagagtcgatcgaggagccacagggctgactggtctgctgcccggtgcccaggagtgtctggtgtagcagtcgctggagccatcccggcgttttgctgtccatgaccgagcatctcccctctagatgcgtgagctcttctctctacgcggtggctgctgagacatgagtgaggctggctggctcctgtgcctgcgggaccgtgagacgggttcgtgggcggccatttacgtggacgctgcgagcactcggctgcgcccctccggacgtggctccttgggccccggaagctcgcggcgggccctgcgggtagtgcgtgcattgtctccccgcctggagtgcctgcttgcgtcggctgagcttggtcaggcgtgaacgcgcgtgggacgtggtgtgcctagagtggtcgcttacttgcgtccggattcaagtgcccgcattcagttcaacggtgcctgcggcgttgctggtcgtctgcgctaggaaaatcagcgtcacgtcctcttacctgcccgtcttctacctcccctaagatgctcagcgacctgcgtttctcctacggtcacgctcctggtagctcggcttgtacagtgacgtacctggcacatgcctcgtgcctttaatggcggcgataatcggcgtctacgatctgtgacgaggagaggatcacgcctgagggatcttcacctaattcccattatctcctaatccttaacccgacataaataccggtttcctct

SEQ ID NO: 542485 - DNA, 361 bp, Homo sapiens
ccatagaaaaccttaaactttcacctcaagattaatcttagtctcagtgaaagacttgataattgttgatgaagtgctccatcagagccactatgcaaagactgggaaaggtgtttgcttctttggttttgtgttttctctttttctggtttgcttgtaaaatctcctggtattgaagaaaatctctgtcaaaacattagctgaacatgatgttaggaaacagacatgaaaagggatacagtccttggaaaaatagtttggaaaagtacctaaaccaatggactgctacaacatttaataacagtgacaacaacagcaaccactgccaccaacaacaaagtgtttcaacaacaaaaataat

SEQ ID NO: 542486 - DNA, 720 bp, Homo sapiens
gcagcgactctttatatggcgatgctgggtatcggcttcctctccctgaccagtgtgcccagcgagtcttgacgcattggggagcagtcccccgaagggcagtggcaacatcaagcagaggtacagattgcccgaaagcttcagtgcattgcagaccagttccaccggcttcatgtgcagcaacaccagcagaaccgaaaatcgtgtgtggtggcagatcctcctcttcctgcactaccttgctttgaatggagaagagaacaggaacggggcaggccctaggtgcggagtgggcatgcccatcttcacatggggcaccaggaacaccgtcatggaacaggaaggacatcgggcaggactgacaatgtgatcttgtgaaattgtgtaaatagtcgatcataaacagtagctaagagaatttgattattaaaatttctctcatgagtgtacatacgacatacgtcaagcgggaactatctatactctgtcaggcccttgacctggaatggagggcctgtgtcaaacactgttacggagaggctgatagtgtcatgtgatggtgagccacttcccaaagggactcatgaacaagatagcatcgagcgaactggaggaaatacaaacaggtgacgcacaaagacacggaagggaagaactccagcagacagagggacacgagaacaaaacagcggaagcacagaaagaatcgagaaggagaga

SEQ ID NO: 542487 - DNA, 100 bp, Homo sapiens
  misc_feature (9)..(9): n is a, c, g, or t
aattcaagncttctaacgatgtacggggacatgctcataaggaaaggttaaaaaaaaaaagttgtactgcaccagcaaatccatgatgatgatgtcgacc

SEQ ID NO: 542488 - DNA, 142 bp, Homo sapiens
gtcggggcgactctcgaggatccctgatatgcgtctcacacagtgaataggaccaagtgtccttgtaggatactaattcttctccactattatgatcatacttataaagtttaaaatcttcaccggctggaacaagaaattc

SEQ ID NO: 542489 - DNA, 365 bp, Homo sapiens
ggatgtaaattatacctcattaaggctgtttttaaaaagtataatgcaaactaaagttcaaaagcaacacaaatacaagattcttaaactgaaacaggtttcagttgtatgtcctcaagtattcttacttggagagacaaagcaagtatttatgaggtgatctttttttacttttatttgtattttgagtattcaagatagaaattaaaagagcatataaggatagaatggtattaaaaagtggacagtggctgggtgtggatcacgcctgtaatcccaacgcttcaggaggccgaggtaggcggatcacctgaggtcagaagttcaagaccagcctggccaacatgatgaaacctcatctctac

SEQ ID NO: 542490 - DNA, 172 bp, Homo sapiens
  misc_feature (59)..(59): n is a, c, g, or t
  misc_feature (100)..(100): n is a, c, g, or t
  misc_feature (114)..(114): n is a, c, g, or t
tctttcaaaaacaaaacaaaacaaaagtggcctaagatctcacacagcatttgctgtanagactgttttccggatggactggtttgggaacactgtgctnggggaagtgcccangaagcgctcccgctgccggctttccggagtctctgcccagtgcactgcggggacctgg

SEQ ID NO: 542491 - DNA, 1879 bp, Homo sapiens
  misc_feature (231)..(231): n is a, c, g, or t
ctcttgctcgtcatgttggcaggcggtcgactgctgcgaatatgaagacttgtggccccatcactacttgggttgggtgcatacacgaggagggtccttgcttcgtcccttgcgctgatatctggaactcctagaatcaggctcttgcgccaatggtatcgacacatgatagcacgtgaagacagcatgcccaagaactcattcattctcaacatggatgtgctcgttccntgtggccctccatgcgattgtgaactggctgggattcctcctatcctaccagcttcttattccgcattggttccctgccttcgttcgaaggcttgtgatgttggaacgctttgcgccttccacccccttagacggattacgcggccctcattcagcattggaactatatggatttccatggttgggacggaataggggtcaacagaagacctttgggtatccgacatcaggtccccttcaccagggcctggaggatcgatagggggcgttgtgcaggaggagggccctttcgcatggagtcggccggtatggtgcgcgcttgggttattcccacattcaccacatgtgcgatgtcacccaaaaggtggcaacaacttaatggcactcgaaaaaaggcaattgcgcactggtgggatgggaaccgcaatgcaggacatggtggggcgttgtaccccattgtgtaggagaatgcgaacggcctatggcttctcctcgacgcttgtgtggaggggccgaaaaccgttgcggttcacgtttagtctaagtgcggcgttgggcaaaacccaaaccaaatgacacggcggttccatatgtgttcagcattctgtagtttgggcccaatgtgtggaaattcgtcacacccagataatccacttggattaattgtagtacccttcaaccccctcatcctcggatatctaatggacccggttgtcggaagcattttttatcaccctatgaactgaaggcacctaagcctttaagcgaccgtggattctccagtttacagcaccttttgcgttgacgacgaccttgaggaggtccgattccacttttgagaaacccgcggaatggcaaaaccgccggttgccggaagttggggtgtgggtccccgagaaaataaaaaaacttgggggtgaagacatgggcaggacagaggaccgtggtaatctcagaaggagcgctgggacccccacattataaagaaccgtcttggccacacaagagagaagctggatgtcgacaggcagcgaaacttacaacacgacggggaaggcacaagtgcagaggcacacaacacacaaaagtgagacaagaagacaccatataccaccgacgatataaagcaaacaatagtcaacaaaggagacaaaagacctagtggtagtagaccacccatcaaagacaacagggacaccccaccaccaaaaggagcggcagacacaaagagcggtgagagaacctgcacgggacacacagacgagagaagagaccaacaaggcgcgcacaccgcgaagagggaagaaacccccataagacatctccccagaaatgacagaccaaagaaccagggaacgaagttacgacgcacccataacaggagacggacgcgggaggaaacacgcgagagagcgaggacaggacggaacacaccgagcgccaacagggagacagcgatgccataaagaaaaagaaacggagcaagatgggccagaaccacggggcaaaagaaagaaaaacaagaacagcgaggagtgggaccccactgggtgagaacgtaccccacatcaaaacagaaggggagacgacccccaagcaggagaacagcatgaggagagagcgactacgctacgaaagcacgaggaca

SEQ ID NO: 542492 - DNA, 970 bp, Homo sapiens
gcggatccgcggtgcacaagatggcagtgcaatatatccaacgcaagaggaagttggtcgctgatggcatctacaacagctgaactgaatgagtttcttacttcgggagtctggctgaagatggctactctgtgagttgaggtgcgaagattacgaccgaagcctaggacagaaatcattatcttagccactcagcaactacagcaatgttcgtatggctgagataggggccggtcggtagttcgggacatctgagctgctgctagcttcaaaagacggttaggctttccagagggcaaggtgtagagctttatgctgaaaaggtggccacttagacggtctgtgtgccattcgtcgccatggcagagatctctgtcgttacaaatgtcctaggagcggcttagctagtgctgagagggcctgactatcggtagtcgctgctggtctccatcattgcgagacgtcgcgggccaaaaggcttgccgaaagtggaggtggtcttggcgaaactccgaggacatgagggctaaaatccatgacagtatgtgactggcctgatgatccgacagcaggaagagccatgcttaactactacgtttgacactgcttgtgcagccacggtgtggctcaagaccagggatagtagttgggcatcatctgtgaagatcatagctggccgtgggacccaatcatggtaaccatgtggcccgtaaagaaggccccttgacatgatcacgcgtgacgcatcgtggaagccaaagatgagaatactgtaccaacaacgcccaatcgcaagaaccagacagggtgggaaagccagaagcaggcctggcaggcaccaaacagtacccacagactaacacagggacttacctgggccagctggaatccaggggagccccccgaagcgatccactacgaaaagaccgttagccacaactccggacgacggacacagaagacaacaccc

SEQ ID NO: 542493 - DNA, 1107 bp, Homo sapiens
gaacagacctccggggctccggggagaagcaatatgttaaggatacctgtaaggaaaggccttagtaggccttgctaagtctcctaaaggatgtgttcggaacgaactgccacgagcatgcaagcaacgttgatcgaatgtattagtcgatggtcagatctgtcatggtagaagcgggaacgagcgtcctccaagcttgtgagaagggttggcaatgcaagatcccatcgatgtctgtacatcatgcaaacggttgtcatggttgctggaaactgcggcgatgtgcctatgtgaaattgagaaagcccctaaggttggtagctgcttgtgccatgccaggtaatgacaggcgttgcaatatcctaacaaactcagaaaaatccaaaaaagccagggaaggtgtgatggacgttcttaatcagcaaaatcacccatttggacctgtcctatgatggtgaccaggggaggtgactgtgagtctgcaggcatcatgtccatgatgctctggcacatgactagtgagcccgaatccttaagaaggggaacagcgtgctggtgtacagaaccagaaacatttggggcccattctgggtcaaaggaccaatcaatggacccagcatgtataaccgaggggcaccacggctggccatccaagggaacggcaaagatcgacgcactcgccagcgaacgcccgcatcacacacgggcgacaccggacacgggccagaacgggaaacatcggatcatggccacaggaatggggcaccagttaccgactttgtgcaaacacccgacatcgcgttcacacgggtccctggcagaagcgctgcgttcttggggcaaaacataactccaacaatcgtaggacaaaattccaagggaccacccgggtataaaacaggatgtagccgccataacagcacagccgcccaaaaaagggcgcgcgccacaaagggacgcccccaattaaacaaaggggtacccacggggcgccccaacggtggcgaccgcgacagccacatcagagcgacaaacggacaaagccagaaacaagaaccacgcaacaaatgaagatcgcgaaacataccgaagacggccagcacaaag

SEQ ID NO: 542494 - DNA, 257 bp, Homo sapiens
catttcatccctgaaaaataaacactctagagtattagtgtctcagaggtcatttagttgcctccttgtaacgcaacctgcatgacaatctccttttctagacctcctgagacatagatggtagaatctctgggcagcagtccttgtggtactcgcactcagtgcctggccaagaggtccataatgagatattctgtgcgtctctagagtcagaacattcctttttcatcttccaccgtggattccttctaatgctt

SEQ ID NO: 542495 - DNA, 401 bp, Homo sapiens
  misc_feature (41)..(42): n is a, c, g, or t
cagcaggcgtgggcccagataagatgtcatgtaactctttnntttttatcaaaaaaaaattttttgacacagtatcttgctgtgttgcccagactggagtgcagtggcaagatcacggctcactgcagcttccaactcctgggctcaagtgatcttcctgtcacatgagtctcccaagtagttggaacacaggtgccagccaccacacctggctaatttggtttggttttgtttttttagagatgggctcttgctatgttgcctatactggtctcgaactgctggcctcaggcaatcttcccccctcggccacccaaagtgctgggattacaggtgtgagccactgcaccctgcctcagtacctccattcttcccacacaccctcctcatgtgctccttcc

SEQ ID NO: 542496 - DNA, 950 bp, Homo sapiens
agtctgcctctcactcctcagatatcacgaccatgtctgtggttgcaccttagcgatgtccttatgaatgacctgctccatggagctgatggacaatcagctttcaccgctgtggaagtatccggacgacacataggcagcgcctggccttacgactcgacgagtagacacatgaagacgtgctatctccagagtccatagtatcattgcccacggctgacgctgagttgatccatgattactctagtagcatcctggatcggagagactgcacatggggctacccatctaaaaagactttatcatgagataattgataacgcatcgtctatggcgggcagtaccatctcctgaaaatcagctcatggtcccaacgctggattaggcacctattgccttggagttccagaaaaggagctcgtcggaggttagtctcagactatgggcagtggcgtgctatggggctttttgaatcgtccttcggatcatctgtaacatcacattccactcctgcccaaacatcgtgcactcaggactatttgaatatgctcggatgtatcccataaatgggagtccatgcaatggggtgcggtgtccccggtcgtgaaccgtacgggcttgtgaggatccgaattctggtcattctgcatgatctaacatatcgaacaacctggcctgtactgaagctatgggggttcacggattataatcatattgctacactaaatgtgtgtgccgaacatctgtccgtcagtcgaggcacttactgtacattgtgcctggacttaatactgcctaagagaaaaacctatacaaggctccttgccgtctgaatggtgcctactgagtactacctgtcttattacactggggaactgtagcgtatcaggcccgtaacatcatacccaatgaactagcggaaatccgggggaccggtgctgtccactccc

SEQ ID NO: 542497 - DNA, 269 bp, Homo sapiens
  misc_feature (148)..(148): n is a, c, g, or t
atctaaggactgtgacggaagcagtcactactgtaacaaatgatgtaggcgccggaatatgacacagggcggtgcaacagtgaacactttgtgcacgaacgccgcctggtagatgtccagaatgtctgtttccaggaaaaggtcaccntgcaaggaaaacggtgcagtggcaacttgctacaagagcaactccagcatgcacatccacaagaactggcgcgcctgacaaacggctccaggtacccccaactgtgcatacctggacagcc

SEQ ID NO: 542498 - DNA, 315 bp, Homo sapiens
  misc_feature (61)..(61): n is a, c, g, or t
  misc_feature (78)..(78): n is a, c, g, or t
  misc_feature (162)..(162): n is a, c, g, or t
  misc_feature (169)..(169): n is a, c, g, or t
  misc_feature (179)..(179): n is a, c, g, or t
  misc_feature (298)..(298): n is a, c, g, or t
  misc_feature (307)..(307): n is a, c, g, or t
tgggatgaggtgcgttcagaatcgttccgcttcgtgattattgatgaggcgttcgggcgcngctcggacgagtcagcngagtacgggctgcgctattccaaaagctcaacctgcaattgttgatcgtgacgccgctgcagaagattcacatcattgagccgntcgtctncagcgtgggnttcgtgcaaacaagggcggggtgtgactcgcagctacgctgtctgtccgatttgaggagtaccaaaccggggcggcagcttgagactcatcgggggatccttctagaagtcgacctggnaggccatgncaaagctt

SEQ ID NO: 542499 - DNA, 1819 bp, Homo sapiens
  misc_feature (495)..(495): n is a, c, g, or t
  misc_feature (1175)..(1175): n is a, c, g, or t
  misc_feature (1183)..(1183): n is a, c, g, or t
  misc_feature (1607)..(1607): n is a, c, g, or t
tcaacattgagtagctgaccttgacttgtatgcacctttgttggtgtgttgttgtcttctgccagatattgttttcgcgtactgctactgtttgtcgtcgctgcgcgtgagtaatgatgtatgaggcgctgcgcatgccttagcctgatgttcttctttcatcatgctgctccgggggtgtcgcccgctcttctcctcctcgagggtgtgaatcgtcgttcttccggcgcccttggtgatgactctccctgctttttctcccgcggtgtttctcgcgccgggcggcttgcgcctctaacacggggggttcccccgggggcaatgttttgttaggataaccttgtggagaggtgtagaagaaggagtggcacgcaagacacacgcgttgttgtattggttgatgatactgccgtattgggcgcctcaggaatttgcttgtgggtgtttctcccaaccaaggaggttgaataggatgccactgacgcctgttgctcnctggacggacccaccgcccagatgtgtgccccccgccgccgtcccacagaaaagatggtgtgtgcacgcaaaaaagcgggaaggcgttgcagaacgccttcgggtgggtgtcaccccacggggggcgcccccccaccgccggggaattggtggaaacgccgcaagggtgtcggaaacaacaacgataataagttgggggggaggccaacacatatgggtgggcacggaagagcgcgttgcccataaatgcctcctcttaactggggcggtgtcttaccccccggagtttttccagtggggttctcggttttcctcaacaggaggacacattctcggggggccacacaacacaccacttgtttgggggcgccttcttaatatcttgtgtcgtcacgacacacacagcggctggccgcacccttttggagggtctctactaacacgtgcgcatgtagcagtgtgctagcacgccggtgttcgaccaacaaggttgggggttacaattgctcgcggcacttggagacactgtccctcacagagactctcggggggacacacacaacacgtttcggcgagggggtccctcataggcccgctcaccactctttcagcttcacacacacacacggggtttttttactctctctccgcactctcggggagcacacaccggcgggttntttcttgnacacatattctctctctcgcagtaaagacgctcatatttgtcacgcgcgggtgctcccacacaagtatagtgtactcacgctcacacaccggcggttgtcatatacacacgctctgtcgcgcacacacactcacgcggagacgcatacttagacatatatatcactttctcggcgcgcacacacacatgtggtgataatagagaagagacaacgagacccacccgccccaacgtgtggagagctccacactggagagttcgcggggcacccgcgctctgttggagactggaagactgtgaacactggataccgcttctgggggcacaccctgggagacacacgaggagaggccacacccgaccaacgaacagctgggagatggcgcgtggccacacccttacacacccaataacccgccacagncacagaagaagattttccttgagccaccgagatgagccaccacatccacccacatccagtccaggaccatggacattggaacatccagaggatggggctgttcatagacagacccccccgtagggactgtcaccgaatggccttctgaactgggaatgtggagactttggcgggtggagaggtttgaattaaccgtttgtgtcaatggccaa

SEQ ID NO: 542500 - DNA, 304 bp, Homo sapiens
  misc_feature (15)..(15): n is a, c, g, or t
  misc_feature (125)..(125): n is a, c, g, or t
  misc_feature (196)..(196): n is a, c, g, or t
  misc_feature (286)..(286): n is a, c, g, or t
  misc_feature (288)..(289): n is a, c, g, or t
  misc_feature (291)..(291): n is a, c, g, or t
cctctagagggatcncccagatgagtctcaagctgccgcccgtttggggtttgccacggcttcatggcatcgagcctaatgaggtgaacgtgacattgccattagcgcgttggccacaccctggncctgggcacgacccgggtaggcaagaccaggctcgccgaactgttcatcacgcaggacatccgccgcaagnacgccgagggcgagcacgaggtcgtgatcgtcttcgatccgaaaggcgatgcggaccttctcaagcggatgtatgtggaggccaaacggncnncngcttgagactcat

SEQ ID NO: 542501 - DNA, 387 bp, Homo sapiens
  misc_feature (21)..(21): n is a, c, g, or t
ctataaaataagggcccaggntgcggtgtcatgctgtaatcccagcattttgggaggctgaggcaggcggatcacgaggtcaggagttcaagaccagcctgaccaacatggtaaaactccgtctctactaaaagtgtagaaattagccaggcatggtggcacgcacctgtaattccagctactcaggaagctgagtcaggagaattgcttgaacccaggagacggaggttgcagtgagctgagatcatgccactgcactccagcctgggtgacaaagtgagacactgtctcaaaaaataaataaataaataaataaataaataggagtcaatagagctgcaacatagaggcatgtgatgagcttgaagcaaggtaggcggggtctgg

SEQ ID NO: 542502 - DNA, 167 bp, Homo sapiens
tagaggatcccgtctactatagtgtgtccatatgttaaagccactttcgtagtctattttgtgtcactggaattttttacaactcaggtgagttttagctttattggggcgggggtgatctcaaacattctttacgccggcttctattgaacttgggttactcgtgt

SEQ ID NO: 542503 - DNA, 260 bp, Homo sapiens
  misc_feature (81)..(81): n is a, c, g, or t
  misc_feature (152)..(152): n is a, c, g, or t
  misc_feature (242)..(242): n is a, c, g, or t
  misc_feature (244)..(245): n is a, c, g, or t
  misc_feature (247)..(247): n is a, c, g, or t
tgggatgaggtgcgttcagaatcgttccgcttcgtgattattgatgaggcgttcgggcgagcgcgttggccacaccctggncctgggcacgacccgggtaggcaagaccaggctcgccgaactgttcatcacgcaggacatccgccgcaagnacgccgagggcgagcacgaggtcgtgatcgtcttcgatccgaaaggcgatgcggaccttctcaagcggatgtatgtggaggccaaacggncnncngcttgagactcat

SEQ ID NO: 542504 - DNA, 519 bp, Homo sapiens
gcattctccgtgctacctgcagaggggtccatacggcgttcgttctaggattcccgtcgtaacttaaagggaaattttcacaatgtccggagcccattgatgtcctgctgagaaggcagtgaccaaggagcgaagttccatgggtgtaatgggactgctcccgaccacctgagtagcagccctgactcttctttctccaatctccttcagacatctctgataacttcctaacagcatcactcgctgaacgcagacctcgcaaccgctcctccacgcaagcaccctgcggccaccacgcggtcctgcataccaagcgcccggctataaacccgttaagcacaacccgcaccaccccctgaaatgcccgacacaacagcgctgagataaccacccaaacgcaagggcaacattaccagcgaactcggcagacagagatcgcaactcgaaacgacacagagcgcaggaacatgccagacatggcgacagccatacgcacccaacacagccgctcggccacac

SEQ ID NO: 542505 - DNA, 386 bp, Homo sapiens
gatcgaatccttatctccaactggggagttccgtgtggaccgtgaaggttctccagttgctgctcaactgtctcatgtcaatgatgtgttattatcgctttggacaggtttacacagaagccaagcgttctccaggctttgaccgtgtccgaaatgctgatattgggattcaagactttgagcttgatttcctgcaggatagcatatatcacagaacattggctggtcaggatatacaacgtcatggatctgaataatctaggcttgtcaaggacataaatgtcacgtccagctctgatatgcttcgcactgagcacatcacatttaggacgttgaagattttttttaataatatttttattaaatatgcagttggaaaaaacaaa

SEQ ID NO: 542506 - DNA, 864 bp, Homo sapiens
  misc_feature (48)..(48): n is a, c, g, or t
  misc_feature (77)..(77): n is a, c, g, or t
  misc_feature (325)..(326): n is a, c, g, or t
ctgagtgtgagcttaaagtcccctggcttttgacccaaaatcttaagngtctgggatcgtggcttgaactcggcccngcctgggccccattgtaggaaacgtggctgtaggacagaagcctgtggtgcccagccccttggaagggctcagatgtgcccagaacgaatgccttgcctgcccatcctcctggggctccctagaccccaagccaaagcagagatacctgttatcaaaggttggggaagagcctccaaggcaggggcaaaacttccaatatctctttcccccaaactgatctagcttctccttcaccttcccccaccgnngccacccggccattttaaagtttagtggctgtggacttttagaatttggtttggtctgtgatccttaccgcacagacccaatgaccaccacctctttctttttgtcttttatctgctctccttttgagggggaggaaagtgctggcctgttccatcaagcccagttcgcatttgctttagcctctgatttctctttcttctttggaaatttcattgagatgtctctgtacttcgcttgtcagttatctttgttccttttaaataaagggcttttaaatggacttattgctcccagcgtgggttcctctctctaaatgttagaaaattgtgccatctacccgctatgctgagtactgtcacactcggagacctcggggacctccgggcaggcttcaatgctgcagtgtcaggggccgcgggcagcaggaggagggggcggctcacgtggatttttacagatctccgcctgcagccggcccgcgtggccacgccagggcacggcccgagacgcgcgcagccgccagcttgatggcggccg

SEQ ID NO: 542507 - DNA, 536 bp, Homo sapiens
  misc_feature (136)..(136): n is a, c, g, or t
  misc_feature (388)..(388): n is a, c, g, or t
ttgctggcccccccatatagccacccgcccctttcgcgcatgggattttttgggccttattatgtgttgcccaaggcccgctttgtggctcttgttttccgtttaaaaaaagaaagggttttccggggggattttnttctgtgggcgggggttttaaaagtcccccccccgggggaaaaattttggggtttgggtgggttttttttccggggggggccccccccctttttccggggaaaccggggcctttcccccccggggggtttttccccgtttttccaaaaaatggggggccgggcccgggccccggcccccccccttttttttttttaggggggggggttttcggcccccaaattcccccgggggggttttaaaaggtttcccnaccccaaaaaaaatgtttccccttcccccccgggttttgggcggggggccccaaccccctttttccccccaaggggccccccccttttttttggggggggggccctttccggggggggcccccatttattccggggccccccgggtta

SEQ ID NO: 542508 - DNA, 239 bp, Homo sapiens
  misc_feature (37)..(37): n is a, c, g, or t
  misc_feature (126)..(126): n is a, c, g, or t
  misc_feature (147)..(147): n is a, c, g, or t
  misc_feature (174)..(174): n is a, c, g, or t
  misc_feature (182)..(182): n is a, c, g, or t
  misc_feature (212)..(212): n is a, c, g, or t
ctgaggttgacctcaggagatgatgagggctccagangatgatgtttgcagaatcctcagcacgttgcaggcagctcagagcctgcccaagagatggatgatgccctttctagcccagagttccanttccagttgatacccccaggntggcattgatgcccacatcacacacgnatcctctntgggtgggatcacaccagagcactattaanttgtgggaaattcacagtccccatcct

SEQ ID NO: 542509 - DNA, 267 bp, Homo sapiens
tgggctgcctgggttttgttgccctcctttgtgggggcaggacctttgtggggttttgtgccctgttttggggcccagggggggttggtccccattcccaggccccaacagcctttaaaaatgggtaaaggagcttgccctccttgggcccccccccttggtgatttgcccccccacccccagccctgtccctgccccccctcttagtggggattagtgaatgacttgacctgtgccctcaatacaataaatgtgttccccccccca

SEQ ID NO: 542510 - DNA, 298 bp, Homo sapiens
  misc_feature (30)..(30): n is a, c, g, or t
aacatttacatagtagataagtagtacatngtggataacttctacttttaggaggactactctcttctgacagtcctagactggtcttctacactaagacaccatgaaggagtatgtgctcctatgatacctggctatgtgctcttccaaaccctactttagcccttcacacatcgcactttaagtttatgatgctgaaggatatggaagacacagatgatcatgatgatgatgatgatgatgctgatgatgatgaggacaactctctggctccaacaagagaccaagacgcctgggg

SEQ ID NO: 542511 - DNA, 327 bp, Homo sapiens
tgtctcatatataggtaacgctctaagactcctgagccatcttttatgtaactggcttacctaggcttggcgcttgaacataatgtaacagaagccaaggagttcagatctagatagcagagaagtaagtctcatactaaaaacattgcaactactgttagagtccacaccatgaagctgtatcagatggtgtatctttgactgaattctataagtatatatggaccagactaaaactaatgtggctagctaggtgggctgacgtgtctcagtaggacatggacagactccagcttccaccctcgagagaccttggacctaagtgcc

SEQ ID NO: 542512 - DNA, 762 bp, Homo sapiens
ggctgccgtcgccgcgccatttggatggcaggaagagtccggttctggacagctggagacagtggtggtgactgaaataactttaccaaaggaaagctatttgggcgaactatcttctccagcggagatggcccaatgtgcttgtgtaacagagccagactgtttcctaatctcccaggattggctctttagtaaaaagggtgtgtcaatcccaaaagccttttcgatgcaggatcatcaggtcccggatgagtctcatgtggctgtgacctccagatatatgctctcgaacagtgtgcctgatgaaactatgggaaccccttgtgaccctcaagatcagaggtcccagcttcctgggaacataggtttggatgtgtcacctcaatgggactgttcacaagaagaaaagcctgttcataaaactttggtgcctgatgtctagcagaacctttatcagtgaaacgccatgagtttgtgatggcccatatgtgactgaacttcaggggtaatgatgcacctggtgtgaacaagaaattaaccagtgcagaaacttacttgtgaaagtgccagagtagatgtggtgcaatacaaacatgtcagaatgggtgggaaaagatttgggatcactgtttccagaaagtagctaatggaactaatgattctggttgtaacacaaaactagaatggttgactgttgggtgacaattaaattggagagagggttttaaaagttctcatggggtcaggaaatgcatgttcgtg

SEQ ID NO: 542513 - DNA, 224 bp, Homo sapiens
  misc_feature (4)..(6): n is a, c, g, or t
ggtnnncgaccttttaaacctcttccacccctttatcacaaactggaagaaacaacctcctggattttactccctgcccaatcaatggacccctttgggccattaatattgatttatcttcaacacttagcaggagacaaaccggaacccccttcgaccttgccgaagggaggtccgaactagtctcaggcttcaacatcgaatacgccgcagccctgtcgacg

SEQ ID NO: 542514 - DNA, 99 bp, Homo sapiens
  misc_feature (67)..(67): n is a, c, g, or t
aaaattgtgtaggcgaatatgaaatatcattcgggcttgatgtggggagggtgtttaaggggttggntaaatataattgtctgggtcgcctatgaggtt

SEQ ID NO: 542515 - DNA, 941 bp, Homo sapiens
gaatagtagtatatggctcagcacctcatatcctccctactatgcctagaaggaatattactatcgctgtgcattatagctactctcataacctcaacagccactccctcttagccaatattgtgccgtattgccatactagtcttgccgcctgcgaagcagtgggtggaaggctagccctactagtctcaatcgtccaacacatatggagctagaagcgtgacgtacataaccctgaaaacctactcgcaatgctaaagactaaatcgctcccaaacgaatgtatatctacgtgacgccacgtgacagtggactgtatccagagaaaacacataatctctgaatcaggcacgaagcgcacgccacgaggcgtaatgtattgagacatcatcccgtcgtactatgtttggtagccgaagtcaagaacatcctatatagactgttgcccaacctgttcctccgaccgcctaacaagccccctgctaatagtagactgagctgagtcctaccccgtcaggaagtcatgggagaggccgaggtggcgcaacttgatccgagggaaggcacgtatcactgaagaaacactgctacctctctgatatcggaactcgacccctacaaatctcgttagttataaccattgacagtctcagaactaaatgatatttcatatacttaatcacgacatgcacaaattatacaccaatgttgtggtaatccagtcgacgccgatgaggcagaccagattcagatacgccttggaccgccaaggccacataactttcatatactagcgcctagtaaggtagcactttcccctaggcgtcgcatggtagcacatcaaaagacttaggctcagtagacctataatatcagtctcatggccagactattaaagcttgagcaagagttatgtgataggtacaaggttatggaagata

SEQ ID NO: 542516 - DNA, 309 bp, Homo sapiens
ctggacaacgtattcctatggaatcattattgattgatctcctaaggggatgtttagcttgaattgcacctctctgctctgcgtgccacggccacactatgttcagctggtctgaacaaaattgtcagattgtagaaatgataagaaatacggctagggttcctattatctggaaccatagcggtgtagtgtcacctcaacctcaaatggtatggccctttgtaggagctaaacattaggatttgtggaaactgtttatagctcttaataagatcataatttgggacagaataaaaaagcatctagaag

SEQ ID NO: 542517 - DNA, 188 bp, Homo sapiens
agctagtgagcacttccaacaatgtagaatccaataggagaaacagaatggagaatccagatggaagtccaatacacgtcaggcaggccatcgggtgcgacactaccaaggtccaccccagaatactcaccactcactccagcgggaagatcacattgtaactggagcttgcccacttcctagagttc

SEQ ID NO: 542518 - DNA, 408 bp, Homo sapiens
  misc_feature (5)..(5): n is a, c, g, or t
  misc_feature (61)..(61): n is a, c, g, or t
atatnaaaactgcaaccatttggaaacactggccaatgatgattccttttaaacactagtntaactccagtggtcattgttgttaaactgttcataatttctattcctcagtaatatgacccaatacttcatgttaccttgtgtattatgagtaaggttacataaataaaacagcaagataattctgaaaatttcttgcctcaattccaagggtaaagacaactatgagttactagagatactaagaattactagaataactaatagttactagagatagtaagaatatcttaagtttcataactggttaagatgttttaaaaattaaatataaaattatgatctattggattctaaaggtatagtctgaaaggtcatgtcatttggactgtgctttgttagtaaagc

SEQ ID NO: 542519 - DNA, 282 bp, Homo sapiens
tcgcccggccacgtccgtctggaacacggcctcgaccaggtgctcgaccacgctgcgcagctgctcttcgctgccgcgcaaggcgtcgaccgcgcgctgtcggtcgagcgcaaacgcggtgtgcgcggcgatgttgcgcacgagctgcatctcggccccgccgaactcgtgccgctcggggcgatagaccatgaattttccgatcgtgccgccgccggtgacgagcggaatcatggccagcgcaccgatgccttcgtcgcgaaacacgggcagaaagtcgcg

SEQ ID NO: 542520 - DNA, 141 bp, Homo sapiens
cacataagacaaaatccaaaactcttagatgaacacatcaaaaagccaaacatggagtataacatcctgacgacaggacatctatgaaaaacccgtagctgatatgttgatgcaaactactgtaaggccttcccccccaga

SEQ ID NO: 542521 - DNA, 202 bp, Homo sapiens
tcatttcaggccatcctgcagcccccagaaccttccacatgaaatgaaaggctccccccttcataggctttaaggaaatttttggccaggtgtggtgcctcactcatgtaatcccagtgctttaaaaggccaaaatgggaggattgtttgagccagctgtttgagaccagcctgggcaacgtcatgagcccccatctccata

SEQ ID NO: 542522 - DNA, 419 bp, Homo sapiens
  misc_feature (102)..(102): n is a, c, g, or t
  misc_feature (374)..(374): n is a, c, g, or t
ttgctcactccagggcctgctgccacccagatggctggcaaacaccaggactccgaacacaacaggattcagggattcagacaggagtcttgctctaccaanttattataggatcttgagatgcctttcccaggtaaagcttaacaaaaaaacaaaacagaaattaaaagccatatccagaaatactaaacaggctgtctccaaggatcagaagggcgatcagaaaagagccctcagagaggttgtctatatcccagaaggaaggatcttaagtgggggatggtgctccacagcaggaagaccttggaagatttcaggggaagtgaaattgttattgtcagagactttcagataaatatgtaagccaccgactnctgggagcgattaatataaagaattaccaacaaagcagaaaaaag

SEQ ID NO: 542523 - DNA, 340 bp, Homo sapiens
  misc_feature (67)..(67): n is a, c, g, or t
  misc_feature (167)..(167): n is a, c, g, or t
  misc_feature (192)..(192): n is a, c, g, or t
  misc_feature (203)..(203): n is a, c, g, or t
  misc_feature (214)..(214): n is a, c, g, or t
  misc_feature (309)..(309): n is a, c, g, or t
  misc_feature (327)..(327): n is a, c, g, or t
ggtctcttgaagtttggggtagtcaagaagcattagaagaagcaaaggaagtccgacaggaaaaccnagaaaaaatgaaacagaagaaatttgataaaaaagtaaaagaggttgttcccgccttcctgaataggcccaaagggctgagactggagtagacactgtanagattagacacaaggagcttactgngcaggtttctnagaaggcttanaacagagaggaattaaaagccaggctgtattttagtttgggaattggacctgggtcctctttgggcttctgatttgatccccaagaacttgcccnagttacttcttatggaanttgcgctagcagt

SEQ ID NO: 542524 - DNA, 334 bp, Homo sapiens
aacagactatttcctgaactgtaacattctcaaacactgcatacacagagaggatatgagacatggcatttgcggataggaaatgaggaaattttgcgataggacagctgtagatcctgttgcggacacccagccgggcagttggaggcggggtcagtccagaagccttcagataacaccagggtgtagtcctggcgagaaatcttcagttgcttcaggaccttttctagccccacgcgacggctaggtcctccgtgagagaaaactggttcgagaagcatggccaacattcccaatgatccgtgagtattgagaagttctccatgttctccca

SEQ ID NO: 542525 - DNA, 1166 bp, Homo sapiens
aggaaagactttttttcgaaggcatcactgttaggttgggggaaagatttatttttgaaggcatcactgttaaatgaggtttgggggctggtgtgcacatggagttatttccccccaaattctgggcctcatgtaggaaaacctaaaacatagcaaatgggatatgttgttatggctcttcaggtcagcttagttctcattaataatactttctcctgcgttaatcacagctatgtgtgtaggaaagggacaacagtaaagtgggtaggttaaaatttagaactcctttgcttcatgcacccattccttgtgctgaattggtagtactttagttgctttgtgagaccttttgaaacaacataattaaggacctattcataggagactacaaagtgttcctttataagataacacattcatttgcattgacccttgatgactgggaaagcaaatgccacatgacccatgtgtattttacagagaaatccggctaactaacaggagtcacactgggcgtggtggccttattcctgtgatccagcacttcgggaagccaagacgggtggatcatgaggtccggacgttcgagaccagactggctgacatggcgaaacccttgtctctgttgaaagtgccacaattcagccgggtgtggtgtcacacgctttgattgctaagttagtcgggaggttgaaggacaggagattactcggaaccatggaggcaaagttggcgtgacccacgattgggccattgggctccattctgggcacacgacagcttcgtttcgacaaacaacatctactctacaaacacatctttgtcggctccctctcagagttctaacacaattggcgcggcccatctgtcgacccgggacaagtgcccaaagaaccaggccagaccggggggtgcttcccaaaaaccggggacgcgagcgtaacaacaagttagtgacttgcacatgccgaccacaccccggccacgccgagcagcaccaacaagagacgacgaacgcgcagcagaacaacgacgttaactccctctagttgacgcgaagagagaccaacgtaagcgcaagcgactagacacacaccgagcagactgcgacaaccagaacgaagccacgccacaggcgctcgaatccaccagacacagacagccag

SEQ ID NO: 542526 - DNA, 241 bp, Homo sapiens
  misc_feature (133)..(133): n is a, c, g, or t
atacacccctcgttactacacagcatcatgataggggtagacgattaggcagctaattaaacactgcgaagtactggcacgaccaatacactcaagataaaaatttgaaacctattcctacggtacggcaacngaacatagagtctattacaatgaggcacgtgcgccactgatacttttccaaccggtaaaatgtactagacccaccgtaaatgccgacgtagatgaagacgtcgcatca

SEQ ID NO: 542527 - DNA, 625 bp, Homo sapiens
  misc_feature (163)..(163): n is a, c, g, or t
  misc_feature (275)..(275): n is a, c, g, or t
  misc_feature (407)..(407): n is a, c, g, or t
aaacttctctccctgaggcctgacagttatcaagtgaaatgagctgctgtggtttaccccaactctagcactccctcctgtctccagtactctccacagcaataacctcttttgtgagactgggcatatgctgaagcaactggaagtgagttgtctcaagttnacttggctttaactcccaagaccccagcaaatgtctttctttcctccttttgtgtcctttcaccatccctcttcctttgaaaaaatgattatcagaactgtcatcctgatgnttcccttcctaactgctttttatggatgattgtgaccacttttttcatctgtattcagcagtagtatacacctgtaatctctcttttttcatctcattttccttcccctgtggctagaatcatgctcagaantaaaaggaaattaaagctttccctggattctgttatcttttaaattgctctccagtggttctttttccagatttctctaaaggaaggctattcccttgctattcagagctgtgtccaaggaccagcacaaacatcacctgagtgctcatgagaaatgcagactccaatacctgctgagtcagaatgtgcactttccagaagctcctcaacgaattcat

SEQ ID NO: 542528 - DNA, 333 bp, Homo sapiens
agcctctctgtaggggacatgctgtccagcgcattctctgctgacacccagatgctcatattctagttacaacagctgtgtgctttgcagtggagatgcagcatgatggctctgcctgtccttgggcgcgcagtccaggatggagtccccttggatctgagagttgccccggctcttgaaactcttcagagtgaagcgggtggttaggtgggtctcaggtcctggctcgcactgggagatgagtgtgtttggttgtgaggttcatgaggcaggagaggttgtgtcggtatggctggagggtagccggcgctgcagctctaatctggtcgcatg

SEQ ID NO: 542529 - DNA, 174 bp, Homo sapiens
tcggatgtacacagaacacaaatggggcgtttttcaaggtgatttatcaaaacaaaaatgaggggtcactttcaggagatcggaagaggtgaaaatagagccaattcccgtgtgtgctcctttccccttttcccggcatagggttctctcatctggtagagattacggcaaccg

SEQ ID NO: 542530 - DNA, 233 bp, Homo sapiens
cggctgacctgagtatcccaagcttacgaggagacgtgtgcaggacatgtacagcaagagctggcaggctgggttgatgaggggaagtgctgggctcacatgccccgaaatgcccgaactcatcccagcagcctactcttttttaggcacggttcgcagagagggtctcattctatcgccctggctggagtacagtgtcatcatcatagctcactgtagccttgacctcgttc

SEQ ID NO: 542531 - DNA, 551 bp, Homo sapiens
gcacgagggaagacctccaaagtgaggtagactggcccaagtgaacaccagcagacattaagctctcaacagtaatgttttctgggaggggcggatagaaaatgtccttatgaggatagtaaaccttcgaaatagtggcacccaatttagcggtacgcatggaatggtttagttgacgcaagaaaagttcttgagaggaatatggtttgtcattggccgaaggtataaggttagggtaaggcttggttggcgtggctgctgctgtcgttgtaaaagattgtccatctaatgtcttgctgtcaaacaacttgttcaacagagcataatttctgaaaaagtcactcaattcagcctccagctgctgttctttgtcagagagtttgtcttgctctaatgactttttcaactcaggtaatatttcatcttctggtacctgagatagagacttcaattctgatctaatttcatcatacaaaagtttctgttgcaacagcatcacctcatcgttattgttaggggtgttggccgcaccggatgctgacgactgaaac

SEQ ID NO: 542532 - DNA, 229 bp, Homo sapiens
  misc_feature (77)..(77): n is a, c, g, or t
tctacggatctccgatggcgaagtcgatgggagtgtagtcaggaattttgattctgcagttacataccagccagggnccgtggaggagggctggatgaactgagtgaggggggcaggtagcagccagctgcgactgaggcttgagaccccagggtgggggtgctgatccatctctggtaagatgtactgtggtggctgtcaaaggtggatgcacacattgagttcatgg

SEQ ID NO: 542533 - DNA, 340 bp, Homo sapiens
tatggggaagctatgggagcagatacagcaaacgcatatgggcatcacacatttcttctctggtatcaggagaacctggttgcttctaatgagaggtctctcttatttggcaggatagaatccaatggggtaggagaataagagaagggaaaaggatccttgcgagatcatgctcccacatctattaaaagatacataagcttggccaaacttaaaaccaggagcatatcatcatggcacaaaacacatccctaataggggcgggatcactcttttttttttcttttttttttatcctctccggtctggtgggaaggggtttccccacgggacattttta

SEQ ID NO: 542534 - DNA, 92 bp, Homo sapiens
ttcaagcttctaacgatgtacggggacatgcctatttactggaaacctgttatgccaaacagttgtaccactgctaataaatgaccagttta

SEQ ID NO: 542535 - DNA, 109 bp, Homo sapiens
cattctaatgggtggaagtttaaccactaacaggatatttcatggtctcaaagcctcttcccacaagatgtttataataaaaaataaaaagcagaaacttcagagcaaa

SEQ ID NO: 542536 - DNA, 200 bp, Homo sapiens
aatcaaatgtcatcgacttagtatattctgagcaagtttgactggagatagaattggacaagatttcggccattgattaaccacatcgagagatagaaccacgcgtatcctgatgctagtgattaatccctcattcctggcctatggggtacaagttcatgagcggccagaacgctggggagctgtataccatatcataa

SEQ ID NO: 542537 - DNA, 128 bp, Homo sapiens
gggtggcgccgcgcagtcaccgcggagcagacgcggaggctggtggcccctgggcgagatgccgtacgccaaccagccttcctggcttatcagggtgctcactgacgagaatgtcttgttcatcatcg

SEQ ID NO: 542538 - DNA, 265 bp, Homo sapiens
  misc_feature (178)..(178): n is a, c, g, or t
tcggaagggccaggatcgtcacttggcccacgtcccccaatgcctgcacatgcgtaccgccgcacgataggccggcagctcgccaaaacccacttcccgcgtgccctcatccagtgccatatggcgcggcaggttggcggcgatccattggtcgacttgccgctgaatcgcctcgggntccatgggttgagccgaagtaccgcgaataaaggtgatcttgccttcgcccggccagtgatgggccttgatcggcatccagtcgacg

SEQ ID NO: 542539 - DNA, 427 bp, Homo sapiens
gtaactacctgctagtagagcgagccaagagtagaacctataggctgctagcccaaatagagcaacaccacctactgctccgaacacctagcacagctagcccccaagacactgtagagtgacctgatccagagtaaagtgcctctccaaggagaacgctaccaaggacctacctcactaaagctgcctgcgcacacagtagggggatgtgaaatagtgacatggaaggtgggctgcccaagattgctatacctagctgccgtctacagtacgggggcctaggggctactagccctatttacccagagctgtgtagctcgtgagagaccacataacgactgcatgtcccagcggggttttacagtgtgacacagcagacagggtaccctgtgaacagagggccccatccagtgtgcccttggattgg

SEQ ID NO: 542540 - DNA, 1558 bp, Homo sapiens
  misc_feature (613)..(613): n is a, c, g, or t
gcttcatgtgtggtgttttgccacaccaccgaatggtggtgtgttatctatgtcgtcgtgttatgggggggcggcgccccccctgcttgtggtggtgtgttagctcacgaccgctgtgggggggtttgtgtcgtgtggttggttggttggtgccaccctgcctgtgtgggttgctccatgagcgccgctgtgtttgatgtgtttggtcgttgttatcttccccgggggcgccgctcgtactgcactcgtgttgtatctcttcttggtcccgcccagtaatattttgtgtgtgcgtggtgtcgccccacaagcgaggatgtagtgtgtttgtttgcatgcgcaccgttttcgttgggaatatttgaggggcgccaacaaatatgtgtttttgtctctgtgttttgcctcgtgtgtgtggtatgtgagaaaccacagtgtggcccgccctgcttatgagactgttcccacgggaggtgtttccgcgcccaccgtgggcgcccccgtttccgccccaacttgtggtgtgaggacgtgtgtgtggccgcctagaacgtgggggtggggtccttttaggaggtgtttgtccacgagctttcctcaacgttctcctccncgcgaaatttgtcttgttaataccgtcccccacacccactctgtgtgacacaagtcctgtgcacagcccacacccaccgcgtggggggtgttctcgaatataggatgttgtgctggagtcttcggtgcgccccccacgtgtgggcactctcggagattgtctcgctcctcgcacaccagctgggtttcctcgtgtttccactcgtgtggagagggctctcccacacgctccagatagccctgtggcacatctcgtccctatatgtgtcacaccgtatagagggtgtgttgtgtggggttcacacatgctccacatcagtgtcacccgctacacacagtgtgtagtgagaattgtgtgagatgtgtctacagagatacgtcgcacaccacagggcctctcaccacgcgccacagcgtgtgtgctttgtctcgctgtcccctttgtcacattgtagagagagatgctcacacagagatgtcacaccacgcgtgttgtgtctgtgtgtcacacacactggtgagaaggggacacacaccccgctgtgagatgtacaccgctctacaccacctatagaccctcgttatataaactttcacctcgccacactggcccacactctttgagaattctctctcgttataagggtttatatttatatttgtcacaccctctctcggaagaaaaagaatgtttgtttaccccaacacctctcttagtgtcaccttcctcccttctttactgccatacccatgccccacgtgcccaccatagatagtgtgtgccacatagaaataaaaaggaatattaataatttctataagtgataataccccggttctcccagattcttttaagactgtactatagaggcctcggggaattattatagcccctcgaggccaactatgaatttaaagtgttgtggatcccccctgaatccccttt

SEQ ID NO: 542541 - DNA, 173 bp, Homo sapiens
  misc_feature (71)..(71): n is a, c, g, or t
  misc_feature (82)..(82): n is a, c, g, or t
  misc_feature (152)..(152): n is a, c, g, or t
cgtcgaccagcatcccaagtagttgagactacatacgtgtactgtcacgcctggctagttttttgattttntgtagaaatgngggttctcactatattgcccaggctggttttgaaatcctggtctcaagcggtcttcccgccttggcaatntagtgagaacccacatttcta

SEQ ID NO: 542542 - DNA, 1390 bp, Homo sapiens
ggtggcctggctggtcgtggtgccgctgctgggtgtgctgggctggcgcggacgtaggtggctggctggccatggcctgaggcgtcgccgcattcccgggacgggtacttcttgccattgctggctccgtgggagcatcgtcccgcgccgtgccgggatatatattcttgtccaagaattgcgagctcgtgcgtaaaatacagagagaggcttccgggacagagacccagggagacaacagaaaacttgtgttctgccccccttccaaaagtctcccaacagacccaagaagcccggtgcccacacggattgggaggcggccacacacaggaaagacaatgcaacggggcccttgaaagccccaccaagggcacaacgcaccaccatatacattctcccccaagcaagcggttggaaaccaagccaacctgtataacaacgctatagccggcagaaggaggcataacagcgaaacaaggataggcgctagacaccgggcacaagtcgctacccgacatggaaacaagggcctgccgaggaataccccacaaggagttatccccataccacatggaggcacgtacaagagcgtgacagtaacggggcagaggggaaaccccttggcaggaagccccgtggcgatgcagaagaagaaccaaaattcacgggtaccccggggcacacccgggatacacgagacgaccatcggaaaaaaagaccgcgagtgggcccccgggcagttacaaccacacgcgcaggaacagaggcgcacaaaccggggtagctgaggaacgagtaagagaggaaggtaccgccccaaacgcaatggaaaagagagacgattcaatccgaagcgagacagtactgctacaaggcggagagtacaattacacgcccgagaggagacaatatcacccgagggactgagggaccacccatgggggacaggcctagcaatacaacagcactctaatgggaacactaccggcctaggaggagggacaagcgcgcaatggagaaggcaaaccagaacaaaacagggcgcctacagacgcaaggtcggagagacaccaggggccacacaacagggaagacaaaagagagaaactaggagagcgaactcaccgaaggtccacaggtcagatgagcagagccgagaatgcgacctgggacaaaagagcactagatgcaaggacgaaaaacaccagggaggcgcagagtaagagaaggacaggacaccactagcaccaggaaggatagaacagtggtgaaacaagagtgcacgcatagacagaaacactgagacacgacggcagaccacgtcagaaggagggcgaacatcagagatacactcacattaagcagtagtgacagaggggcaggagcacac

SEQ ID NO: 542543 - DNA, 485 bp, Homo sapiens
  misc_feature (479)..(479): n is a, c, g, or t
ggcctccgccatccggggggtcttatacctggccaaggtttctttcgtctccgtggccagaggtccttgggggaacaagattggcaagccccacattgtcccttgcaaggtgccaggccccccggttttttgttgggcgcctcatccccggacccaggggaacgggtatggtctccgcacctgtgcccaaaaaactggtcataagggctggtatcgatgtctgctacacctcagcccgggggtgcactgcccccctgggcaaatttgccaaggccccctttgatgccatttttaagacctacaggtacctgacccccgccctttggaaggagactgtattcaccaagtttccctatcaggagtttactgacccccttgtcaagaccccccccaaagtttccgtgcaggggaatcaggctccagctgtgggtccaacatagggtttttaaacaagaaaaataaagtgaatttagggtggnaacaca

SEQ ID NO: 542544 - DNA, 160 bp, Homo sapiens
  misc_feature (19)..(19): n is a, c, g, or t
  misc_feature (78)..(79): n is a, c, g, or t
agttaggagacaccttttntaggggcaacagcacaggcccagagataccctctgccttcactccggcttgccttgggnnaattaggaccttaggttaacgacaggttccaggccctttaacttctttggccaaaggtttggggaaggttgccaaaggggc

SEQ ID NO: 542545 - DNA, 274 bp, Homo sapiens
ctctgcatttagctagctcacaaaagcatatcatcatccacactgtattataaaaaactcataatagccatgtccaggagaggcaatctagctggtgtcaggtgatccagtccatacctgtcaaagcctccaacagatacagaacaaacaccatcagtttgcgatggctggggggccttctggaagacgagaggcaaagacagtcttgaagacaagccatgctgtgctcttaaaggagggactgaacatgctcgccatctagtacatccctgtc

SEQ ID NO: 542546 - DNA, 214 bp, Homo sapiens
  misc_feature (212)..(212): n is a, c, g, or t
aggcaagagaattacttgaacctgggagtcggaggctgcagtgggccgagatcataccactgcactccagcctgggcaacagagtgagaccctgtctcaaaaacaaacaaacaaacaataccttggggcataaagtgttccacggttcaatccaattaaatttttttttttttttgagacagagtctcgctctgttgcccaggctggagtgnag

SEQ ID NO: 542547 - DNA, 416 bp, Homo sapiens
gtctcatctcccttacggtctcatctcccttaccgtcgtgtccaactgatctctcaaacccaagcaccttctgcaaaacaacaactcctattccttacctaggcatggttagcgcggtcagaattcttacacaagagccaggaccacaccctgtagcctttctggccaaacaacttgaacttactgttttagcctagccctcgtgtctgcgtgcagtggctagctgctgctttaatacttttagaggccctcaaaatcacaaactatgctcaactcactctctacagttctcataacttccaaaatgtatagtcttcctcatacctgacgcatatactttctgctccccggctccttcaggctgtactcactctttgttgagtctcccacaattaccattgacggtcagggagatt

SEQ ID NO: 542548 - DNA, 521 bp, Homo sapiens
  misc_feature (315)..(316): n is a, c, g, or t
  misc_feature (328)..(328): n is a, c, g, or t
  misc_feature (330)..(330): n is a, c, g, or t
  misc_feature (338)..(338): n is a, c, g, or t
  misc_feature (341)..(341): n is a, c, g, or t
  misc_feature (348)..(348): n is a, c, g, or t
  misc_feature (359)..(359): n is a, c, g, or t
  misc_feature (366)..(366): n is a, c, g, or t
  misc_feature (370)..(370): n is a, c, g, or t
  misc_feature (381)..(381): n is a, c, g, or t
  misc_feature (387)..(387): n is a, c, g, or t
  misc_feature (389)..(390): n is a, c, g, or t
  misc_feature (394)..(394): n is a, c, g, or t
  misc_feature (404)..(404): n is a, c, g, or t
  misc_feature (413)..(413): n is a, c, g, or t
  misc_feature (418)..(419): n is a, c, g, or t
  misc_feature (422)..(422): n is a, c, g, or t
  misc_feature (428)..(428): n is a, c, g, or t
  misc_feature (436)..(436): n is a, c, g, or t
  misc_feature (441)..(441): n is a, c, g, or t
  misc_feature (448)..(448): n is a, c, g, or t
  misc_feature (515)..(515): n is a, c, g, or t
gcacatgtccccccccttgtattgtaattcacttccttgtctgtaagccagagtgaggtggaagcgtcaatcaaccttaattgccttaacaagttccccctggtgaaggccttggcccttaacctttttcttacgccgagccctgcagccctttgccttgaaggcctggggcgggaagaaggagaacttgaagctgcgcaggaggagtatgtcaagcgagccctggccaacagccttgcctgttaaaggaaagtacactccgagcggtcaggctgggctgttgccagcgagtccctcttcgtctttaaccacgcnnattaagcggagntnttcccagntgnccccaanactccaggccngcccccntccnactcttgaagnggaggncnnctcnctcgggctcncaggtggcntgccnncgntctttnttccctgngacantggtgtntggtgtcgtctgtgaatgctaagtccatcaccctttccggcacactgccaaataaacagctatttanggggga

SEQ ID NO: 542549 - DNA, 336 bp, Homo sapiens
gggaagcgagttgttgggaggcgagttatggctcagtgtaaagaaaaagctttctggccaggtgcagtggctcatgcctgtaatcccagcactttgggaggctgaggcaggcggatcacctgaggtcgggagttcgagaccagcctgaccaacatggagaaaccccatctctactaaaatacaaaattagccgggcgtggtcgcacatgcctgtaatcccagctactccggaggctgaggcaggagaatcgcttgaacccgggaggagaagtttgtggtgagccgagatcaagccattgcactccagcctgggcaacaaaagcgaaactccgcctc

SEQ ID NO: 542550 - DNA, 972 bp, Homo sapiens
gggtgtcagttgaaatccggttctaagcgatcaggggttcccatgcgttataaaaactttataaatccccccgtagccctgagcagtgtgagagaagaggcgagaacgagcccgaagcgaacataagcacgagcgcaggtagactccccggtgtccagctggctacgtcccggctgccgtcgctcgcacggcatcgaatgtccatacgatgacaggctggcagggggattgttacagggagataatgcagagggtgaaggataaaccaaagagaagatcccgcgaagtaggtctgcttgaaacctgattccttccaataagaccatgagccccacaaagcttaaaaaaggccccgtgcgaaaaaaagtgcagcacaacgggttatcgaaaagggaaacagaggggaatagggttgattggttgacaaacgggagtgtggaaataaccttgacgagacaagttgtagatggcaaagatgactagtgataagaaacagctgaaaggtgcttgcagatgaccatgtgaattgtgtgcattttagagtaactgtgtaagttctggtgacctgtgcaggtttgggacatcactatttaatcgagtgtgttataccaaattgcagaatttgttttaattttaactttttttggctaaacagctatttgtctgttatgccatcaggaacacttcaattaggtggttcggggggcgacggcggcatattggtcacctatagagaattgtttccacaggtggggttgctgtggaagacaaagcgttccatttcaagttataggaaatcctctgggtcccaggaggggggattccctagttggaccattgggccttggaaaagcttgcgttcagacaccattttgttgtctcgcctctgattggaagatactctaccgaattttgaaccccattgggagagagaagatcagtcagaagagcaagaaggattatggaacatac

SEQ ID NO: 542551 - DNA, 460 bp, Homo sapiens
catatgcccggaagctctagtcctagatatatacccaagacaacgtgaaagtatgttcacataaaaggttgtgcatgaatgttcatggcagcatttgcttggtaatagtcaaaaagtagaaacaagccacatgtccttcaacggatgactggaacaatgtggtatctccacactatagaatattacgtcagcaatatcgaggcatgcagtgttcaatagcttctacaacacgaatgaaacttgggctacgtgaatattctggaaaaagaccgatataaaggccacacattacatggttccatttgcctataatgcctcccaggttccagtgattctcctgccacagcctccccagtagcttggactgccggaatgtgccaccatatccggctaagttaggtatataacgcaaagacgggtttaccccatataggccgggatggactcgaagtcctgacct

SEQ ID NO: 542552 - DNA, 303 bp, Homo sapiens
gctcgccagactgcattctctggatgtcccaatagataacctcaaggagcttggcgtcaggaagcagttgccctcagcaaaccttctggggcaggcgcagtcatgagtttgcccacattctgtattcatgataaacagtttgctgtttgatcgtatagactcagtggaatgttggtcacgtcccatgggcctttggctctctgtatatcctcctttctgtttatgtattaattgaaggagtgtaaggccagggtgggcagctctcattttcccattgatggtccatccaactttacagactgt

SEQ ID NO: 542553 - DNA, 223 bp, Homo sapiens
agaggatccccgtcagcatttccagcagcggggactataggcacgcaccaccacacccagctaagttctgtatttttagcagagacgggatttcactaggttgcccaggctggtctcaaactactgacctcaagtgatccacccgcctcggcctcccaaagtgctgggattacaggtgtgagcacgcgctgacacatctctatctaatgtatgtgttctcatg

SEQ ID NO: 542554 - DNA, 338 bp, Homo sapiens
  misc_feature (24)..(24): n is a, c, g, or t
  misc_feature (198)..(198): n is a, c, g, or t
  misc_feature (255)..(255): n is a, c, g, or t
taaaacccccacaatgagatatcnccccttatcccccggtagaatggcctacctataaaaaaatgaagtgtccatccaaggatatagagaaattggaaccccttccttcactgcctggagggaatggaaaatggtgtagcccgttatgaaaaacagtacggaggtttctcaaaaattaaaaatagaactgctatatgntccagcaatctcacttctgtatatatacccaaaataattgaaatcagaatttcaagnaaatatttacactcccatgttcattgtggcactcttcacaatcactgtttccaaagttatggaaacaacccaaatttccattg

SEQ ID NO: 542555 - DNA, 204 bp, Homo sapiens
atgtgttggctctattagcactaaagatagcacactgttacatattgccaatttcatatcaatgtcatcagtggctttgaaggaaaataacagttatttccacactatgtgtatgatttttattattgtcatctaaattcataacatcctattccttttaattacccttagcagagtactttgaggagtcatagatgcatccgg

SEQ ID NO: 542556 - DNA, 809 bp, Homo sapiens
atctcaatttgaattgtatctcccagaattcccacgtattgtgggagggcaccagagggaggtaattgaatcatgggggccggtctttcccatgctattctcgtggtggtgaataagtctcactagatctgacgggtttatcaggggtttccgcttttgcttcttcctcatttttctcttgccccttgccacgcaagaagtgccttttgcctcccaccataattctgaggcctccccaaccatgtggaactgtaagtccaattaaacctctttttcttcccagtctcaggtatgtctttatcagcagtgtgaaaacggactaatacacatggtaattccatgtttaactttttgaggaacagccaaactgttctccacagtggctgcaccattttacattcctgccagccgctcatgaagcttccaatttttccatatctttgccaagatttattattgtctgtctttttgattgtagcctttctagtgggtgtggagtggtatttcattgtggtttgatttgcatttccctagtaattaacggtattgataatcactttcatgaacttattgccacttgtatgttttcttttgggatacactgtcttttccggtcctttgcctattttacaactggtaccatttgtctttttattcgacttctcttactcatcatggtatccggatactagatccttattatactatctcattgcgcaatatttcctctcattccggggtattgccttttactttcctgacagggcctttaataaccaaaagtttcaattccaaaacaaaactacccc

SEQ ID NO: 542557 - DNA, 221 bp, Homo sapiens
ttttttttaaaaaaacccgggtttcttggcccaaaattgtccgttttcaaaggttgtttaagcccccccagggggtttttgggggggtaaaccaaaggggggaattttcattgggccccccctttttaggatttgaaattaggtttctttatttttccaggcggggtccggccccggttttttaaaattgggttcttccattaaccctggggggcttggga

SEQ ID NO: 542558 - DNA, 440 bp, Homo sapiens
ataacattcttgtttatcacccattggataccatagaatataagctccacagaggcagggtttttaggtttgcttggggttttttttatcttatgttcactggtgtattctccaacatcatataaaactaatgacctggcaagaataagtagactgttcaatacaatacacgctgaataaatctgttgaaccaacgtgtatatgcatatgtctttttctggaaacagaattcacagtttttatcagattaatgaagtgatctgccacccaaaaaaggttccccaatcctttgttctcaagctttaagtggttaaggaacaggcaattccatcctcaaagaccccaactctcaaaaaaagccaacaaaaccccaaaaacactcacaccacgactccgcatctcaccaagcgcagacaccaagttcaaatttcacactccca

SEQ ID NO: 542559 - DNA, 422 bp, Homo sapiens
agatccctgtgcagacaatattgcttatgaacattggtaaaaattcttaggaaaacagtgccaaactggttgggcacagtggctcatgctggtaatcccagcactttgggagattaaggcaggtggatcacttgagctcaagttcaagaccagctgggcgtggtggcccatgcctgtaaccccagcactttgggaggccaaggcgggtggatcatgaggtcaggagatcgagaccacagtgaaaccccgtctctactaaaaaatacaaaaaaattagccaggcgcagtggcgggcacctgtagtcccagctactcaggaggctgaggcaggagaatggcgtaaacccaggaggctgagcttgcagtcagccgagatcgtgccactgcactccagcctgggtgacaaagtgagactccatctc

SEQ ID NO: 542560 - DNA, 780 bp, Homo sapiens
ggatgaccttgggcacattacacaacctcactgtacctcagtttccttcatctataaactgcctccctagggttgctgatgtatgttgatctattacaaaggactgaaaacagccactggcacataggaagccctcacgtaagtgttcaccattatttgtatgattaccatatcctgtgcaaggtccctcctaagatgtaagctgccttaggtctccaggctccccctttggaatgtgagccccttacagattcagtacctgatttctgggcttcgaggcaagacagacatggccaaggggagaaaagcagtattggaaggatgctcccagacctatccaccaaagtgagacaaagcattgggtgaaccctcttctcagtaccagcttcacagaatagtaagcagctgcagcgtggggctcagagtggctttggcttctgtgcttacttagcaagtgatccgtcacaagttctgccagctccctttggaactctgtcaccccgctcagccatggacaagcagacagccacggatattatagacaatgcaagtctggagggttgcatctctgatatgggaggagtcagagtaatcctttccactcttccccgaagatgcttttcaaaagaggagctgctttgagttttgaaacatctgagtctttcagaaggaatgtggggaagttcaagggggttttcttgcctgagaatgtgattggcttcagaaggggaaagccagaggcctttttttttttctccttttttggggaaaaaactgttc

SEQ ID NO: 542561 - DNA, 176 bp, Homo sapiens
cgttccctgtacttcccggggagtgtgtgggttgggttcgtaccagcatgtagactaggaactgagccccggaaagggggatgttttcctggtgtttggatggtcatgctgggatgtgtccgatcatctaggggaacgatcataccacagtgtgcactacagctagcccgagggcc

SEQ ID NO: 542562 - DNA, 181 bp, Homo sapiens
cccctgagttacctcggtactgtcatcggcgactcaactcccgccgcggcagatccaagagatggttgaggagcacggaaacaaggtcgtgcgcgctttggtcccgctatctgagatgtttggatacgtcggtgacttgcgctcaaagacctccggacaggcttcatactccatggagttt

SEQ ID NO: 542563 - DNA, 841 bp, Homo sapiens
  misc_feature (659)..(659): n is a, c, g, or t
ctacaaagctacaaagacattggaagactatacctattattcggcgcatgagctggattcctaaagcacagctctaagcctccttattcgagccgagctgggccagccagggcaaccttctaggtaacgaccacatctagcaacgttatcgttacagtccatgctgttttgtgagatagagtcgtctcgttcgatagtgagatacgccatcataagtcggaggcttggggcgactggagctagattgcccctagataattcggtgacccccgactatggagttttccccggcgtaaagcaagcataagcttctgactcgtgtacctccctctctcctaatacctgactgcatagtctgctgatagatggaggaccggtagtcaggtagacaaggtcgaacacgttgcgtacaccctctccttaggctagggggacactatctcccacgcacgtggaagcctccgttcgatccatatacgcattcttctgccttagctagactagtcatggtgtcctccatcatattcttaaggggccgattcaataattcagtcacgaacatagtatatcaagtataataagtccccatgctcaataagcgaaatatcggaacgcccctgcgttcgtgctagaatccggtgcgtaatcaccagcaagtngtactttttgcgtatctgcgtcccagtcctgggactgctggcgtttactagtactactaatcggagcagcaagcttcaagatcacccttcttcgaccgcgccggaggaggcgagccgatacttatgacaatcactagtcgagttgcggcgaccgaagtgatgtctatctacaggttggaata

SEQ ID NO: 542564 - DNA, 103 bp, Homo sapiens
cacgaggaattgcgcatgcacagaggttgactgaactcactttccatgcggagggaccacagctaacaaccagcacaggcgctgtgcagatagagtggcttga

SEQ ID NO: 542565 - DNA, 388 bp, Homo sapiens
tagcctgggtgacaaagggcgcctatgtctcaaaaaaaaaaaaaaaaaaaaaaaaaaaaaaaatatatatatatatatatatatatatatatatatatatattattaatactttttttggtaaaacagcctctccaaggagcaaatttgtaaatataagcctaaactctatggcaaaataaagtatcagaggttgaattccaactatataggaagcacatgggaacgtagatgactagaaatacagatataggtatattaattagcaatgagatatgtatttttatacttaatgaggtcatataacacaactgttttgtatttagttatatttagtctgagctatccacaattttttaaaatttaaagccctttgtttcaatatcgcg

SEQ ID NO: 542566 - DNA, 100 bp, Homo sapiens
ctgtttcgatctagaggatcctgccttattgtcagctggtggctcacctggagccactgcccgagcctgcgaggtcaccaacagcctccgcaagatttcc

SEQ ID NO: 542567 - DNA, 535 bp, Homo sapiens
tgttacacttttcattctatggtgttcatagtgcacaacggtaccaagtaagtaaatacaaacaagtctcttctttttcatagctaaagcaaaataacgatcttcttgatatctgtactggtcaggaggcatgagttcggggattacctgtaccgtaattaggtaagatggcagtgaccaatgcccctgataaacaccttcctctccgtctcatgtcaccgtgacatgagaggtacgtggggacgcgtacgctaggctgggagtgtacgtgggggaactcattcacagggcaggtctgaagtcagtggcaatcgcgctcaccatgctgtagtgagaacttgggtgggttactatgaccgctctaagcctcagtatcttgctctatgcaaacagggatagtggccctggaaattgtctctgttcagagcattcaggtcaatgatgggcagtggaaagcagtgggccctggaagtgaatggcacactatgctcgctggggtctagaacaacgttatactgcgtcgggcacaagcccc

SEQ ID NO: 542568 - DNA, 365 bp, Homo sapiens
  misc_feature (42)..(42): n is a, c, g, or t
  misc_feature (60)..(60): n is a, c, g, or t
  misc_feature (74)..(74): n is a, c, g, or t
  misc_feature (81)..(81): n is a, c, g, or t
  misc_feature (88)..(88): n is a, c, g, or t
  misc_feature (106)..(106): n is a, c, g, or t
  misc_feature (162)..(162): n is a, c, g, or t
  misc_feature (164)..(164): n is a, c, g, or t
  misc_feature (169)..(169): n is a, c, g, or t
  misc_feature (211)..(211): n is a, c, g, or t
  misc_feature (213)..(213): n is a, c, g, or t
  misc_feature (271)..(271): n is a, c, g, or t
  misc_feature (286)..(286): n is a, c, g, or t
  misc_feature (301)..(301): n is a, c, g, or t
  misc_feature (327)..(327): n is a, c, g, or t
gggtaccccgggctgtaggaattctgcacgaggtgtttttgnaagcgctcaaccatatgnctctagaatacacntctgttntgtgcangcgaatattcgatgactntgggactcaatactctaactctggcttcctgtgaggcgtgtatgaacctctctatnangttancagtgagggactaaagaactcaaggttaaccgcgggagaagncnaacactgtgtcaggattggaacaaagaaacgcggtttatttgcgttagcatttatacngggaggagagaaatncatattcctgattcnaggtggaaggagtgaatatggagcanctttggcatgggaggggagctcttgctggaggaggact

SEQ ID NO: 542569 - DNA, 164 bp, Homo sapiens
cctttgacatgcatggcgtcgaaagcttgggcagcacagttccaagcttcggtcagtgcgaggcgagtgtcaaacccgcgtcaggtcagcacgtagtccgctggctccaacgctggcggcaggttgacttcacccaaggcggagaggatctcgcgctccaatgt

SEQ ID NO: 542570 - DNA, 188 bp, Homo sapiens
gacgctctctcggtggggggttgggataaatcaccatatctgggcttctatcgattagtggtgattaattatgtggacaggtgataggcagtcaggtggtttctacttccgggggattaccagcagccaagtctgccaaaaaggagcaagtcgggacaatgcatatataatatgatgttttatgagtg

SEQ ID NO: 542571 - DNA, 137 bp, Homo sapiens
tctggtgggcatgctggcgcacgcgttcggtatcagtgccggcgaccgctacctgtccccggcgcccgtataccacgccgcacccctgaagtggtgcggcggtgtgcacgccctcggcggcaccgtggtcttgatgg

SEQ ID NO: 542572 - DNA, 367 bp, Homo sapiens
tctagaggatcccggtgtcccttgtctgtcttagagacggagtttgctctgttgcccaggctggaatgcaatgtcacaatctcggctcactgcaacctctgcctcctgggttcaggcgattctcctgcctcagccttccaagtagctgggactacagacgtgtaccaccatgcccagctaatttttgtatttttagacagagatgaggtttcaccatgttggccagactggtctcgaactcctgaccacatgatacgcccgccttggcctcccagagtgctgggattacaggcgtgagccacagtgccctaccttaaaaacaatttttttttttacctttggttaaaaatgacgacaaagggaaaca

SEQ ID NO: 542573 - DNA, 393 bp, Homo sapiens
  misc_feature (136)..(136): n is a, c, g, or t
gcagccttcttcaggtagatccacctagtaatgcatatggctgcaaaggatactttgaaggtttaaatagtgatttaaaataataaaataatttgtctggtcttgtgtgctttctgtgctgaattctccacatttntaactgtttaagctagttttagagtatgatatgttcttaagcataatactcccatgtctctctctagaacataataatggtgtgtgatcgattggtatatttttgatattacatctgttgtaatttatattgtgtgtgcatttatacatggttgtctttttctatcaaatacctgttcatctttgtatgtaattttcttggcttaaatggtctaatttctgaatgtgaataaatgctttatttatttaaaaaaaaaa

SEQ ID NO: 542574 - DNA, 735 bp, Homo sapiens
cccggtccgaatcgtgcccagccagttgttgtgctgccttcgtcttcccagcagcctgtaactcagtgtgtgtacttcactgaatgtgatggttagaaacttcgtggatagttgtggaaatcatccaattaaacatactgcttaaaacagtgttgctgtgacttcaggagacaagcctgggaaggggcaccttaggaagccccttcgcttgcagtttgctcgcttctggggtgtgctcccttcgaaggcccagataagagcagggaacactgtgtgagcacacagagcagcatctgatgccctgtggtgtaatggcatgtgccccactgtaatactgaccaagtcacgtgtggcatgaggcgccacgcctatcgcaaaggctttcacttatccaaagagcatagcgcgtggctccacccagtaccatgtcctagccgtgtctgcatatgtatagtggtaatattctttatgtataagtaaagtgtcagagtagcccgtagagaaagagagacaaggaagaacccaggcaacggagacgacaaagacaaccaaaaggtgccacacggctctcatataaaaaaatacatgaccgccaaagaggaccggcaccagaatcgagagccgaccataaaagtcacgccagaggcaaaaggaagtcgcccaacaatgagaatggcaacggaacccacgcgaacgcagacaggcacggacgtacaacatgacatctgaactgaa

SEQ ID NO: 542575 - DNA, 109 bp, Homo sapiens
gcatagaaagagcagcgtagtcgtagtagcccgtggtagccaggtagagaccggtggcacgaactaccagctgcttggcaggcatcccaagggcacatcttaacgttgg

SEQ ID NO: 542576 - DNA, 483 bp, Homo sapiens
accaatttcaaatctggtcttctcggcttagcggctgaagactgacactgcccgatcgcctcggaagccccctagaccatcacggatgccgagctttagtataagaagacaggaatgtcaggcctctgagcccaagctaagccatcatatcccctgtgacctgcacatacacatccacatggccggttcctgccttaactgatgacattccaccacaaaagaagtgaaaatggcctgttcctgccttaactgttgacattatcttgtgaaattccttctcctagctcatcctggctcaaaagctcccctactgagcaccttgtgacccctactcctgcccgccagagaacaacccccctttttcctttacctacccaaatcctataaaacagccccacccttatctcccttcactgactttcttttcggactcagcccacctgcacccaggtgaaataaacagctttattgctcacaaaaaaa

SEQ ID NO: 542577 - DNA, 411 bp, Homo sapiens
aagaagaaacagcgccagaaaataaactgacattaggcaatctgtcaaaagagttatgttgaagaccgcttttgacttcttttatgacatggacctttctacgatatgggcactgaaactaaagcaaatggtggaagaaggtttggttccatgtagaaatatttttagagaactgaaaaagcaaaatgataggaattatgatgtttctgtaaagttacaccaagtgtgcctgcctctcctgcctcctctctcaactgttacacattttccatctctgtcacccctgagatatcaagactaacccctcctctttctcctccttcttagcctactcaatggggaaaccatgaggatgaagacttttataatgattcatttccacttcataaacagtaaatgtattttctaaaa

SEQ ID NO: 542578 - DNA, 200 bp, Homo sapiens
ggaaggaaggagaagcaggcctgtcttcatgtccaggcaggattcacatcacccgtgctgcaggcttgtggggggtcgcagggtggtggggcgggactcgggtgtgagccggtgcgaggcggtgcgggatgctcttgatgcactgtctgcgtggggcctccgggtggccgggaggtcgccctgggaagttggtggtggct

SEQ ID NO: 542579 - DNA, 515 bp, Homo sapiens
  misc_feature (504)..(504): n is a, c, g, or t
tagcagggtatctgggttctacagtgcacacagcatgtagctctgattcttcctgcattttttttttgtgtggatgacagcgtctcactccgttgccaggtgggagttgcaggggcacgatctcggctcacggcaacctcggcctcccaggttcaagcgatttttatgcctcagcctcccaagtagctgggaccaggggcggacgccacctggcccagccaattttggtatcttcagcagagacggggcttcaccattgtgggccagggtgggtcttgatctcccgacctcgtgatctgcccgcctcggcctcccaaagtgcggggactataggcgtagagccaccgcgcggggcctcttcgggctccttaacgtggctgctcaaaactcttaatctctgcgactcattttaccctttcattgggggcagagaagaaggggaaaggtgtgtaaatcaatagaacgggaagtggtgtctatcccgtgtgtggcgtggctaagcanggcacccagcc

SEQ ID NO: 542580 - DNA, 895 bp, Homo sapiens
gtcgaaggctaaggggagggtgcgaaggaggcgcctgcgtgcaaaactgcgggcaattgaaaaagagccggctaggacttccccaaaacttgtggggaactccgggccgcgccggcagcaggagcggaacgcagcgcagcggcggcagttgccgggagatgcgagcatagaccggactgtgagcacctttccctcttcgggctgtaagggagcgagacagccaccggagcgaggccactccagagccggcagcggcaggacccgggacacaagagtagccccgagacacccccagacgtagcgggcgctccaggtgatcgagtccacgccgctccctgccaaggcgaaagggacgccccctggcagcccggccggtggtcttccctcccgggatcaaacttttcttgcaagccctttggaccaaacttgtcgcgcgtacaccggtcgccaagcgggtccggcgtagagcggctcatctatagcgagatgtctgagcgcaaagaaggcagaggcaagggggaaggggcaagaaagaaggactgggatcccggggaagcccggggcccgacgaagggcagacccagatgcccaggaaatgggcctccccagaattggaaagcgacactgagagcccagggagtacaggattgcatgggcccccaaggctccgtgagcttcgggtgtgaaaccaagcttctgagatacgtccctcactcagaattcacgtggttcccagaccgggaagtgagcttgagccggtagggaataaacccacaaaagttcgggatccagaagcagcccaagggaaggtacaaggcttgaatcaagaaagcgtccctggttaatcgggagagttattgcaagggacagagagtatggaacgactgtgcttgca

SEQ ID NO: 542581 - DNA, 782 bp, Homo sapiens
gggtgttaacgccaggacgctgatgcgtagggttctcgtctggcagaccctctggagcctggtcacgattgccataatgtaccacaacagtagtcgagaagcgggcgactgggaccttcgtccagcgaggtagcagctggcactgactgcgggttgtaagccacaaccgtcaggattcagatgcaagagccgtggccaaggggaaggtgcttccgaatgatccagtctttcttgagccctcatgaagaagtgagactcgtgcgaatgactgatgagaaaaggtggatttgggatgtccgtctcggggttcaagccagagaatggcaaagatacttgtgtgtgggtgttcacgagtgtgtgtagtgtttcacagaagggttgatatctttaagtaggctcagtaggggaatatcaccgccaggatatgtgtgcgcccactgggttcatctgtggggctgcagaggtaggatgaattcaatgtatctacgctcctcagttgtggaagcctccgggagcagtcctcttggtacatggagaaggcagtgtcgaacatgatacgtgggatatgaactagtttttgatacagcaactgaattccatgttatgtccacgatccttacagagccatttgagggctgcctcatcgattaagaccgctatcccatatgcgagtccgcagattgaggacaacagtgatgaggttctgatagaactggtggcggagcttacttttatatcacttccaatgcctggtgcaatatcaaggcccaggggatacatga

SEQ ID NO: 542582 - DNA, 413 bp, Homo sapiens
aggcccagccagagcctgtcgggagaagaccagactctttacttgcagtaggcaccagaggtgggaaggatggtgggattgtgtacctttctaagaattaaccctctgctgctttactgctaattttttcctgctgcaaccctcccaccagtttttggcttactcctgagatatgctctcccaatcacgagagagaacatgcggtctgccaagcatgccactccttctcttcgaactcttccctcccctacaccctcccgtcgtcttacaatacagtctctcagacaagtgtctctacatcgatgtgaactccttaactcatcaagtaaggtggtactcaagccatgctgcctccttacatcctttttggaacagagcacggtatcaataataaactaataataatatgccaa

SEQ ID NO: 542583 - DNA, 234 bp, Homo sapiens
aaagcgcccaaaaaagattttttccccggggtggggaatcccggtagcaagccaaaaaaaggggggactttggccatttccccctttttttttttaaaaaaaaaaatggtttaaaagccccctttttttccgtttttccccgggggaaaaaaaaataaggtttaaaggttttttttttaaattaagccaaatttttttttgtttttttaaaaaaaaaaaaaagggggcccccca

SEQ ID NO: 542584 - DNA, 127 bp, Homo sapiens
  misc_feature (65)..(65): n is a, c, g, or t
  misc_feature (85)..(85): n is a, c, g, or t
gcttaatgagggcactatggggcctaaaggtgtgaatacagagacatgtgtaagaatgggccggnaggctgaagatcttggaggnggctcctctgatgtcccacaaattcccatggagcccgaaaat

SEQ ID NO: 542585 - DNA, 1441 bp, Homo sapiens
atgccctctgtgtctccagcggggccctcggccggggcagtccccaatgccaccgcagtgacaacagtgcggaccaatgccagcgggctggaggtgcccctgttccacctgtttgcccggctggacgaggagctgcatggcaccttcccaggcctgtgcgtggcgctgatggcggtgcacggagccatcttcctggcagggctggtgctcaacgggctggcgctgtacgtcttctgctgccgcacccgggccaagacaccctcagtcatctacaccatcaacctggtggtgaccgatctactggtagggctgtccctgcccacgcgcttcgctgtgtactacggcgccaggggctgcctgcgctgtgccttcccgcacgtcctcggttacttcctcaacatgcactgctccatcctcttcctcacctgcatctgcgtggaccgctacctggccatcgtgcggcccgaagctcccgccgcctgccgccagcctgcctgtgccagggccgtgtgcgccttcgtgtggctggccgccggtgccgtcaccctgtcggtgctgggcgtgacaggcagccggccctgctgccgtgtctttgcgctgactgtcctggagttcctgctgcccctgctggtcatcagcgtgtttaccggccgcatcatgtgtgcactgtcgcggccgggtctgctccaccagggtcgccagcgccgcgtgcgggccatgcagctcctgctcacggtgctcatcatctttctcgtctgcttcacgcccttccacgcccgccaagtggccgtggcgctgtggcccgacatgccacaccacacgagcctcgtggtctaccacgtggccgtgaccctcagcagcctcaacagctgcatggaccccatcgtctactgcttcgtcaccagtggcttccaggccaccgtccgaggcctcttcggccagcacggagagcgtgagcccagcagcggtgacgtggtcagcatgcacaggagctccaagggctcaggccgtcatcacatcctcagtgccggccctcacgccctcacccaggccctggctaatgggcccgaggcttagtcagcagggctctgccaggggccgaaggtcaggactcatctgggcatgccagcgtggacacccaccatgccaggggtggcaatcggttccatctcgattgattggtgatggctacccagagcaccgcattgagcgtctaaggccactgtgctgtggttgattagcaatgtctgccactggctccgatgggatgtggtggcctgaatgccggtgatttgctgttcctggggtatagcacgtccactgaaaactcacaggggtagccgggagctgctcctcactttggccagtttgtctccagaaggagttcctcagaaaaaagggcacagtggattccattgattagaaggatgagatgaaaaag

SEQ ID NO: 542586 - DNA, 329 bp, Homo sapiens
attcactgtagagtctcttctgagacggatccggcaaagcccactccccctggtgatcacaatacaacctgagatttgggcagcggcacaaattcaaactatatcattctgcccctgacccctcccaaatgtcatgtccttctgacactgcaaaatacaatcatccatctcaatagtcccccagatcttaactcatttcaccattaactcagaaagtccgcagttcagtctcatctaagacaaggcaaatctcttctgcctataaagcccataaaatcaaaaccaagttagttacttccaagatacaacaggggtataggcatttggta

SEQ ID NO: 542587 - DNA, 103 bp, Homo sapiens
gtggggctctatgaccgacaaaggacactgtgaatcacagtagcgtaaacgagatgcttcctttctaatgacaatgacagggtataggtgaaggagctaatgt

SEQ ID NO: 542588 - DNA, 492 bp, Homo sapiens
  misc_feature (180)..(180): n is a, c, g, or t
  misc_feature (334)..(334): n is a, c, g, or t
tttgggacaagcaaccgatagaaagacttctcttcaggcagttctgtgataccaaacccactctaaagaggcacattgaattcttggatgcagtggcagaatatgaagttgccgatgatgaggaccgaagtgactgtggactgtcaatcttagatagattcttcaatgataagttggcancccctttaccagaaatacctccagatgttgtgacagaatgtagattgggactgaaggaggagaacccttccaaaaaagtctttgaggaatgtactagagttgcccataactacctaagaggggaaccatttgaagaataccaagaaagctcatntttttctcagtttttacaatggaaatggctggaaaggcaacccgtaacaaagaacacatttagacattacagagttctaggaaaaggcggatttggagaggtttgcgcctgtcaagtgcgagccacaggaaaaatgtatgcctgcaaaaagctacaaa

SEQ ID NO: 542589 - DNA, 244 bp, Homo sapiens
gaactctcacttctagatgggatggcggctgggaagaggcgctcctcacttcctagatgggatggcggccgggcagaggcgctcctcactttccagacggggtggcggccgggcagaggctgcaatctcggtactttgggaggccaaggcaggtggctgggaggtggaggttgtagtgagccgagataggtaggtcttaaaaacttgattgagaattgaacttgtgtagagagttgcggtggtg

SEQ ID NO: 542590 - DNA, 148 bp, Homo sapiens
tatacatatacgaatcgagctcgtgtaccccgctggccaatggcaaacccgcatctactaaataaaaaattagccgggcgtggtggcggcgcctgtaatcccagctacttgggaggctgaggcgtgagaatctcttgaacccaggaga

SEQ ID NO: 542591 - DNA, 910 bp, Homo sapiens
agcctcccgagatagctgggactacagctctttcagtctcacatggcaacgaaaacatacttgcttactgtcttcacaatggatcagactgatgaacagatactaccaaccaatagttgactacatagatgctcacgtttgaggcctactctccacagaacgaacatgacaccgcactctacaacgcccgcctctcctccatcactatctaacccataacaaaaatgaaacttcatcgccaatcacatgactgatgctcctcctacctctcactctctcacccgcaccagcgaccacactctctcctgcacagcaacaccacttgcactcatcatctacacccactgcaccgcacaccccatctggcaccacagcccaaacgcgccctacacacccacatttacttacacaagactgcactctgccccaacagccccaccgactaacggcttctcatacaacacctgcacattaacaagaacgctctatcaagcactcacaagcatcaatgcagctgcaactcggcctccacgccccactgcgcgtccatgactactacccagctctcccaaccggcactgcactgaccacctacttcgcctacaggctcaaccgctagcaacctgacactgccaacatgctctgccgctcactgcctgctccgctgcgccaacgctactggcactgcacggctacacacacgctccggcaaaaccaaagcactcgttcaaaacgcattcgtcccagctacccccctttagccgcgcgctggctctgctaccacacgcctgcgcccacacttgcacactcatccaatcttgactgcacctccccggctcccatgtcattgccgcgcgcacccacttcgcctcactttctgatacccaccaccttcactgcgcccgcgacc

SEQ ID NO: 542592 - DNA, 425 bp, Homo sapiens
ctgcctgtacacggttaatccgagttactccttgggtcttcaggcgacgatggccaagggcttgtgacttctgcagcgacgtgactcgaaaccacgcagcacttcacagggttcctagtgtgttctctgctggtgattccccaggggaggctcctcctgctgctgttgcaggggcaccagctggtcagctgaggcactcagtgacagggcaaaccggctggcaggcagctctgtcagaccgagccttgtgttgatcggagcagcttgttcctccaggacgtgtgcgcgttcaagccagtttccaaaaagccgttcatagtatattgagcactttcagtggttttcaatgttaaacaggtttaggtgtggtttttaaaaagtgagagaaaacaggagtatttacaggtttggatttttagttttac

SEQ ID NO: 542593 - DNA, 397 bp, Homo sapiens
  misc_feature (28)..(28): n is a, c, g, or t
  misc_feature (62)..(62): n is a, c, g, or t
  misc_feature (64)..(64): n is a, c, g, or t
  misc_feature (74)..(74): n is a, c, g, or t
  misc_feature (77)..(77): n is a, c, g, or t
  misc_feature (85)..(85): n is a, c, g, or t
  misc_feature (93)..(93): n is a, c, g, or t
  misc_feature (97)..(98): n is a, c, g, or t
  misc_feature (101)..(101): n is a, c, g, or t
  misc_feature (106)..(106): n is a, c, g, or t
  misc_feature (113)..(113): n is a, c, g, or t
  misc_feature (124)..(124): n is a, c, g, or t
  misc_feature (137)..(137): n is a, c, g, or t
  misc_feature (143)..(143): n is a, c, g, or t
  misc_feature (158)..(158): n is a, c, g, or t
  misc_feature (174)..(174): n is a, c, g, or t
  misc_feature (196)..(196): n is a, c, g, or t
  misc_feature (208)..(208): n is a, c, g, or t
  misc_feature (252)..(252): n is a, c, g, or t
  misc_feature (260)..(260): n is a, c, g, or t
  misc_feature (262)..(262): n is a, c, g, or t
  misc_feature (278)..(278): n is a, c, g, or t
  misc_feature (379)..(379): n is a, c, g, or t
  misc_feature (385)..(385): n is a, c, g, or t
tatctcgcttcaggaatttaaaggggtngtttgaaataggttcatagggaaattttaggttntnttttaatttnttnttccaaantttttttntaannttncctgntctgggncagatcttggngaccaggtttgtnttgtcnaaatattctccccanataaaagcttttccancaattaccagagccttctgctnaggggtaccttnaaatgccaggggttccactacgtagaaatccttccagtcagggnaataggananaaggttaaggtaaaanggggcagaaaaaagggcccggaagccggccttggtaaaaagattaaagaatccttaatatagttaaatggaatatcctctcgccacacctgtatgattgtntctggntgaatctttact

SEQ ID NO: 542594 - DNA, 616 bp, Homo sapiens
  misc_feature (72)..(72): n is a, c, g, or t
  misc_feature (85)..(85): n is a, c, g, or t
  misc_feature (137)..(137): n is a, c, g, or t
ggaggaaccccgacaacaggacgccccttccgcgccgccgcccgcatgtgagtgccattccttggggcaccnctgccactgcagncctcagtcctgctgcatgcggaagaccgagcttgccccactcattgcgctcnggttccagcccagcaaagttattcagcaccagcccctcatgccatgcacccgctgccacccagcatgcaccctattttaagggtacagccgctgccaatggagagctcacagacctaagccttgatgaccttaaggggaaataatcggcgctctccccctatccttcggatttccaccctttgtgtgtcctacagacattcgtgcttttagcgacatacgctaacgaattttaccgttgtgaactgctgaagctgtcgcaccctcagcggattccccactttagtccacccccgcctgttaaatacacccagacaggaacggcgccttggcccacaacgacaccggactataggccgccccgaccacgccctttccccacgaccaccggggccctggtagaaagctcctggatttgcctacataggattattccatacctgcccccaaggcgtgcaaacaagaattctcccctccacct

SEQ ID NO: 542595 - DNA, 345 bp, Homo sapiens
ttatgtggatatttttctctttttaaccctataaaccattaaaatccagtcatcccttggatacgctaggggctggtttcagggcccccccatattaccaaatcttgcccatactcaagtcccccagaaagtcttgcagaacccatatgtagaaaagttggccctccagttgaccccccggacccatgagtttcccatcccatgcccaaatgctgatctgtgtgacctcccctgcatttgattgaaaaaagtatgcgggtaagtgtaccccccccgttcaaacccgtgtgtaagggtcccctgtacaaaaaagtttgtgaaataaacgtcctggagaatctttta

SEQ ID NO: 542596 - DNA, 339 bp, Homo sapiens
acaacctccatctacgttatgtactctcactgatatcctagaggagcagtctacagtatatgtctctggcagtcactctccgttcaccattcgactgtccccttttcccttgtggttccacaactcctactctactagttctctattactgattcctatactcttagcaccccagcccaaacatcatcatcttccagagttaaactcccataacccaatatataaaacaagtctacttatctctagcagtctaactctggggccaatatccacaaactcaatcacctagtagactgctactagtagatcttctggaggaatctcaaacatggtttaaac

SEQ ID NO: 542597 - DNA, 1467 bp, Homo sapiens
  misc_feature (352)..(352): n is a, c, g, or t
  misc_feature (868)..(868): n is a, c, g, or t
  misc_feature (1113)..(1113): n is a, c, g, or t
gcaaaaaacaacacccgcccgttttggatgtgtagccctccctctgttgagttgtccctccctgtggtgggacagcaacacttacccacaccccctcggtgggtgtgtcggcgccctcccagctgaggtggagacactcccccggggggcccggtattactagactccgtcgcgcgggctttatcattccatccattatgccccccccgggcgcgcgggagtaaaacaacattggttgtctcgcccacgccggggataatacgtctcggtgtttggtgccccatctatggcggccccctcatccttttattgttgggggcgcccccctccttatgtaggaacgacagcgtgntgtgttggcaccacacacaaaacaacaaaggcgccgtgggtgtaccaccccgtccggccggaatatcatttccccccccggcggatgctaatcaattattgtgttggcgcgctattataggaaggacggccgtcccgctttaatataatccccccccccctctcaaataaatcattgtgcgtcgcgtacacaccaccctctattgagggggggggcctacacacaccccccttgtttgtttatacgccacgtcctagcacaccgccgtccccgcgccgctcctctttggtggggtggggcgctatatcaaacaaacaccccgcgtctggtcgcacgatgattttgtccccagccagcaactaatacgtttctctatcgtctgcgtcggtgaaaaaactcctccctccccccagcctctcggctcgcacgctctggtctagaaagaattgttgtgagtaatcatctcgcgggcggggatgagagttattttctcttgtgtctctccctcgcgggaangagaaacacacaccacggggagtgtctctcttctctcggcggctgtgttttgagcaacacgcacccacgttggcggcgccacactctatcgccgctgactttctctcctcgcgggaagtaatgagctcccctcttttgttggcaccccgcccccctctttactcctctctcgcgagggaggacatctcacaattggtagacgcgctctcttctccccccccccagtgggtctctcatcggtcgcnccgttctctcttcttccccgcgcgttgttgttatagatacgccgcccctctcgaatagcctgagtgtttaggcccataatccctctcggcgcccccctcttataaaggtgtttttatgaaaggggatagagggtgcccccccctcacgaattgtgaaatcccccccccactcatctcttcgagaaaagttaaatacccccacactcttctcactcgcggtcccctctaggggtgttgtaaaagaggagagttttttataaagggggaaaaaaaaaaggggtttttttgaaaagggtgggggggtttttttttttttctctcttttaaaaaaaaaaagaggggtttttataagta

SEQ ID NO: 542598 - DNA, 218 bp, Homo sapiens
acacttatttattgtaaagaccagtgaccatggtatttaaaattagggtacttaatgattttcaaaggtgatttcagcttggttttgagataatcaaatgatttttactttaactcctatttttttaaactagcttttatttgaagatggaagctaagcaatgaaagcattactatattttttacattaagtggtaccaataaagtattttgttacca

SEQ ID NO: 542599 - DNA, 191 bp, Homo sapiens
ggaattttggtcagcaaaaaaacccccccctttccggggtttttttttatttggcccaaaaggttggggaggggggggttgggcaaaccctcagggcccctcctttttggggaaacccatccctgacccttaggtttttttccccaccctttgcggggggaaatttggaaaaaagggggtccggggcccca

SEQ ID NO: 542600 - DNA, 588 bp, Homo sapiens
  misc_feature (413)..(413): n is a, c, g, or t
aatcagtgtttccagcagcaaaagtaattggaaaatcgctagttttattaggttaattattctcccttatcgtagtgtggcatcagcgtggctattattcttaaattgcctctttaaaacaagggctggtgcttcttacaggcaattcctaactcttgggttttgtagagagcccaaaactctttagaacctataattcaaggaaaggctccactttggttttgcattttgtctggtgtctttggctgacagaatttatgtcacaaggtgcacatatttgggggaggctcatggacagcccatcgtgcttgtgctttggtaggaagtacgtgccgttaaggggaaggagatagttactgattctagggaacaattgggtagaaagagatggactccctgtgtttgaaattcanaactcaagcttggctctaagtgtttccttgctttgctttgctccaggggagtcactgagcagaacgaagcgagttgcctgagattcttcaaagccccagcccttttggaggttacattgttattctcagagcctttatgatgcataataaagacctagcttgtaccaatattaaa

SEQ ID NO: 542601 - DNA, 233 bp, Homo sapiens
  misc_feature (5)..(5): n is a, c, g, or t
  misc_feature (7)..(7): n is a, c, g, or t
  misc_feature (65)..(65): n is a, c, g, or t
  misc_feature (88)..(88): n is a, c, g, or t
accgngnacagcatcattatgaacggagaggccatcgcctgccctgagggctgccagtccattgntgacactggctcttctgtccggnccaaccagccccattgccaacatacagagcaacatcgtagccagctagaactcaaatgacgacatggcgtgcagctgctcagccatcagcagactgccctacatcgtattgaccataaaaggaatccagtaccccgcgccaccca

SEQ ID NO: 542602 - DNA, 232 bp, Homo sapiens
ttgttcaaccccaaaaaattttatttacaaaatttgtcctgaatactataaatccggccccatcaccatggaaacaactcccaatcctgcctggggatttgtgccccagcccaacccaagagggctttaaaaaacaaaggtgttttccagcctgcgccatacaaaaaggaaaacctttccccaatattgcctgggggggggcggtgaactcaacccccccaaaggggaaaaa

SEQ ID NO: 542603 - DNA, 423 bp, Homo sapiens
ggggctacgcacttgtctgaatctgtcatacataccactgctgtcttttccgagtggtcatcccaagcaacgatttttggtggtgtgttcgttctcaagagaaatgccaaggcttccagataaagctcaagatgataatgcattgacatggttctgctcttttatttgggtaaaaaaggaaagttgaggggtcagaacacagtagcctgattagtaccattctgtttggtcacactgttccccattagcttgtaccagttctcctcttctcggggatgtagagccacaatgtcactgtgaccaaacaatctgttcaattttttctcctcaatggcgaggtgatggtgtggcctgggtgtttctccaggagtgtgagtgggcagctctgtgggataagtcctaggtacctacatgccatctcta

SEQ ID NO: 542604 - DNA, 381 bp, Homo sapiens
  misc_feature (24)..(24): n is a, c, g, or t
aaaaaaaaaaaaaaaaaaagtttnctcccgccccttgtttttaataaacaaagagatctattttagtagtaaactgaaggtttagttgtgagcttcaaattttgtgaaccccaaatgttgggcgggggttttttttttttttaagaccaccactaaaaaaaatgcaaggaatatgtaccctggaactgtagtgggagctttcagtattgtaaaaagattgttctatacggccccttttgctgtttatcctgtatgtaataaagtcccttttagatcctatgtgaaaaaaaaagtgaagcaactgaattttcagcatgttttcatcggcggagcctttttgtgtaatgtaaactgtgccatgttattaaaaaatgtgaacta

SEQ ID NO: 542605 - DNA, 410 bp, Homo sapiens
atgcacgtagctgaggccggatgcggtggctcacgcttgtaatcccagcactttgggaggcctaggcgggcggtcaggggttcgagaccagtctggccaacatcgtgaaaccctgtctctactaaaaatgcaaaaattagccgggcgtggtggcgggcgcctgtaatcccagctacttgggaagctgaggcgggagaatcatgtgaacccgggacgcaggggttgcagtgagcggagatcgcatcattgcactctagcctgggccacagggcgagactccgtctcaaaaaaaaaaaaaatgcacatagctatcgagtggtggcttaagcttggaaacggtggaccttggcaacttccatggccaacttctgggctcctcaaacagtaaggttgggcagtaagggcacggg

SEQ ID NO: 542606 - DNA, 861 bp, Homo sapiens
cttccccttcggctttgcctggtcaggctcctgcctcccgcaggacccacctgtgtcccccagcgccgctccacccagcagtgcgcttatcccctctctgctgccagacaccccctgctgcccactctcctgctgctcgggttctgaggccagcttgtcacaccgaggcagcacttctctttctctttctctttctcttgctggcccacgagccgcagccaattggcgctgagttcctctgctggagttcatcctgctagctgggttcccgagctgccggtctgagcctgaggcatggagcctccttggagcactgggggcctcctccctggagatcctcctcccataaaccgtacgtcttgaggtctgtgtgctgtatcttcagccttcctgggagccccctgctacgccccagatctgccgtcctgcacggaggacgagtacccagtgggctccgagtgctgccccaagtgcatgtccaggttatcgtgtgaaggaggcctgacggggagctgacgggcacatgtgtgtgaacccatgtcctccagtgcaccatacgatatgcccacctcaatggactataggcaatgtttctgccgtgcccaagatgtgtgacccagccatgggcctgcgctgcgagtccgtaactgctccaggagcagagaacgcctgtgtgtggctgcagccctaggacaacttctgcatcggtccagtgacggggaccatttgctgccggtagccgcgcttaacgccacctccagcccgaggccaaaggggtgccaaaaggggaggcaccgaaaagtcaagaaacccctgagtcaagaatgccccccggggacccttctctcccaaatgggacca

SEQ ID NO: 542607 - DNA, 518 bp, Homo sapiens
caggaggctgaggcaggagaatcacttgaaccaggaggcggaggttgcagtgagccaagatggcgcactgcactccagctggggcaacaatagcgaaactccgtctaaaaaaaaaaaaaaaaaatggaacaattacacagctgtcgttggtaaccagtcatttttatgactgagagttaggcttgctgaaaataaagaactagaacacactttctagtcagcagagtgtggttggctctcaatggggttctggaaggttatatgtcgaaccaataatgggctgcccaagactattagggcatagatagagtagatctcatctccagaacagggtgggggtagctcaatttcaagccttggggatatatgatatctctggagcctgaggagcccacgacagcttagaaaatcaacggaagcataaaacatgctcacatctgaatgggtctctttggacttcatttgggaattggtgacaccaaggggaaaagcaccatgtcgtcacgggttttacaggc

SEQ ID NO: 542608 - DNA, 587 bp, Homo sapiens
  misc_feature (5)..(5): n is a, c, g, or t
  misc_feature (12)..(12): n is a, c, g, or t
  misc_feature (15)..(15): n is a, c, g, or t
  misc_feature (33)..(33): n is a, c, g, or t
  misc_feature (39)..(39): n is a, c, g, or t
  misc_feature (43)..(43): n is a, c, g, or t
  misc_feature (48)..(48): n is a, c, g, or t
  misc_feature (84)..(84): n is a, c, g, or t
  misc_feature (88)..(88): n is a, c, g, or t
  misc_feature (111)..(111): n is a, c, g, or t
  misc_feature (116)..(116): n is a, c, g, or t
  misc_feature (156)..(156): n is a, c, g, or t
ttganaatgaantanttaaaaggcagaaacccnactganttgnttggnccacagagggaaatgggaatcgcatgacctgaaggntganggaggaactgaacagaaaccatncttgnttcctgaatctgaacatggcaccctcttttcacagtgttngtatctgctcagtccggcggcccctcaaaaagaggcaatcttgattttcaaacttaaaatttggcccaaagcccactgctgcccacaatgcccgccagacacattcctcttcccttttagattctatgggaatactctctttgaagaacccatgaagcagagacaggctggtgagagaatcagcagtgatttctttgaggaggagagccgttacttcactcacagtccatgactgagtggatcaagaagaacagagcgcccttttatgagattttgtctgtgtagaccattagcttgtgaaaaatgccaaaaccatcctcgttctttaatagcagattatgttggactcttctctgcaagaagcagcatgggcattcagatgcttttaaggacataatgttctttctcatcaccagacctggtgctctgga

SEQ ID NO: 542609 - DNA, 363 bp, Homo sapiens
aggagtgtgactagactagaagatggtagaggagtgactaagttgggaggggcgacagtcacaagtgagtgggggtgacatgtgtagaagccgctgttgcaaaggagtagggtaaggatgaagtagagctaatagaatgaagggatatattaggctcataagggttattactgttctgcagaaatgcaagtgagtttaagggaagcaggggagagtacttgcgatttccaggaggaagaggagagatcaggctggctggctggcagacacagctttattctggaatggtgaacccaatacagagggtcctgcaggcggacagcagttggggtactatagatgactaagcagggtccagtccat

SEQ ID NO: 542610 - DNA, 294 bp, Homo sapiens
catctaggcttgcaaaactttggcaaggtatatggataaggggctgggcgcggtggctcatgcctgtaatcctagcattttggaaggccgagtcaggcagatcacctgaggtcaaaagttcgtgatcagcctggccaacatggcgaaaccccgtctctactaaaaatacaaaaattagttgggcgtagaggtgggcgcctgtaatcccagctactctggaggctgaagcaggacaactgctgaaacccgggaggtgatggttgcagtgagctgagatcataccactgcactcca

SEQ ID NO: 542611 - DNA, 972 bp, Homo sapiens
  misc_feature (538)..(538): n is a, c, g, or t
aggtgggtccagcaatccggttaggatcgcggtgccgaaaaaatgactgaggatccgaaattgaatgtactacctgaagaccagtcgcgtacatcagtgaccacatgtccctgagcattcgtcgacgcgaatgataggctccggcccgaagcgtacaaccaagctatatatcgaagcctgataccaaacttcacacgattctagagtcgcttctgttcatattgccattgcgtattgaaaccaagggtgtaggctcaccaaagtcctgtacacgggcaagagaatctatatatttgaggcgacacacccagttgctcaggaccaatgcaaccgcgtcacataaacttgcctgatcaaaatgttttccctagatttttcaacagcgcggaggcctcccttggtgccaacatttctttgcaggctagcctacaacattcaaagagtgcaccagggatgtgcggtgttacgatttccagaaatccatcagcgcatgggacctgcaactgtggaaaatgtttaattgaccattgcagaagtnccttggttgcagcaataattgccttgtctcgacctaatccattttttctgttgcccagaaacattgagccccaaactactaggggacaattacaggacacttatcaaagagacaccaggaaaccagtcactgaggattaagaaacaatgcctccccattgtgtgtgtatcctgtccccggggaatctagacggaaagaggattggttacaaccagttcatgaagcagggattaagcagggttctttctgcacatggggctactaatcctgacagttacaacaacgtgatcccaggaattgaaattgcgcgctctggtggaagatgtccaattctggagaaacctaagacggtccatgcaatggatctgggaccgaaccttccagaatggattaaataggaacacagagaatagtgaaaacctgttcccgaaaaa

SEQ ID NO: 542612 - DNA, 298 bp, Homo sapiens
  misc_feature (215)..(215): n is a, c, g, or t
agaaacaagagcgaaactcctgtctttaaaaaaaaaacagaggtgcattatttggcaataaaaaggaatgaagtactgatacatgctatatcatgatgacccttagaaacatcatgctaagtgaaagaagccagccacaaaagaccatatattgtatgatttcctttatatgaaatgtacagagttgacaaaaccatagagtcagaaagcagatnagtggttggtagggtttgagaagagggggaaaggaggagtgactacttacctgcaaaccaaataagagggatccatctaaaaa

SEQ ID NO: 542613 - DNA, 381 bp, Homo sapiens
  misc_feature (9)..(9): n is a, c, g, or t
attcgcggncgcgtcgaccccctctggccccaccgccgcacaacgggttgccagcgaattgctcgaaggcatcaccccggccttgctcgacgagcgttttgcccgggcgaccctctattactctcagcgcgagttcgaggaacaactgctgctgcgctgcctggagcccgggcaggacttccaggccctcgcccactgggggctggagcatttccagtggctgagcccctggcaacgcgccgacttgccgaaacaagcattgctcgaactcgatcagcgtctgttcaagagcctggaagagccctgcggcctgcttgggcgcggggatgtcgaaggattctggcgcgaatactccaacctggagcagctcggttggctcaa

SEQ ID NO: 542614 - DNA, 359 bp, Homo sapiens
  misc_feature (12)..(12): n is a, c, g, or t
  misc_feature (41)..(41): n is a, c, g, or t
  misc_feature (72)..(72): n is a, c, g, or t
  misc_feature (343)..(343): n is a, c, g, or t
  misc_feature (345)..(348): n is a, c, g, or t
ggaataaggggnccataaaagccttgccccaggcccaaagncccagaagtttttccccaaggttatcctccnagaattttatgattttaggtccttagatttaaagtcccctgatatatgttgaagttgatttttgtataaggtgagtgatgtggatcccaatttcattcttctacatgtggcttgctagttatcccagcaccatttgttgagaagggtgtccttttcccactttatgtttttgtttgctttgtcaaagatcagttggctgtatttggctttatttctgggttctctattctgttccattggtctatgtgcctgggtcttagtgttttgcttnannnnttgacaaacgt

SEQ ID NO: 542615 - DNA, 534 bp, Homo sapiens
ccaccttatgcgtgggtatggtggccagtccaatttcatggcattgcttgcagacccatggaacattcaaagtcttaggttacgtgtgtcgcccagggcttaaaatcaccaagtttgttaaatgcacagtattagcagctgtctctggagttattggccagcctattttttatttttatttttttaagatggagtcttgctctgtcacccaggctggagtacagtgattgtcctgcctcagtcttctgggtagctgggaccacaggcaccccaccatgcctggctaatttttgtatttttagtagagatggggtttcaccatgttggccaggctggtctcaaaccccagacctcaagtgatccgcccaccttggcctcccaaagtgctgggattgcatgtgtgagccaccatgcccggcctcattgtgattttgatttgcatttctctaatgatgagtgatgttgagctttttttcgtatgcctgttggccacatgtgtgtcttcttgtgaaaagtgtctgttcatgtcctttg

SEQ ID NO: 542616 - DNA, 271 bp, Homo sapiens
cgcgaggtatatccaggctgagtgcgtggacaatcttggctcactgcaacctccgcctcccaggttcaagcgattctcgtgcttcagcctcacagtagctgagattacaggcgtgcacccccacagccagctaatttattttattttatttttatttatttactttttgtgtatgtgaaaaagagtctcgcactgtcaccgaggctggaatgcagtggtgtgatattggttcgctgcaatctccgcctcccgggtccaagtgattctcctg

SEQ ID NO: 542617 - DNA, 583 bp, Homo sapiens
  misc_feature (26)..(26): n is a, c, g, or t
  misc_feature (63)..(63): n is a, c, g, or t
ttgaaatgtgaatttatggataggtngtaatttagttattagtatttggtttatatttaattnagaagtaaaaatgagaagaaatttggtatttaaaaattgattttaagggttggtaaaagtatttttttagtaagttttttattggatatttgtgattaatgtttatttatgtaatgtttttgtatttgaattgtttatgtatgttttttattatattgatttaataagaagattaatttatgttggtatggtgatggttttgttatggtaaaattaaagggttgattatatatggtgttttttgggaagggggatggtgtggggttgagtatttttgggttgaatgggaatgggttagattgggaagtttaggaagagagttttattgtagattttttaggtattgttttgttgaaataggaatataagtttttagtaatattttgatttaattgggtgatattgataataaagtatgttatttagatttatttaaagtgtgtataattgtatttgaaatgtgtttttgtgtgtgtgtgtgtagaatgggtaaataaaattgttgagtaatttgaattta

SEQ ID NO: 542618 - DNA, 252 bp, Homo sapiens
tgggacacctaccctgggggacgtgactggacatggctgtgaggaatctcaatgatgagaccagcctgaatggcgtactatggagggacatcatcgtggttgaatgggacggatgtatggaaaacaataaaatcaatctctgccaagtcttcccattataaacactggcctaccggtttcctcgtgagtgacgtgactctcaacccaagacgagctcacaagaagatgtctctaggacgtgagcatgcactg

SEQ ID NO: 542619 - DNA, 305 bp, Homo sapiens
tcttctccttcccacttctctctttcccttctttccgcttctattctttccttccttccctcccattccatgtttaatccttattttagaatagaaagaatcagagttgagaccttgtgcaactttgaacttgcatcttttcttttgaacattcatagttgtttcctaagtagcatcttctttatctcagaggctgaatggctgtaatgtgcaaaaggtttgtgaggccaagctgctgagcagctcaggcgaactcacggtcagggagatccggggcctgcgattctgcttctaggtcctttctc

SEQ ID NO: 542620 - DNA, 123 bp, Homo sapiens
tagagaagctagtggtctggatcctgggtgcggagctcgagaagtagtcgatcttgagagtggcaggcaaaagtatcccagcaccagaaatggcagagagaggtcccggaccggaggcggcag

SEQ ID NO: 542621 - DNA, 712 bp, Homo sapiens
gcttcgatgctgaaggaagatgatggctgactgtgaaccccgtcatggccgatagctcaccgtggttgctgtcttccgtggtcggatgtccatgaaggaggtcgatgagcagatgtttaatgtgtagaagaagaaaagcagatactttgtggaatggatcaccacaacaatgtcatagacagccgtcgtgtgtacgatcccgaagcctcgtggaccgtcgaagatggtcgagtcaccttcacttgtgcatagtagcagagacatccaggcagcatcttcaagagctatcgtcggcatcagttcagtgccatgttccgccggaaggccttcctccactggtacaccaggcgaaggtgctatgcgcacagaggattgggagttctaacccgcaacgtgttgtgattagccacaatatgaaccgatcttcgtcatctgagctcatctgacgcagtatcaggcatgcctcacgcagaagcaatggaggacggatttcaggatgaggaggccgaataggagagtctaaaggtcatgagggcccctagtcaacttcaatgcttcctcgaagtgcccgttaaggtcgggtatctactcaaacctggtcccatttccatcgtccacttccagacattaagttagttatgcttggcactcttatcttatgctttgattggtttctattgcattcatggggggggggggtcgtaagtacaca

SEQ ID NO: 542622 - DNA, 193 bp, Homo sapiens
  misc_feature (62)..(62): n is a, c, g, or t
  misc_feature (187)..(188): n is a, c, g, or t
agaacaaaaaaattaggaaagcaatgtctcatccaatacagaatatcaataaagagattganattgtagaaaagaaccaaatagaaattctggagttgaaaagtattataactaaaactgttcactagaggtattcagcagcagactggagaagtcagaaggaatcaacaggcttcaagataggtcnntgatt

SEQ ID NO: 542623 - DNA, 85 bp, Homo sapiens
ctgtgacccaggagttctgggataacctggaaaaggagacagagcggcctgaggcaggagatgagcaaggatctggaggaggtag

SEQ ID NO: 542624 - DNA, 136 bp, Homo sapiens
tgacttcatccgccactctgttgtgcagcccaccggccttccttctaccctgctgtgatgtccaggcgtttgccgtcctccccaactcctccctggcttccctcttcctgattggcatgaaaggcctggacagggt

SEQ ID NO: 542625 - DNA, 1777 bp, Homo sapiens
  misc_feature (1697)..(1697): n is a, c, g, or t
  misc_feature (1722)..(1722): n is a, c, g, or t
  misc_feature (1777)..(1777): n is a, c, g, or t
ttctatctgaagcttagagatctagagcttaggatctttcgggtatatgtccaatggcaggtcattattttatcaatcactttgccattgcaccatgaagtgggttccatgggggcaacacaccatgcagctgtgcaaccattggtcagcaacacacagccatcatcattccatttcaacaactttcctatgctattatagccagcagagcaagccctgtatcatcgttcaccatagtgtgcacatttacagtcagtttcaacagcagcatagtattcgaacacacacattggtacgccatggtttatagtgcatagccacattttgcgggacacattggtatatcacgtatcgcacgacagtgctcaggatcgcattctaataacaaaacaaaaattcccatgcacacacatcacgttgacaccaatcaatgtatgtagcaggcaatatataattctatatatcgcgtctatttccaaagtatattatatacaatattaaatgtcgtagcagaaagcgggacggaactactaggcgtacctataaaccagccacacacaggcctaagagcaagttagcacaacgtgagggcagacaggaatacctaatggaggactataccactggcgacaacaacccttaacacaaacacacaccaccgaggggtatcaccaaaagaccagaatataactacccatgagaccctaccgacagccctccgcggaggaaagaaatcacggcacgatgggcgcacacatactaaccaaaagcgagcgaggacaccccgagacacaaacagccaagcaagactacacccggggggcccatacaaagagtatctgacagtgcataacataatcaaaccacagagactcaagcaacgcaccccggggagaggacatcataaagagggcagaatacacatagacatcgagaggacacgaacaggggatcgattgaggactcagtccacaaaagccttacccgatggagaacaccattcgacacaggaataggacagatcaccaaacatcgttatgaggcgcatacagaggggcgacatactcctcacaagaacagacgtgggcttagtcgaggagaaagtacaacgcaaagcgggattggtatcgacaagcacacatccccaggaagggccccccggaggagttgcacaaggaaagatgataagctagatgaacgtgtagggaccaatgacaacaacgtaaattatgccaggacaaatatgatgatgagccaacatattgggaagaacacgagacacactgtaatggggcacaaacccacaagctaaacgaaccgcgtatggccaacatgagaacacaacaggaacgcgtatcagacgacaagttatacgtggcctcgaagcaaacacagcgtgcaccaggcatggcgtaaaacgataaaagacggacacacatgggcgaagacaacaccccaacaggccaacgaacacagggaataaacacactaaacagacaggtggcgaggcatcgaagcaaacagcgcgaacacggaaacagtatccacataccaagacatgatgagatctcccagcacacacaactgaggcactgtgctccgtccaatctaacgagccgtgatgaagacaacattatacggaagaagaagatcagcgacaagtctagaatacggaagatacttgaccacacacagcncatatcggaaacggcgacgcgccancaaacaaggcaggctcagcacgaataagtatgatcgacaggaacacaaacacacn

SEQ ID NO: 542626 - DNA, 244 bp, Homo sapiens
agtcgtattcgcctgcctcttccatgtgacatggtggcgatcaccgcttcctcctcagcactcgcatgtcagcctgcctcttccatgtgaaatggtggcgtccaggttcctctccagcatcgcatgtcgctgctcttccatgtgaaatggtggcgtccgggatacctctccagcactcccatatcgcctgcctcttccattgtgaattggtggcgtccggggttcctcctcagagctcgtatgt

SEQ ID NO: 542627 - DNA, 519 bp, Homo sapiens
gtctcatgtaattctgatagcagaattgcattgtgtgaactgtgtaactttagtaatgtaaatcaaggaacatcagttaagagatttcctaatttattttttaactgaataaatatcagttaaaagattgccagcatggttacaggtaaactgattttcagaattcactgaactactaaatgtgggattggataatagacttggagtgcccgctgaggctgagatctgtggccatttacatagcacatcattcctcctatagggatgaactttttttccgacacaaaaagtagccactgcggttaaagctttgcttattgtaacaggcttttatttccaggtaacctatctgtggaagacctaattctgaatagagtaatagatattactggaaactgatttgttttttttttcctattatactctgctttattgaaaaagtaaagcatttaaaattgtgctccagaaattcagatgttgtcttgcgatctttaaacaataaaatggatgatttcccct

SEQ ID NO: 542628 - DNA, 171 bp, Homo sapiens
attttcaaaggcaagcatgggaggggagaggaaagagagtggaatttcaggtggaagaattggccagaagtggaggctggcacaggtaagtctgggggacatttatgggagggaggtagagggattagaaatggccttttgcaaaatttgtgaccagtgaggccaaatcct

SEQ ID NO: 542629 - DNA, 181 bp, Homo sapiens
gacacctgcgcggaggagagcggggattccggaactagagtgtgggagccagaggcctgtagcgggcagggctcgagcactggagtagagcagtcctgacaggtagagaagtgagaccggctgcggtacagggcgggttagggctccatgcgtggcttgcgggccatgcgtggattgccag

SEQ ID NO: 542630 - DNA, 122 bp, Homo sapiens
ccctgcctcagaggcctaatgcttgctaaatggggggaaggtccaacttaaccttatggatttagtgtctgggattccagcaactcaaagtcaaaaaaattcaagaggtgggtcagaacata

SEQ ID NO: 542631 - DNA, 203 bp, Homo sapiens
gcgactctagagcatcccttatttccttctttattgagatagagtctcactctgtcacccaggctagagatgtaatggcatgatctcagctcactacaacctccacctcccgggttcaaacaattctcctgccttagcctccgtagtagctgggactacaggtgtgcactgccatactctgctgattttcgtctcctttccct

SEQ ID NO: 542632 - DNA, 408 bp, Homo sapiens
cccccgggttttccttttttttttccgggttttttttttgggggaatttgggggggaaaacatttttcccccgggaacagttttttcccttttttcccccaggttgaaatttcccccccccaaaggggaaaaaaagggggggtccccccggggggggggcccttttaaaaaagggggtccccccgggcccaggaatttgggccgaaaaaaaattttgggacccttttttaacccttttggttttttaaaaagggccaaggggtggggaaaaaaaaaatttccctttttaaaggaaacccccgaaattttttttttttttaaaaatggggggggggaacccccctttaaaaggttggggaaccccccccggggggcccccaaaacaaaaaaaaaaggggggttttttta

SEQ ID NO: 542633 - DNA, 219 bp, Homo sapiens
  misc_feature (6)..(6): n is a, c, g, or t
ctaggntggaaagcgacgtcaacaagaaaatcacaaggcacacaaagaaacagtgatatacggcccatccaaaagaaaactacaaatccaacagaaactcaccctgagaaagggtagatggcagatccactagaaacagactttaaaacagcgatcttaaagatgctctaaaaactacaggaatatgttgctatcaaaactgtataataaaacctgata

SEQ ID NO: 542634 - DNA, 968 bp, Homo sapiens
ggcaacagctgagccgtctgggaagggatgcatcttttcttctgtatgcttgagtcaagaactctaagtcatctggtaataccgggttggatgcttaaagctgcagcaaaaagagcagtaacttttcagggaaaaaagagagaaaaaaaaaaaaaaaaacaaggttttttgttttttgtggcaaaaagtttgtggggatgtgctttgtggtgtttcttggaaatccggggtgtgtttgccaaagtattaaaatttccaagcactcggggggaattgggaaaaaattttgatcgccgaaggaatatattttttacctttggggcaacaactggagactggggttttaacaacacgttgtatattccgtggggacgtgttttaaagaaacataaggaaccctttttatatagagagttttatgaacaacgggtgtggtggcaaactaagaattccggggcactaaccacccaacttaaattggtttggaaggggaacggaaaaaactgtactacgggggcactaacaactctcgcgaagggttttaaacaagtagaacgtgtggggcacgtgggtaacactatatctattatagggggtgtaacgtcccagcgtgtgataaaacgctaacagcgaaacgtgttacagcgttcgtgaacagtgtgtcataggagccacggtgtgacgcggaccccctcttgggcaaaaacaaacaattccgcggtgtcacttcctgccccttacgaagggacaacacaggagagtaccagtagaacccaagtgagggaattaaaaataccccagacgcggtagggacacacacagttgtctcccacaaacacaggggccaagcaacacggggaggggtctagacttacgggggaacgggcgggaaagtacggacagtcccggagaacacggatgctatgcgcgagaggacgcgagcgacccggtaagaacctcaggggaaa

SEQ ID NO: 542635 - DNA, 212 bp, Homo sapiens
ctagagctctcatctgccgagttttgctctgctacgctgaaccctacattggaaaggtcacatggctgagctccagctgacagcctcggaggagctcagcttcaagccatccctgcaaggtatcagccatataaatgaatcaacccagctgccagtcaagtatctttgcatggcttccatcagtgcctcatgaaacggaagattggctagcc

SEQ ID NO: 542636 - DNA, 487 bp, Homo sapiens
gcaaccactgacctgttttctgtccctataagtttatccttttatttaatagaaatccgtgtaattatggccaggcgcagatggctcacaaacgtaatcccagcactgtgggaggctaaggcgggcagatcacctgagtcaggagttcgagaccagcctggccaacatggcaaaaccccgcctctgctacaaatacaaaaattagctgggtgtggtggcacgtgcctgtggtgccagctatttagggaggctagggtaggaggatctcctgaggaggtcaaggctgcagtgagccgtgattgtagccactgcactccaacctgggcaacagggtgagaccctgtctcaaaaacaaagacaaaaaaacatgcaaatctgtagtatactatctttcgctgatgtaaacagtaactgtagataatgtaacagtttctcaattctttaatttgaatacttgtaacatatacactcctaaagtaatttacat

SEQ ID NO: 542637 - DNA, 132 bp, Homo sapiens
tagctggaccttctctgtcgcatctttcctgtcgcttttctctgatcgctcttctctgatcgctatttctctgatctgctctttctctgatctgcttttctctgatctgctccccccccccccgcttacgag

SEQ ID NO: 542638 - DNA, 178 bp, Homo sapiens
ggcgatcaggacaattagctcaccacaagacgagctgcatcttgccgccatgaggatttcttctggatgcactcgggtggggccaccggtgctgggcacaggcgcaccatgcacgggattttcttcactctgcccctcgctgcctgtcaagtctgtgtccacattgttcagcgtctga

SEQ ID NO: 542639 - DNA, 218 bp, Homo sapiens
ctttaacggatcagttaattgatgaaaaggagaaagggccatgtgtctgctgagaattcaagtaagtgatatagtatttcaggtgatccatacgtgtgatattccctgtgagtgagacctggcacactgcgagggtaatgtgccttgtgtacaaaatgcatcgaaccatccccattagacttacgattaaagcagccgaatttgaattttgaccagca

SEQ ID NO: 542640 - DNA, 112 bp, Homo sapiens
aggccaagctaaatactaccgatggcccaccataattacccccatactccttacacgatgcctgatcacccaactaaaagggaaacacaaactaccacctacctccctgacc

SEQ ID NO: 542641 - DNA, 249 bp, Homo sapiens
  misc_feature (67)..(67): n is a, c, g, or t
ttcttcccctgccccccctcacatacctctgccctgagacacagtctctgttgcccaggccacagtncagtggcacagtgtcagctcacctcaacctccgccttctgggttcaagtgattctcctgtctcagctactcggagaggctgaggcaggagaatggcgtgaacccgggaggtggagcttgcagtgagccgagatagtgccactgcactccagcctgggcgacggagcgagactccatctccaa

SEQ ID NO: 542642 - DNA, 159 bp, Homo sapiens
  misc_feature (38)..(38): n is a, c, g, or t
  misc_feature (86)..(86): n is a, c, g, or t
  misc_feature (98)..(98): n is a, c, g, or t
  misc_feature (151)..(151): n is a, c, g, or t
ttgccctgttgctcaggctggagtgcagtgtcaccatnatagcactgtcagccaccaactcttgggctcaagtgatgccttctggntcagcctccttngcagctgggaccacaggcacaggacaccaggcccagatagttaaagacaaaanaaattggc

SEQ ID NO: 542643 - DNA, 751 bp, Homo sapiens
gtgctgtgatactgttcagaggatcccgtgatatgcgtacaggagagcagcagcgaagactaaatacacattagatttctacagaagaagaggctgatgatgctgatgatagatgatagatgacaataatgatttagaggaattgaaagttaaagcatctcccataacaaatgatggggaagatgaatttgttccttcagatgggttagataaagatgaatatacattttcaccaggcaaatcaaaagccactccagaaaaatctttgcatgacaaaaaaagtcaggattttggaaatctcttctcatttccttcatattctcagaagtcagaagatgattcagctaaatttgacagtaatgaggaagattctgcttctgttttttcaccatcatttggtctgaaacagacagataaacgttccaagtaaaacggtagctgctaaaaagggaaaaccgtcttcagatacagtccctaagcccaagagagccccaaaagagaagaaagtagtagaggctgtaaactctgactcggattcagaatttggcattccaaagaagactacaacaccaaaaggtaaaggccgaggggcaaagaaaaggacagcatctggctctgaaaatgacggcgattataaccctggcaggaaaacatcaaaaaaaaagcaagaaccgaagaagactctttgatcaggatcagatgtggaatcttccctcagattccgagtgagcacttatctgcagaccggtgg

SEQ ID NO: 542644 - DNA, 172 bp, Homo sapiens
cctttttggggttttttggccaaagcttgtccccagccccatggcctttccaggggggttcatgcccccaacccgcggccagccccacgtggggccgctcacccttttttgcccctcctgggaatttgtcatttgtgggggcttcaaagtaaaatcaatgagtttttgagca

SEQ ID NO: 542645 - DNA, 337 bp, Homo sapiens
gctcggccctgtgagtggcgtttgacagcaatgccctggagctgtccgccgttaaaggcaaagcccacgtcgcggtggcgctcagcgccatggaagcggcgaaaatccgtcgcctgaccggcgtcaccgccagcctggagctgaccattacgctagccggtgcaccgctgcatctgcatctggtcgggcgccgcgtcaacaacctcgaatgggcgggcaccgcttccgccttcagcgacacccaatctgtggcgcgcgacctggtgcacggcctctccttcgccgagcaggtggtgtccgaagccaactcggtgatcgtgatcgtcgatcaacacgg

SEQ ID NO: 542646 - DNA, 122 bp, Homo sapiens
tgacgttcaccccagacgacgctggaactccatgacgacgcggctctctggggtaacgttgacgacccttcgtggtaacgtgttaccacgctcttacacgtgcatgtgcgagacggggactc

SEQ ID NO: 542647 - DNA, 220 bp, Homo sapiens
taacaggggaggggggtggtgcagtgccgttggtacggggctggctccttgagcacccttggtgaagagcacatgattcagtgcttggcagaccggggtaggtgccgtgtctgtcactctggggcctctgcatcctacacctgctcagctcgtgtatgacgtcaactgctaccttcctagagagtggtgggaattaactggcgatagctgtgtggccaag

SEQ ID NO: 542648 - DNA, 366 bp, Homo sapiens
gtagtagcagctccctttatacagtatcttaggtagagattattaactgactagagacgccgcgcaggcgtaaatttacccacgaagttacagatacccgtttctcggagaggttcaattttagagggcgaataggtagttagagagacttagcaaggaggaaattaacacggactgccgagtccctaagcatctataagaatctaccgcacgagcgtcaatactcggacgcggcgacgtagccagttacggaacttaagcccggagggtcagcttttgaactacgaccctcgtatccctcaggcaccgtcccgtcgggtacccctcctttcacggtcgaggcccttctaggagtacgagttattg

SEQ ID NO: 542649 - DNA, 393 bp, Homo sapiens
ggtactgacctgcggagcacccttacaggtattgaggttgagctagcagtcacagctagagcatagaaagctagcctatggaagacacactgagcagaaactggaggcgcgctatcggagcccagactggcgcatatccatggcgctagatcagcggtaattgaagcccagctagggcgatgtgcgagctagatagtgagcggcagaatcaggagtaccagcggctcatggacatcaagtcgcggctggagcaggagattgccacctaaccgcagcctgctcgagggacaggaagatcactacaacaatttgtctagctccaaggtcctctgaggcagcaggctctggggcttctgctgtcctttggagggtagtcttctgggtagagggaag

SEQ ID NO: 542650 - DNA, 748 bp, Homo sapiens
  misc_feature (1)..(1): n is a, c, g, or t
  misc_feature (175)..(175): n is a, c, g, or t
  misc_feature (215)..(215): n is a, c, g, or t
  misc_feature (224)..(224): n is a, c, g, or t
  misc_feature (238)..(238): n is a, c, g, or t
  misc_feature (249)..(250): n is a, c, g, or t
  misc_feature (262)..(264): n is a, c, g, or t
  misc_feature (275)..(277): n is a, c, g, or t
  misc_feature (280)..(280): n is a, c, g, or t
  misc_feature (283)..(283): n is a, c, g, or t
  misc_feature (299)..(299): n is a, c, g, or t
  misc_feature (307)..(307): n is a, c, g, or t
  misc_feature (314)..(314): n is a, c, g, or t
  misc_feature (351)..(351): n is a, c, g, or t
  misc_feature (359)..(359): n is a, c, g, or t
  misc_feature (362)..(362): n is a, c, g, or t
  misc_feature (366)..(366): n is a, c, g, or t
  misc_feature (372)..(372): n is a, c, g, or t
  misc_feature (516)..(516): n is a, c, g, or t
  misc_feature (563)..(563): n is a, c, g, or t
  misc_feature (580)..(580): n is a, c, g, or t
  misc_feature (596)..(596): n is a, c, g, or t
  misc_feature (608)..(608): n is a, c, g, or t
  misc_feature (623)..(623): n is a, c, g, or t
  misc_feature (671)..(671): n is a, c, g, or t
  misc_feature (705)..(705): n is a, c, g, or t
nacatctcttttacaataaagagaatttagagctcacttgtcaggaaaatatttttcattattaaaaaaaattgttataaagttatttcttctgatatggagtttcaaagcatctaacataaccgcttcagaatctccacagtgcaaaaataaacaacatgcatacacttaaganctttacattctttgaaaaacaatacaaattgggaaagcanaattcagtntgtgcatccaaagnagcagttcagnnctcaagttctgnnnctttgcccatnnnggncgntgtgatgcctgatganttattttngtttggnagtccatttaacagtccattagttctgtttcgttagntgttgacnttncagncagttntttcatgccaccaaccaaagcaacttcagctcctgggtgcccagcaacatcttccttttctgcagagtagaaaatataatccacagttatggcacttcgggaatgacaggtggtcacttctggaattccagtgtcaggaaagtnatgtgaataaacagatgacaactgaatggtgctgtaatttgacgcantttttctgctgtcactnggcctctgtttctctnctgtgtttgtgntgacacttgtcctgncgtttcctccttttggtccctgcctgttcctcaatacacacgagttcntgtgagatacctaggtttggggggccaaattggnatagataaaatttctttgtacccgtgaatgactgttcctgggc

SEQ ID NO: 542651 - DNA, 325 bp, Homo sapiens
ccggagcttatacgttatgtattaagtatctatatatttaagtatgtatgtatgtatgtatatgagacagagactcgctctgtttcgcccaggctggagggtgagtcggtgggtgaagggtaactgaaattgaaaagcctgggacatgactgtacactactataaactttataaatactgtacaccgaggctacactacatttattttaaatatttttttcaataataaattaaccttagcttactataacttttcgctttataaacttttaagtttttaaaactttttgactcttttgtaataacacttagcctaaaacacaaa

SEQ ID NO: 542652 - DNA, 457 bp, Homo sapiens
  misc_feature (98)..(98): n is a, c, g, or t
gaagaggagatccaaaacctggagattgacgtggatgagctcctggacatggagagtgacaatgcccgggctgccagggtcaaggaactgctggttgnctgttacaaacccacaaaggccttcatttttggcctgctggacaaaatccggggcatgcaaaagttgagccccccccaaaaaaagtgagggtccccgacccaggagaacggtgggttccacaggacaattgttgcccccccaaccttgtagcaacagcaataccgggggacccttcggccaggcctggtgccataaacagggctccttgtgcccctggcccaggggttttttcccctgccccctcagttttccccttttggggttttttattgttattaaactgatgggcctttttgtgtttttatattgactttgcggcgcgggccctttaataaagttaggatacccctttggtgca

SEQ ID NO: 542653 - DNA, 652 bp, Homo sapiens
gggggacgaaaggacctcctggcactgacttcgttctgtcaggaggactggtttccagccataccgtgttcatggaaggcagaggggctgtgaggcactccactaggcacaagctgagaggcagcagcttggctaatactcgacgcaggctagtggggcaaattcctgccctctctcctctggccttctgggccgtttggtacgtaatcacccaggggctggtaaagcccctcctcttggcaacctcaggaatcaccaagtgttactagatcaagggattgtgaggctgctgttgggggtggcggggaaggggaatggggcaggcaaacgccagtcttctgtcttcctttgctaacttagggttttgagcaggattggggtaaggtgcctgtcataccgcaccctgccaaccctgggaacctcactgttctctctttcagcctagaacctgctagatcacagggtgtgtgtgagcttgagggtgggtggaggggtttgcagtgtgggaatgtggccctgcagttgacctgagctgcttaacatggttgtccattctggggcttaaagaaactgggatccagaccaagtagaggccttggtgctggttggggtggggcctgcagtatcttccgtgggtgatttcatgtgttcc

SEQ ID NO: 542654 - DNA, 133 bp, Homo sapiens
gctttacagaagggaagaccttttaacttgacagcaggctctcttgagtccacagaacccatatattttctacaaacgacaagggccagggagtcacggttgcctccaacgccttcgggcaggtcggcaccaa

SEQ ID NO: 542655 - DNA, 162 bp, Homo sapiens
gactttagagtattccccgcgggcacatatcctaatctatgttaacctacctaccattgcgctgtgtaacacagattctccctctgcgctatgtgtgacattgccatcccactgctatcaaccagggagctcactcagtgggtttgatcgtggtggatgctg

SEQ ID NO: 542656 - DNA, 960 bp, Homo sapiens
ctcgtattgggcccccgccctgttggggtcgcccatttggggtcctcccgcgcgggcaagacttccgcgcatgggcgctggtgcggtggacaattttgtcacccgcgtgcggggcgacgaaactggggtctgtatcccacgagcgccccgtttgttcggccctatgtctccgggaggtcttcttcctcgagggttccctctccccttgtcggtgcgcgaccccgggtgggccccctgcgaaggaggggcacgccctaggtgtgcaccccctctttgtggacgtgtcctccgacgagtgttccttcacgcagcgccgccggcgcctaccaatgttttggtttctcagacccctttccctggtcaaattgaggtcttctcccctcaccgcccgcgttattctgggcggaaagggcaccgcgcgatggcggctaatttctgtgcgcgtaaaagtgcggccgcacacggttacacatagaaaggtttgggaaaaaatagaatagcgccgactagttacaggatgctgtgagaccagctattcccccctctgtgtctacaggatacgtgtgcgtgtcatacatgcataggcggagtgctcccccctgtgtgcagttcaaggagacaaggtacgacgatccaactgcgctacaacagagagataatccctctgttgcgcaagtgaggaagcctagatcgcacttgactcggacggcaacctattgtgtgtgtcgccacgaaccttccggcgatgaaaaccgccccccaaagtacgtgacaaacagtgagcgagcaatcttacactcgagccacctctcatacatgcagtggtgtgaaccacgcctgagcccgcataccgctccattatgttgaggcaaagtacgcacttggggaattcccaggcccctggacatgttttttcccccccggcgccccctattgccctttttaacaacccacataaca

SEQ ID NO: 542657 - DNA, 210 bp, Homo sapiens
tacccccctgctctggtgttgctgtgagctgtggtgtaggttgcagatgtggctcagatctgatgttgctgtggctatggtgtaggccagtggctacagctccaattcgacccctagcctgggaacctccatatgctgcgggtgcagtcctaaaaaggcaaaaaataaaaaataaaaacgaaaagatcagcagggggtggcggggtggcc

SEQ ID NO: 542658 - DNA, 409 bp, Homo sapiens
ctcgacggcttcacggaacttcagataaagattgaatatgcatttattttcgagataggatcttgttctgtcacccagagaggagtgcagtggcacaaacacggctcactgcagccttgatctcccagactcatgcaatcctctcacctcagcctcccgagtagctggacctacaggcgcagccaccatgcccagctaattttagtgttaacagtagagatggggtttcaccatgtaggccaggatggtctcgatctcttgaccttatgatcaaactgcctcggccttccaaagtgctgggattacaggtgtgagccaccatgcccagcaaatttttttttttattattttcggacacaaagtctgggactgaccccacaacctggagtgcaagggagcacacacacgg

SEQ ID NO: 542659 - DNA, 699 bp, Homo sapiens
  misc_feature (289)..(289): n is a, c, g, or t
  misc_feature (365)..(365): n is a, c, g, or t
actacaacgaccaagtttagttcaacctggcatcaagtcgcctccatggcaaattaccctgaaacatagcctaaatgtacgcctaactttgatatgacgtcttgtgaaccaggtcaagtcttgaaattgcaatacaaaattcaaatccaagcatcagtcagtttgggttacaaaaaacgcctcagcagtaagcttagactatattcatagagcacacaagatggtcatgtcctcattgctcagaagattcactattaacagcaatggctcgactcattagagctacgangatactagtatggacaggatgtgagtcacacaggcagtagagtctctggccccaatcagtatctggggaatactcncagcacagcgtcctaggtctgcatgtcagcctgttcagcagatctgtgaataatcactccagtagtctgaccagtccttgtgaaacatccagtatatcatgactgagatacttacatacgacctcaagtcagtgtctgtcaagcatggctactctggcatatgatccagctaagcagcagtagtgagttcatacttatcactcataggataatggcagccaaatctcaatgggtaggtcctggaaaggccaaggtcgttcccagtgaagcacagttcagacaacaagtcctgtaacatccgcatggccataccctcacgtgcctcacatccttg

SEQ ID NO: 542660 - DNA, 168 bp, Homo sapiens
gacttggtacgctgcttctatcagagcaatacgccgccgtttgtagctagcaggacacgtaggagtaacaagacgctgaatctatgggtagctatatggtcctaaggtattctatacctatactattatattaacgggctatatctataacagacataactagggcgg

SEQ ID NO: 542661 - DNA, 198 bp, Homo sapiens
gtcacagagggcggctcccaggagaggtgagcaccatccgaacttttgctgattataatggcacaaggggcccctgggaaaccaggcagagcacgtcttaaaggctgagatttcgctgaagggctggagtcagaggtcagagtttagctctttcctggtattggaatcttcattttttcttcttggcttaaaatcata

SEQ ID NO: 542662 - DNA, 1285 bp, Homo sapiens
  misc_feature (405)..(405): n is a, c, g, or t
  misc_feature (407)..(407): n is a, c, g, or t
  misc_feature (423)..(423): n is a, c, g, or t
  misc_feature (493)..(493): n is a, c, g, or t
  misc_feature (688)..(688): n is a, c, g, or t
  misc_feature (729)..(729): n is a, c, g, or t
  misc_feature (762)..(762): n is a, c, g, or t
gcaggtggcagttgaagtatcttatgaattagctcgaaggtaatgtcagatgccagaatgaaggctgtagccagtcgttttgccgatagtgccccttggagcctccacagttatctgatggccatgacagaattaggatgcacgagactgaaggtgagcatatagagagtggtctgcgaaatgtgctctctgttattcaccgttcagcgctgctctgcattgcgtgcatcgtgtctctctcagtgcataacatgtaggtacgtgcccaggggcgagtaagttatagtgatcattgccgcgagtagcgattcacgagtctaggtttacctggatcaaatctcctgaaagaaggaacctgggcggcatttcatgacaagctcatgtcccgcctgtactccaccacgntntagactgcagctgtgngatgtatgcactcttgtgctccatatagggaagtgcggttcaatctcgctcctatacaatgacacagccntcgtactcaagcagaggctgtacaacgtatgtgtgtgcggtcctcgtcgcgcgccacatatgtttgtccatatgtcccctagggcgagccgcgaagtaatgtcgagggcgatccccatgggatctgaacgaacgtgggctcttgtcttcccagcatgcccctgggctttaaaattcgagggagcaacttatcagncgcttccgagctagggcgtgcattgttggcgagctgtgagnatcgctgaacctacgatctggggagcatcgagnaggggcaggcaagttcgttgggacaccaacgaaggaagctagaagctgactcgccagcatccgccgtaatattaccatgttctcgacaagtacactcctggtattcaattgaccaagttggcaaaaaggcttgttggggcgaagcgggtgcccaactaatagtcgaccttttctttaaaagcctttgaggaattctcccaagggagaacccacatattctggcgtcgcacgggcgggggggcgcgcccacttttggttccgcttgtgggaactagcaagccccttggtagagccagcaaattgaggcgaggtcggcgaccagcccgggcctacagcggacgcgggtactggtcaggggacaggcggcggcacaagggtcagcgctgaaagtgttgcgcacgtgggcacaacggcccggtcggggtgaaacgttctcccatgctctggggcctcaacatccagggagagcacgcgcaatacaacagatatgccccaaaggtccccccggcgattgggggcccca

SEQ ID NO: 542663 - DNA, 980 bp, Homo sapiens
  misc_feature (269)..(269): n is a, c, g, or t
  misc_feature (801)..(801): n is a, c, g, or t
taacactcatagtaagatactctgtggtaacatttacagtcatacttggcgcttgggccatcatcctgcatcatataacgttacatagtcacaatgcaagcaaaggaacagcgaatcatggacttcattatgaaatattaaatgctgtatgtgtccattgaaaagcgaatatggactcaagaaaaagtggaataaggatatcccctagtaggaattgtgagatagaaaacataatagtgctgatatatcatttgtactatggtagaagnatgatcatgaacaataagcgttcttataagagctggtaccaataagcgactactgaattaaaaacgttcataactactgattaattgtcataaacagtgggagcataataacgacatcacgtgaagaaatgacctagactcgtatgatatcattctagggtacattgcagaggtatacaatggcatatatagacatgatatctcacctaattgcagtaatactcatctttgcgtggtctccatattaagatattggccttatggctaaaaggcatgaataagtaatgaacagtagttgaataatgagcatattgggtatgaatattcgggagatggcatccagattacattgcttgggcttgaagacgtagctaagtattgggtcgcataccatctattgttgaagtactagatttgaccacttaccctacagatttgaatataagatgacccagaaagctaagacttatttcaccctatgtaaactacacggctccctgatggatataatccacccctggttgatccattnaccccactaaaatgttactcttccggaaatactcgtttaaagggcaatgctctaagccatcattgtttctgatactagcccatattaggtggaaccccctcccattttgcgtccaccgggggacaggggcttacaaacgtcggacactcattaccggtcactacatccgccagttcggg

SEQ ID NO: 542664 - DNA, 440 bp, Homo sapiens
tggctgcgtcgggctgcaggagaagatggcggtctccacagagtcactcatgtggttgcatcagctggtgaagggataggcttgttgcccgggacgccttgctccccctccctgcagcctctccaggtggccagttaggacttcctcacatcccggtggtgtcagggtgttcagaattcttacatgatggttggcttccacaagaacgaaagcagaagttagcattcctcttacaaggacgttaaagttcctcgtaattttcgcttgttggacgaacttgaagaagggacaaacacggactaggcgagggtacagctacgctggggccttgaagaatgactgacagactatgcacacttacaaggtggacaggcagtgacttattgggccaccaaggcacaaattatgacaacagaatatatagcctgcaaagtagactg

SEQ ID NO: 542665 - DNA, 611 bp, Homo sapiens
cctcttctatatacatgtatacgaggatgtgtggctggcagacccaggaagacacaagtgcattttcagcataaagagcaggtgcagttattcccaggacaaagccatttctgccagtgctgttatgcgcctgcaaatgcatgaaaaagcctgggaggccaccagactgtcttgatgctacctcggggcccgggattcaggagctgggctcactgcaggctttgctcacatgtctctagattggatttccacttgctctcagcagaaattacttttagaattaaaagaatggacattgccacttcatatatttctgtcgatttttaattttttttgaaattgtttttccaagagtcctagtctttggtgtcaccgggattttttcacacctcaggtgagtctaagcttcatgggggagggggtgatctaaaacactctttacgccggtttctatggacttggtttactcgtgtgaccgcgttggctgccacgaatttgaccacccctggggttagtatagcttagttaaccttccgtttattcgctaaaggtaaatcactgctgctccccgtgggggtgtggcaggctaagcgtatgagctgcttgctgct

SEQ ID NO: 542666 - DNA, 373 bp, Homo sapiens
ttaagcacatgcaataaaacagtttgagattgtgggatagagtgtggcagggaggttaaaagcatgggctttgtaataagaaatctgattttgggccaggcacggtggctcacgcctgtaatcccaggactttgggaggctgaggcaagaggatcccgaggtcaagagattgagactatcctggccaacatggtgaaaccccgtctttactaaaaatacaaaaactagctgggtgtggtggtgtgcccctttagtcccagctactcgggaggctgaggcaggagaatcccttcaacctgggaggcagaggttgcagtgagccgagatcccgcccctgccctccagcctggtgacagagcaagactccctttca

SEQ ID NO: 542667 - DNA, 332 bp, Homo sapiens
cgggcggatcacttgagctcaggagtttgagaccaacctgggcaacatatcaaaacccacctctacaaaaaatacaataaaaaaaaaattagccaggcatggtggtgcatgcctgtggtcccagctactcaggaggctgaggagggaggatcactggagctcaggaagttgaggctgcagtgagccatgatcgcaccactgcactctagcctgggtgatggagtgaaaccctggcctaccccccaaaatataaaaaataaaaactcacagagcctcagggacttgtgggactataaaaacagatctaacattgttgtcatcagacaatgtat

SEQ ID NO: 542668 - DNA, 315 bp, Homo sapiens
ataactcttctctcccttgtcatagagtattaaaagctcacagcttgtataaatgtaaccattaggagtcagcatataacttggactagtgtaactccttcatgcaataaactagaacaaagaccatgctgtctaatcttgaagtccctcattaaaacaacggtcaagcaataggcgcctggaagatgtcacgcctgaaaccaagcaataccgtcatgttatcagccaagcccagagccctaagattacaaacaactatggctggaacctcctcagctctccctcagcagagttccctaccctaagagaatgaac

SEQ ID NO: 542669 - DNA, 132 bp, Homo sapiens
tagtggcgggctgccaggcaactgtgaggtgtggggtgaggatgaggaagaggacagtccattgggtgtacggggtcagctgcctctcccgtgtacggtcacagaaaggcacgccccccccggccccccgcc

SEQ ID NO: 542670 - DNA, 326 bp, Homo sapiens
tggggatgaagtttcgctcttgtcgcccaggctggaatgcaacagtgtgatctcggctcactgcagcctccgcctcctcctgggttcaagcgattttcctgcctcagcctcccaagtagctgggattacaggcatccacaacaatgcccagctaatttttgtatttttagtagagacggggtttcaccatgttggtcaggctggtctggaactcctgatctcaggtgatctgcccgccttggcctcccaaagtgttgggattataggtgtgaggcaccacgctggccaaaaatttacttttttggaatgctgtcttagtttgggct

SEQ ID NO: 542671 - DNA, 114 bp, Homo sapiens
  misc_feature (15)..(15): n is a, c, g, or t
gtcttgttgacccgnaagtgcatgggaggataagcaccgaagaagccatccggaagggttcatagatggccgcgcgcacagaggctgcaagacaccagcagctatgccaaaaaa

SEQ ID NO: 542672 - DNA, 169 bp, Homo sapiens
ccttacggtaacaggggagcacaaccgttggaagctgcggggctgccattaatgctgggacttcaggccaataggtacgagctgaggcagccccaaaggaggacatattctgcagcgctgttgcaccagtcgcaaccaggtccggagaaaggtctctcttgtggaagaa

SEQ ID NO: 542673 - DNA, 912 bp, Homo sapiens
ctcctccccatgcatggtgtccactgtcgcgccttctgctacatgctgcgctgtgtcactggcggcacatcttcttcgccatttggacacgatatagcatttgatgagctgaaggactgattacaagagtcctatagaccagtgtaataccctgaatccccttgtactcccagagtacctcatccaggcttcttcgtgtgtcaggtgctttgtgcagcagagtggttacactggtctcaagtatgcgccgtcttgcatatcatatttgcaggtatatgagtagaccaggtgatgagtgccccaggactctatgacgtagaagcatcttgaccttgcagatatttctagcaattttgtccgaaggcaggattgggtgcaaaatctagcttgataatcttctagcattttttcaactcacctatatggcatgatctaatgtctggagagctcttagaacaacagcgcgagaagactggcctccagttaaggtgcttgcaaaagagccaccaaaggagcggggttctatccagcaagatcttgtccaggagtagctgtggaatctgagtcaagctagcttagaaaatgacttccttattttcaaactgttgcccccatttttggctggtgggactgactgtttcatatgtcattcctcggctccacgcttcaacatgggaatcacgtaatacattaacatgcgatggttacccctgtgttgacaacttgagtggcctcttaaggggaagccaactcctcgagggcctaaacgcggccgcaacatgaagcgtgggcaagcacgccgctatgggcgtcacagcccatatctgggcacgcgccgcggcgatctctccgagcgggccacggcgatatatcacaagggggccgccctgtgcactctctcaactccctctc

SEQ ID NO: 542674 - DNA, 160 bp, Homo sapiens
acttcacccccaatattttttgggatgtttgtataaaatggaatttaaagttcccttttgattgtttttgaaccccaggggggccccttttttaataaaaaacttttttaatagttaaatgtagggggaaaaaataaaaaaaaaatgggaaaccttgtta

SEQ ID NO: 542675 - DNA, 1166 bp, Homo sapiens
ctgagactgcggcggagcctaactgtgtccctgcagtgcctgctgctgaggaatgtgccaccgaagctcggggacgcgaggagccggcgttgccctggaaagactgccccgatccggacgctgtgtgcagcgcatccaccagctgcatggctgagcgctgcgcagggcttcctgcctgactggatgtgatgtgagtggtggtgctgcgtgagtggtgctcagtggttctggtccccctgccctgctcctggtgccgtgggctgtgttctcgcgcttggctgtgcccttggaggacggagcttgggtcctatggtgttggctgcagaagtcaggattgggcgctggaggatattcctgggggacaacctggtgatcctacacgctatcgacggacaaacagggcgccctcacatgtccactggtacgcgcagtaagacacggaggtggaacgtcgactactttgcgcttgggctatactacgttcgtgccgttaccccgcgcaatggaaatgcgagtgggtgtctgtgtgcccctatgatacctacggcacgggtttacccacagtgacgttgagaaagtgtctacggtgcacacgcctgttacccagtagacgcagtacacataacggagggtgccttccacgccagtccgtgcggttgctccctgtgggcggacaccagcgtttccaccattgcggctggtgggcgaccccagatattacccacgtgtggttatgcgcatcttgtggctcctggcccctggccgaccttacctaatcggtgtgaccgccgatagtgaaatgtacaagaccccacattgagggtgttggaccgcgtgcgattagcgacttacgagatgggggggaatcccggccagaaccaactatagcccactgccaggcaagggggcccccagacgcctgccacataagggttacaccctttgagtggacgcagcgcgtagggagcaccccgttgacatgcttatagcgggcaagctattcaccgactaggccctgtccgcttatacccgcgggacgacggcccgacaagggagctgggccaccctggtgttgagtgtattgaaccgcaccagacgcgtgcgcagttaccatagccacgtgtgccgtggccctttcagggtccgtgagcgggaacgtagggttg

SEQ ID NO: 542676 - DNA, 203 bp, Homo sapiens
cctgcccaatgcagctcgccataccactgcattggcaagaagtgacctggcatcttggcacatcaattgtgtgtcttcaggagaatgtgcagtgtcttgtcaacaactaattataatgcaaattagggctacattgtaatctgctttgttaatgaaactgctaaaacagaatattgacaagctaggacacctgtggttaagac

SEQ ID NO: 542677 - DNA, 119 bp, Homo sapiens
gagagccagcttcaacaaccctacagagcagtgagtatcttttaatgggaatccctgagatagagaaagtcaggctgtgttgacccccttaagcagctagtcctcgggctcctagtctt

SEQ ID NO: 542678 - DNA, 237 bp, Homo sapiens
  misc_feature (28)..(28): n is a, c, g, or t
  misc_feature (52)..(52): n is a, c, g, or t
  misc_feature (58)..(58): n is a, c, g, or t
  misc_feature (129)..(129): n is a, c, g, or t
ccagtggccgcggagcccgtccgtgctncctgcttcttgtcttttctggcgncctggncaccatagccctccggccgggccttaagggccgtcggcagcctacacttgccaaccaaccccacatccctnccggctgtagcaagaactattcgggttctctacttccaacagaaggttgatcattttggatttaatactgtgaaaacttttaatcagcggtacctagtagctgataaa

SEQ ID NO: 542679 - DNA, 146 bp, Homo sapiens
ctcgcttggcgatacgctgttcgagcacaagctctggaatgagtcgctgattgctcaagtgcgatcgggcgagcttgagcctcattactactggcagcttgagcagcagttgctggtgaccggcgctgagaaggtgatcttcgggt

SEQ ID NO: 542680 - DNA, 176 bp, Homo sapiens
ctctcgttgcgtggcgcgtgggggccatcaatttcatcacaacaattatctaatattaaaccccctgccataacccaacgagccacgaagagccacacaatgggccgcgcgaagagccacacaacgagccgcacaaagagccacccaatgagccacccaatgagccacacgatgag

SEQ ID NO: 542681 - DNA, 154 bp, Homo sapiens
ttaaaagcccccccctttttttttaaggagaatggcccagtcctttcccaagtccccccaggggaggtgatagcattgcttttgtgtaaattatgtaaagcaaaatttttttaatcttcgccctaaaccttttttattttgtttttttttgaat

SEQ ID NO: 542682 - DNA, 438 bp, Homo sapiens
  misc_feature (159)..(160): n is a, c, g, or t
  misc_feature (237)..(237): n is a, c, g, or t
  misc_feature (272)..(272): n is a, c, g, or t
  misc_feature (291)..(291): n is a, c, g, or t
  misc_feature (365)..(365): n is a, c, g, or t
  misc_feature (380)..(380): n is a, c, g, or t
  misc_feature (386)..(386): n is a, c, g, or t
  misc_feature (394)..(394): n is a, c, g, or t
  misc_feature (399)..(399): n is a, c, g, or t
  misc_feature (423)..(423): n is a, c, g, or t
  misc_feature (433)..(433): n is a, c, g, or t
gagatggagtcttgctctgtcatgcaggcaggagtgcgatggcatgatctcggctcactgcaacctctgcctcctgggttcaagccattctcctgtcagcctcctgagtagctaggattacaggtgcacaccactaagcccagttaatttttgtatttnnagtagagatgggattttgccatgttggccaggctggtttcaaactcctgacctcaggtgatctacccacctcagccncctaaagtgctgagattataagcatgagccatcgngctcagctgcaggttgtcnacttttttccattacagcctggatcagccagtgttcaccaaagaggtatatataagacacacatacataaatanaccatgcacacacancatatntctataangcccncatatattaaatatttaagccaanagggaatgtntggtt

SEQ ID NO: 542683 - DNA, 99 bp, Homo sapiens
  misc_feature (1)..(1): n is a, c, g, or t
ncatgcagagactgcagtgagccaattactcaccatagccctacagcctgggtgacagagtgaaactccatctcaaaaaatacatacatacatacattt

SEQ ID NO: 542684 - DNA, 360 bp, Homo sapiens
  misc_feature (9)..(9): n is a, c, g, or t
  misc_feature (35)..(35): n is a, c, g, or t
  misc_feature (39)..(39): n is a, c, g, or t
  misc_feature (55)..(55): n is a, c, g, or t
  misc_feature (117)..(117): n is a, c, g, or t
  misc_feature (138)..(138): n is a, c, g, or t
  misc_feature (265)..(265): n is a, c, g, or t
  misc_feature (319)..(319): n is a, c, g, or t
  misc_feature (333)..(333): n is a, c, g, or t
  misc_feature (350)..(350): n is a, c, g, or t
cggaggagnaaaatgccaccagataaatccatggntccncctctggctctcttcngcccaaatgagggcaacagtgccggccacttccctggcaaatctgcagctcaggatagggangcataagaccctctgtttcgntagagagtcaagtaggtcaccaaagccaagctctgtccaaggtgctttggagttgctaaattgaggagtgcatccttgctgtcttgaaccattctgtttgcaatggtgagaccttacataacctagncttgcagggccgccacacaaccctggagtcctagagtttggaggaacctttgtntccagctggacttntcatttttgtcagaatntgtttgagga

SEQ ID NO: 542685 - DNA, 85 bp, Homo sapiens
ccacgcgtcgcccacgcgatcggcgcgtctattatgctgccggggccggcgagccaaagaggagccggccgcgcgggccgggagg

SEQ ID NO: 542686 - DNA, 539 bp, Homo sapiens
gcgagcggtccgcggcggcagaggcagtgtctggcggtcgcgcgtggaggtcggacgctcagagctgctgggcgcaatatctccgcctgctgcttcggcgcggctgtatcggcgagcgagcgagataccgcgagttctcggtggcgctcccccttccttatagtctccacggactggcccctcgtccttgtacttgaccgctcccgtcttacgccgccttctggcgcttttcgttgggccgattgccgaccgctttctactgcttaccatcgaagctctagaaatgaatgtttccatctcttcagagatgaaccagactatgatgcatcattatcacaagagaaattcgtgtctatagctattaaggacttgattacatcatttttaagcctgataggtttggcatcaccattagagctcacacctgccttcaatttaaccacctggcttataccctgacgaagtgcacctttaacactccttggccttgggatacttaagagttccggaatacatttgccaccaccagagtgctttgg

SEQ ID NO: 542687 - DNA, 363 bp, Homo sapiens
cttagtcttccggaggatatggccaacagacaacccaaacaaccaacaaaagagcagagatgctgcaaaaaaaaaaaaaaaaaaacaaaaaaactttttttttttcccccacgtttggcttttttacccaaaaaattttttttttttgtaaaaggtttccgaaaaaaaggtccaaaaaattttctttttttaaaaaaagggcaaccctttttaaaaaaaaaaatttttttttttttaaacctaaactatcctataaactacctaatgggcaaaaatttttttttttttttaaaaagggggggggaaaaaaataaaatttttaaaactttttttatagttaaaaaaaaaaaatttttttttaat

SEQ ID NO: 542688 - DNA, 257 bp, Homo sapiens
gggtaaggtgggatttgggccccttaaatttttctaaaaacggggtttgggtccggggctctaaaaaatcaaaagtttctttttaaaaattttcccaaactttttcccattttaaaaagccctggtaaaaacgttgaactatcccaatgttaaaatggtaaaaatttggaaaaagcaacttcttttctcttcaaatgaaagccaagatttttttggacaatgattaaaaaatggaacttatccagaggaaccccgga

SEQ ID NO: 542689 - DNA, 1109 bp, Homo sapiens
cacagaatatttcaacgaacaacggtgacttgcaccgtctgggctgtgttcctgctgctgcacttgcgggaacacatccacgacacagagattatcctacgatggacacgtaccctcacagacatctcctttcagagcaatgtgctctttcgctgaaggcgagggccagacttctcgaactgctgcgttacgagctagtataggtgggcctgtgtggaacgaaagatggggcgccctgaccaggcggtcccacacagcaggcttgccactcaaagcgtcagcgaggcctcccgcctggagcccgccgtccctcgagcgggaggtcgatgtcgcggcgccaatctgtctgggcttcagatgcttggcggcgttcatggcgagaccgtccgcatcttgcctcccgcagcccaggttgcttggttggtcgctcgattactcatccgtctgtggctcaagaccagggactcacccgtgtgcacagcaggtgcataggaatggatgttcctgcatgacattgaggctcgaccgcttgcctagtcaatgagggagaaccccgtgccgtggctgccccttcttaatgcctaagcagtgctgcttgccgtcctgtcaagggtcacgccatcgtctagcactgaacgtcttggcgccaacatggcagacggttggataccccctacagggttgccaggcaaggccttggcggaggaatgcagcatagcatgaggaccagcgaagttgcaattggacggtatcatgaaaagggacacaaaccctcgttctggttacccggaaacctgcaggatgcagacaactgtgggaaagagccgcttgtctttacttattgcttgtcaaacaaggagactcgagtccggggcaaggggagcctggaccaggctcttaggacgggccttcaaccctaaagcatcagttaaacccagtaatgggcgattgatgacgcgtggacaaaccagcgccttcagaacaggaaaagtcgggaacgcacttgtcagcagctggattggaggctcttgtcgccagttgctttgacattggcccaatgaagccgggctggtatgaatctgaaaatgaacttctgttcccggaacacc

SEQ ID NO: 542690 - DNA, 1250 bp, Homo sapiens
agtagcagccaaacttgcaggttgccccgatttctgatcatcattgcaatcaagtcacctgacacactctgctgcacgcacacctactcttactgcacggcacacactgctcctactgtacacgctgacacgtgctgcatgagacacagctgcaacacgtgcttttcttgtccgctggtaacactccatttggatgcatgcaagcaatcaaggtggtcggctacgtgccaagttcacgacaaagggcatcagagtatcttccaccagctggacaattatcatgagctgcgcttgtaccacgcaaacttacacaatacaacgttgagtcgcacccagaagcatacacagcgttgcccaacagctggcctgcgctaatcctaggctgtgctcgcacggcctctgacacgcagctgcgcagagcaacctctctaacgccttgctctactactgcacctctgcgccacgcactccaaccatagcaatgcatgccagctctgcgctgcatttccctgttgtctgtctgctctgactgcctgtgcctcttgattctccaagtgaacactgcaaagattgcgacacgactgggcaaacacactacgtcagcagccaagatacattctatacttcgacgtgctcgcgcagatactcctcggacgtcctatctcaaaccactttcagactaggcgcactgcacacgtcacagccacagcacatactcgctgcgcaacattcaactactcacgactccagcaagtcttccatcttctctcccaacggcttgggctcgcacttattgcgcaattagggtacgcacccacctctcctctccacccgcggctacagctctcccctgccacctcgacttgccgcactcatctcgcacaccacacaccactcgcctccagcgactccctcgcctctctagcactagggcaaagaaaccctctctccaggctcaaccagacggctaaatttcgcaaccttgtacaacacatccaccaggaactaaaatctcggaaggagcgcaaatctaactaaacccaagacctctaatctcggtcacaaacacctccactcgtcgcgcgccctgctctagcgctctttccacctaacaccattcgctacgcgctactaagctcttattataagtcgctaatttcctcatcatatatgcactcgacatatacgagctacgatgctcacgcgagaatcaccactctctaagcgactatagagagcgactcccactc

SEQ ID NO: 542691 - DNA, 419 bp, Homo sapiens
  misc_feature (236)..(236): n is a, c, g, or t
  misc_feature (257)..(257): n is a, c, g, or t
  misc_feature (277)..(277): n is a, c, g, or t
tgtattaggttattcttgaagtactataaagaaatatgtgagactgggtaatttataaagaagaggtttaattggcttatagttttgtaggttgtataggaagcatggtgctaacatttgattagcttgtagggaggtgttaggaagcttccaaccattgtggaaggcaaaaggggaataagtattttacatggcaggagcaagggtaaagagagggggagggaggtgccacacanttaaccagattttgtgagtantcaggttttgtgagggttgnttgaggttagggataccccatttaccctgatgtgttcatatacatttcatgactgtatcaaaatatttcatgtacccccataaacatatacacctatttgtacccacaaaaatttaaaaataatttcaatgtttgaagaaaa

SEQ ID NO: 542692 - DNA, 109 bp, Homo sapiens
ttatacctgggagaaaatcatcaagaagggatgcatgatgtttgcccaaaatttccaaaatccgaaaatcttttttgcttaaaaaaaagagtaaagttttgaaagggta

SEQ ID NO: 542693 - DNA, 194 bp, Homo sapiens
cgtgctgtgtcatgactacggggcattgagtcagctcccccaagatgagctgatgccccagagagagctctgaacgtcaccaagtaaccagtgcccatgctccatggccccaattctgccaggctctaccccgctctggatcctgcacttctaacgctcgactctgctgctcatgggaagaacagaattgctcc

SEQ ID NO: 542694 - DNA, 1998 bp, Homo sapiens
gcggcgcagcgcggcagctcctgcatggcccggcatgggttaccgctgctgcccctgctttcgctcctggctcggcgcgtggctcaacgctaggacacactggacaggctactagcatggtccaacctgcacgggctgcgcgcagcattcctgcactggcgcaacaaacttctccagcaccagccagcagcactgcgtgcaacggcgcctgtgccgcgcgcaaggcgcgacagctgacacaccccctcttgccacctccgcacactacttctcccctgctcaaccccaacccacacccgacttttccacgcgccactttctccgctccacgcggccaccaacacaacgctactcgggcaccaccacagccctgcagccactgatccttgcgcacctgcgcacggcctctcccgcctcccttctcggcaggcggaccctccccgcctcctccctgcactgcacgccccttgtacgcacacccccacccacgccccacccctcacgcccccatcacctgccccgccctctcgcctatccttcctgcccttgggcccttctcccaacccctgcgcccccccccgccgcaccctttcctctgcgccctccgcctcccgctctcccttgcccctccgggcctcccccctggccgccctctcccgtgcgcggccctcctcccctgcgacgccaacgcctcaggcccaccccttgatgcgcgcgtcaccacttcccccctagcgcttgtctctcaccgcccctcgtgcttgccaacgcgccctcgcgcgccaccttgcgaccgcgcctccgccgctctgcgccccttcatacactttgtgctgtcgccctcttctgcgcgcgaccgcgtcgcgccgtccaccacgcagcacgtcgcgtgacctcccctctgccccacgcctcacactccggcgcgccactggcgcgcaactcctgtcacggccttgccgcctcgtaccggtccttccgtcgtgcccccgcgccggccgcctgcacacctccgtggcgcgtcgccctcacggccaccacgccccgccgcctcccacgccgaccgtctctcaactgcgcgccccaccttcgtgtcgcgctcagtgccacccgctcttgcgccgcctcttcgccacctccctccacctaccgccctccggcgtgccaccgccgcctcctccacctcgtctgctgcgctctccgctcgctccaaccacccgcgttcttcgccccgctccgcggctgccacccataccacacccctcccctgcccccccaactcccctcactctcccccactcgtcccatcccttcacatccaccccccacgacccgtcacctctcctccttctctccactcccctccaccccacaccacgaacacacccacattaccagcgccccactccatcaacataacccccctcctcctcgccaccgccaaaccgactcattctcacacatcctctcagccaccccgcgcctcttcccctcatccgtccatcaccatcccaccatccacactcacatcccgaccactcaacacttcatcccacccatctaccactacgcaccaccacccacactctcacctcccaccatctacaacccacaccgccctctcacacttccctcctctaccacacacaccacacacgcccctcgacctcactccatcccagacatacactcaaacctcaccaccaagcttcactcgccactctcagccaccctcctcctctcctcccacctcccccctcccccctcttcctccactccgcccacaccacctaccaccacctccctctcacccacccacccccctcctcccaccactccctccgccccttccatcgcagccctccagcccacctactcacctctaaaacactctcccccaccactcacccccaccacctccctccaccatcctcttcctccaccctacctcccacaccctcacctctctctccactccactcctacactcccaaccct

SEQ ID NO: 542695 - DNA, 449 bp, Homo sapiens
  misc_feature (2)..(2): n is a, c, g, or t
anttcgggcacagacgaaatagacccatataaatatagtcaactcatcttctgagaagattcaaaggcaccacaatgcagaaaatggtcccacaatggtgctgggacaactagatgtccgcatgtgcaaaagaaatcaaacagaccctacaccctaaacagaaattaatgaaaaggagctgggcgcggtggctcatgctgtagtcccagcactttgggaagccaaggcaggtggatcacttgaggtcaggagttcgagaccagcctggccaacatggtgaaaccctgtctctactaaaaatacaagattagctgggcatgatggcgagcacctgtgatcccagctgctcgggaggctgaggcgggggagttgcttgaacctgggaggcggaggttgagacaagatcacgccactgcactccagcctgggtgacagggtgagattctgtc

SEQ ID NO: 542696 - DNA, 314 bp, Homo sapiens
cctgggatttaggggacttaaaattactaaaaaaaacggtttttttcccaaacaggaaaagggccgggattatttttaatggggccaaaggagggaagactgaaaagggttttaaaatttggaacgggagtcaaaaaaaggcatttttggcattttttaaaccaggaatttacattttttccgggaaagggaaaaaaatgaaatgggcggggcaaagcttttggaaaaaaaaacaaagttttaaaaaaagggaaaggttttttggcccaactgggaaaattttaattaaaaaattcccccatttttcaacccca

SEQ ID NO: 542697 - DNA, 360 bp, Homo sapiens
tgcaggaattcggcccaagggtcattctctagaacaccagatgcacaagctgaaagggggcgacagagcatatgtgacctcatacatgcgcctgaacctaacattatgaactataaattttttgagcctgcccacagaccagatgttatcatcttctgaacagcatttaccgaaacctgctgcaatgacggaagtggaacaactggattggctgagagatccaattcagaacgtaggctaggtcagccgatttggatgccatcaacactccttttacctaatcatgagccagatgcctaagaaggcatttcaacaggatcctgaggaccagcggttgcccatgtctagactgcgctgctg

SEQ ID NO: 542698 - DNA, 81 bp, Homo sapiens
ggctcgaaattcaaagcttcttaaccgatgtacggggacaatgtaccatcaataaagtaccctgtgctcaatcaaaaaaaa

SEQ ID NO: 542699 - DNA, 390 bp, Homo sapiens
tggtatccatgagagagagtgagtgtagagtgaggatcagagcggtgagaggctggcgggagttgggggcctggaggctggggcctggttacttggtgacgtgcagagctctctctggggggctgcagctcatcttggggggagctggactcagatgcccccgtaggtgcaaaagcaacatccacatctcactcctcccggtgcttttttgcggtattcctgcagcgctttctccgccacggtctccataaatttagggttcttcctggagacttctacagggaccgtcacagtgatggggcgcaaggcttttacaatcaagaacaccgcagtaagaccggaaggaacgtgcgagtcaaaagtcgagggaagccacgatgatacccgcag

SEQ ID NO: 542700 - DNA, 411 bp, Homo sapiens
tcagaagcatgtctgtagttgccacgagcagcagaaacgagggccagagagccggatccagagcggtgagaggctggcgggagttgggggcctggaggctggggcctggttacttggtgacgtgcagagctctctctggggggctgcagctcatcttggggggagctggactcagatgcccccgtaggtgcaaaagcaacatccacatctcactcctcccggtgcttttttgcggtattcctgcagcgctttctccgccacggtctccataaatttagggttcttcctggagacttctacagggaccgtcacagtgatggggcgcaaggcttttacaatcaagaacaccgcagtaagaccggaaggaacgtgcgagtcaaaagtcgagggaagccacgatgatacccgcag

SEQ ID NO: 542701 - DNA, 161 bp, Homo sapiens
  misc_feature (25)..(25): n is a, c, g, or t
tcgacggtaccaacactgacaacgngcttagcacaaaccaaaaggctctgctagagctcagaggcagcacgagattgggagagctggatgacggtttgctaagagaatttaaggtcggtacagtcctcctgtgtatccctttggattcctgttatgctgtt

SEQ ID NO: 542702 - DNA, 651 bp, Homo sapiens
  misc_feature (540)..(540): n is a, c, g, or t
cacgaggagattttgatgcacccatcacccagatagtgtacattgtacccaatatgtgattttcttatcccacaccctcacactcttcccccttagatatctccaaaatccattatatcactctatatgtctttacattctcatagcttacctcccacttacaggtgagaacacaaggtaatttgatcttccattcctgacttacttcacttataataatggcctccaactccatcctaattactacaaatgacattattctatttctctttatggctaagtaattctccacagtgtatacataccacattttctatatctactcattggttgattggtgcttcaattcattctatatctttacatttgtgaatgtgactaaaataaacatatatgtgcatttatatttttcatataatgacttcttctcctttagacacatacccaggtatgggattgctggatcacatatacatctacttttgattctttaacgaatctccatactatttcccatatacattatacattcccacctancactatatacaccatccctgttcaccacatgcacaccaacatctatgacttgttatatatttagatacacttcaccactgatactatattcttaacttttcttccgtgttt

SEQ ID NO: 542703 - DNA, 115 bp, Homo sapiens
gacaggcagcaatgcaagggagaagtgaatcagtcagcttcagcacgggaggtggacagggacaggcttcaaggagcattgattcctttgcattcatggggagggacaatttggg

SEQ ID NO: 542704 - DNA, 1672 bp, Homo sapiens
gagggattggtccgcgaaactgggacgtggccggaaaatacccagacagactccaatgtgcctaggcattgcggggaacccatttgctccagaagctccacaggtgatctacataggagttgccacgtatatctcgcacttgcccccactcgcggagaatcacgctgacctgctcaactcgcatgagtctttgatgaggcaaccataccctcgtgttcgtggccagcgagcatcgtctaacggagcgaagggtcgagccccgctgatgggtgtaacccgtgatagtgctggcctgctcgcccgcccggctaatgaagcacttgtacacttcatcgagcgtgatggctaagcaagacacagcagctctactatagtgcgcgcaacctggtatggacgctcaggggactgctaaccgtactagtagagcccgcgccaggcggtacagtactccaaggcacaaagaccagggagcgtacgaaacaagtggcctcggaaacaagggggaccccccgcattggacagagccccgaaacaaccatcgaaacgacccatcgacgcgtcccctgaagaacgcatacttcgcgccgcgggaccacggggcgccctcatctcccgtcggcgccccctttcgccccaatacctcttgcgactgcgccaatgctcgggcttgccccaaccaccctgcacatccacgcatcggtggtacacgaacagctactgcgccctactggctacgcccttacaacccaataacccgcggcccaccctggcgggaaccggccccgtgacaggatccacgcgggcgcaactttggtccccctccaagcttccacgaataacacaacacgcccactctcttgcgcgggccccattggctcaccctggcaacaaacccttacaaacacacttacgcggccccaccggcaatcttgaatcttggtaaggtcaccactgaacttaacgcccacaagaacggaaagcgacgccaaatggacctccccggacccctggatttgccctggccctgtttccacacggtccttgccctgattgatcaccgcgcgggccccccccgccgccgccgccgccacccctatcgcccccacccccctccgcggccgcctccatccctcgcgtcgcgccctccctcgccccccctcccgttcgcccccctccgcggctcatcctccgcggccccctccacccacccgtccccgcacaaccgaccccacacaccacacacacccgtcccccaccccacaaccaccactgacccacaccactccctccacacacccccccactcccccccaccccgacatctccccccccacccctcctctactcctcttctctctcacccaccaccctaccaccaacaccacaccacacccactacctgccacccaccaaccacacccctcacctctcccaccaccacacacccacacctacaaccccccaccaccacccctagcaaccccctaccctcctcccacacccgaccctcctctacccatcacacaatacccacacccaccacacaccactcactaccacacactccacctctaccccccatcctctcctcctcttcctctcgtccttcttctcctcgttcctcctccctccactcctcctctcccactctcacccacacccacccccccgc

SEQ ID NO: 542705 - DNA, 371 bp, Homo sapiens
tatacgctcagccaagcagcagatggtgcgacaaccatgactataggaaggactggggaagaagagaaagggagcctggcaaatctgagcttagggagtggttctggagactcgttgagcattactccatctgctacccgaggcttccatagagctccaagccactggctagcttgagaggaaggacgatggtcaaggtacatgtctcttctcctctgactctgggaatgagatttttctactcccacaggcgtagaacgctccttataggagtgtctccacatgccaaaatcagaggaagtcagaataaaccctcccaaggctgaaaactagagctggcacgtagtacatggtcagtaaatgtgtatagg

SEQ ID NO: 542706 - DNA, 471 bp, Homo sapiens
atcatggtgtcagctcaccataagctataaagctttacagaatgctttacaccacctaaccttatgagaatagcactacttttaaagttttagtgacatttatgtttatacaatactagaacaccttgcaacagctgcagatgaacaccatagatggctgggtacctgatgctcgaaatatcgtaaatacataggtacataagctaagtttaccagtgaagatacatagaaataaacgacgtatcaactaaaaaataactaaaaaacagaagaatagctaaacatatacaagacagacaaacctttttcacctgcacaacaacaaacgctaacacactaccagacaacactagaagtatttacgaccaatagtatatattgacaataatataccaaactctctaaacaaatataaaactcccattcacaatatatattaatcaacccaagactcatacttgccaatcccac

SEQ ID NO: 542707 - DNA, 368 bp, Homo sapiens
  misc_feature (101)..(101): n is a, c, g, or t
  misc_feature (107)..(107): n is a, c, g, or t
  misc_feature (117)..(117): n is a, c, g, or t
  misc_feature (141)..(141): n is a, c, g, or t
  misc_feature (146)..(146): n is a, c, g, or t
  misc_feature (206)..(207): n is a, c, g, or t
  misc_feature (233)..(233): n is a, c, g, or t
  misc_feature (242)..(242): n is a, c, g, or t
  misc_feature (295)..(296): n is a, c, g, or t
  misc_feature (301)..(301): n is a, c, g, or t
tgagggagggggctgcaggtcaggtaagatttggaagacaaacgtacagcttggagggcagggggactttaaggcaaggagatttacagttgggaaggagncagtgncaaaggggtnagggacaggggcccttaagtccancaagnaaagctcggtgtgggcccgctttacgctccgtttggggtgacctggaacgccttttttcnnagctccctccagccatcagcagcctnttgtcaagnttttgcctcgccccagtttatccccaaccccaaatcaagacccccttttttcnnggtcnctatttattttttgttcctttttctttttgtaagaaacattcccaaaaaccagtgcaaaaccctcca

SEQ ID NO: 542708 - DNA, 149 bp, Homo sapiens
  misc_feature (1)..(1): n is a, c, g, or t
ntcaggttgtcagcatgtctcgagaatctcagcacatacccactgctgagggtgcatcagtgatcaaacacggtatgaggagatcaggatggagctaagccctgacactcatactcaggctgcttgggcctggaaaaagtacctggtac

SEQ ID NO: 542709 - DNA, 128 bp, Homo sapiens
caggtactcagaatggttagcgctttcaaataatgacgtaggcttttttataataaagcgttaaaacaactaggtgtttggacacctggtaatagaattgttcactcttataaagaaggttgggaaag

SEQ ID NO: 542710 - DNA, 128 bp, Homo sapiens
ccccgttctatgccggaaactacacaggttcacactaggactacacatggactacacaggagctacacaggactacacaggactacaccggactatgcaggaacacacaggagctatacaggagctac

SEQ ID NO: 542711 - DNA, 277 bp, Homo sapiens
agcgacaattatgacgccattatagtgccactattgctcggccgtgagcccggaagctacacgaccaagaaatatttcttacaggcccggcagcgctggcgaagtatgtgccaccagtgcgtccaaggttccgctttcattggtttccacgcgtttgctcagcagtagctcttcagcaccgagtgggtctcgggtggactgctgctcttcgatgatgttcagggtggcgtcggaaggatcgttcttgtccgcctgacgctgtgccagccaagcgcgt

SEQ ID NO: 542712 - DNA, 861 bp, Homo sapiens
gcctgacgcggagacgcaatcgagccgagctgagttcgctcgagcacacgcggttaccgtacgggctgggtctatggtcgctccgcgtcgccgctccaccgggatgcgtagccttttatgactcatgggtcgaagcttgtggttccaatggcagggggaacttctgggcggaggagctccggcactagttattccaagcagtctacggctgaactagtcgttaaagttatagaacgaagcaagtgttatatgcacacgtgccgtacggctactagtttcaccgagatgtctagtgccaaggtaattctccttgaaaacgctatatgatcctagttattaataggcatccgtacatttgtgttgtgttggataggccatccagaagtacgaacgcgaatttgggacgtacgttgccaagactaccaacgatctcgacttcgctgcatcgctaactgctggtcactaaaacagaagcgtaagtctattttgcagtactagcgcgttttcactatagatgggacatttgttcgctggacataagtgacttgacattcactcattacttaacgtaaatggttgcacagtaacttgagtctggtagatgaaaactaccatgcgtaatactgtgggaccatggaatcaaggtttggtgcttggattacgcattacaaagggcaccgcttctgaggcattcagtgggcaactggctgggctcgtggggccacattgggacgggccaaaaggaagcgcacacaatggtacggtccaaagtcggcattttgcccaatagcgccgcgaataatggtcgataattgaagacccctgagcccgcgacaatcggacaatacttgatgacccata

SEQ ID NO: 542713 - DNA, 140 bp, Homo sapiens
ggtatgtcacatcttgtcccactgaagaggcttccagggcactcaccatggagccgtcttctcctatgataacaatgcattcttctgcaatagtccctgaaggacctgcttgaagcggttttaaagttatctttttaaaa

SEQ ID NO: 542714 - DNA, 342 bp, Homo sapiens
aaagcttttttgggcataaccccctgctttggggagggtttggggcgatttttgcctgcttactcgggaaatttgcttttgccaaacccgctttttgggggataccgggcccccctccttactttgggtggttttgggagccccaaccggctccgcccgctttggcggtttggatttattgccctcgtcctccgactcgctgacagggtacaggaccccccacaaccccaatccccgttttggatgccctgagaccccgccattcctcggtatttattgtttgtccccccctaggacccccccccccgaccctcgggaataaaaggccctccatttgcccca

SEQ ID NO: 542715 - DNA, 308 bp, Homo sapiens
gagctcctgggctcaggcagtctgcctgccttggcttcccagtgctgggattacaggcgtgagccaccgtgcccggctaaaaagtatttttaagttctgcatattgcttatttcacttaacactatattagagattgttttaaatcaaaacaaaaaaaaagctttattttgttgcacattgccaattttcccaacaaagataattacaggggcctttaaaccattttgcttttatttttagacaaaatttaaggaaacaagtggatgttttgtggttaaagctattaaaacagtggtttttgaccaga

SEQ ID NO: 542716 - DNA, 389 bp, Homo sapiens
ctagtagcaggctgttttagagccatctaatattacatcttgtaggttctcatccttagtgtgactttctattttcagatgcgtgtggagtagacccggatgatgaacaaatatactcccagggagtctctaagtatggagtgatgagagctattagatctacttgacactatcttgtaccttgcttagaactaagttactgtgagggattatagagacggtttgtcatttattccactgataagtttctgttacttattttgacattgcatttttagtaaggaaacagtgatagtcttctacagaagtagttctttcgatatttgattcttttactttggtgaagtggcttattcatctcaatttgtatgtcagttttataatacaaa

SEQ ID NO: 542717 - DNA, 218 bp, Homo sapiens
ctgcaccattgactgtccttcctcaagtccaaaggcccatgacatcctcatgcccagctgcatgaccgagtgggctaccagatgtcttactgtttaccaaagctctccaagcggactcagacgttagcttcctgggcctagtgtagactgttcagcaccagggacgatgagggtttaataaggatttacggggcagctggtacccaacagactggtgt

SEQ ID NO: 542718 - DNA, 994 bp, Homo sapiens
  misc_feature (994)..(994): n is a, c, g, or t
ggcaacgctatggatcccataaggacctatacatcctcatgagccacactagtggctctgcagccgaggcctttgctcacactatgcaggacctacagcgggccaccgttataggagagcccacagctggaggggcactctccgtgggcatctaccaggtgggcaacagccccttatatgcctccatgcctactcagatggccctgagtgccagcaccggtgaggcctgggacttggctggtgtggaacctgacatcactgtgcccatgagtgaggccctttccacagcccaggacatagtggtcctgcgtgctaaggtgcccactgttctgcagacagctgggaaactagtggctgataactatgcatcccctgaattgggggccaagatggctgccaagctaagcggtctgcagagccgctatgcaagggtgacttcagaaggggccttggctgagatgctgggggcagatctgcaaatactctctggggacccacacctgaagacagcacacattccagaggatgccaaagaccgaattcctggaatcgtgcctatgcagattccctccccagaagtctttgaagacctgatcaagttttccttccacacaaatgtccttgaggacaacattggctacttgagattcgacatgttcggggcactgggagcttggttaccagtctcgagctgttgggagaacacctcttggaccaagactgtgccactgatggcctgatcatcgacattgaggtcaacctgggggcccactctcaatcagcttgtggctaattttgaagaggcccccctttgtgggacgcttcaccgcccagatcggcggaattggccacacccagggagaattgccaaaaggaccgcaggggacaggcgcaaaaaacaaaaaggggccgcgacaaaggtggacacagagaagacaccaccgggagaaagagggagatcacaacacgagtcacgccgggcgctcacacggcn

SEQ ID NO: 542719 - DNA, 253 bp, Homo sapiens
gtcggggacatttctttgaactcgtcgtttcatgatctgtgatgatgccgagaacaatacgctaccgttctctgaacgttcgaagaatcataagaggtaagatagagtaaagctccggaggctctaactgtcacgcgggatcggagttttgtcctcttggcgcccaggatttcagagttcaaggctgaggccgcgccggctctcatgtcatcgggcaagggcctcttcccctcctgactcccgcgatacagcg

SEQ ID NO: 542720 - DNA, 822 bp, Homo sapiens
  misc_feature (391)..(391): n is a, c, g, or t
  misc_feature (479)..(479): n is a, c, g, or t
  misc_feature (484)..(484): n is a, c, g, or t
  misc_feature (486)..(486): n is a, c, g, or t
  misc_feature (553)..(553): n is a, c, g, or t
  misc_feature (572)..(572): n is a, c, g, or t
  misc_feature (582)..(582): n is a, c, g, or t
  misc_feature (592)..(593): n is a, c, g, or t
  misc_feature (596)..(596): n is a, c, g, or t
  misc_feature (612)..(612): n is a, c, g, or t
  misc_feature (624)..(624): n is a, c, g, or t
  misc_feature (746)..(746): n is a, c, g, or t
  misc_feature (786)..(786): n is a, c, g, or t
tggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaanaggaagattaatgcaggtgttatagaagccagaagagaaactgtgtcaccctaaagaagcatataatcatagcattaaaaatgcacanattantncaggtggaaggtggcaattgctttctgatatcagctcgtttgatttagtgcaaaatgttttcaagantatttaatggatgtaaaanagcctatttntacattatannaantgagaaaaaaatggtnggtaaagtgttntttaataataaataataagaaatggtaaaatttgaaggaaaagtgaagaatatgagtgttaaagggaaaaaaatgatggaagtaaattgtaaaaaggtatgggagaaaatgaattgatgggntgtttatgaaaaaggttttgtttgtgaaataaagttatanaaatttataatgaggattaaaattaatataatataa

SEQ ID NO: 542721 - DNA, 119 bp, Homo sapiens
cgcaggagtatgcagacccatgagtggactgctgcacagaaggacaggaagtgacggggctttccagccccccagcagtgtccagcccttgtgatgaagctaggaaaaccccatgaatc

SEQ ID NO: 542722 - DNA, 203 bp, Homo sapiens
  misc_feature (178)..(178): n is a, c, g, or t
accacgccaccggagaagggggctatgtaaattgcttcgcacttcacccatgaggcaagcgctccgaaggtgcaagctatcattgccttggcgtctttagacttacgcattttcttgggctgcctcttcggcctttgagaccttcctgtagcaatatatctctcgatgagcagccacnagtgagccttctccggtggcgtggt

SEQ ID NO: 542723 - DNA, 183 bp, Homo sapiens
gggattttttttttcattaccccccctccgcaaaccccagaccccctccctttttttttggattgtttgcccttttggggggggggccctccccttttcccctgcctgttcctccatgttgtgaggtgttttggcagttttttttttttgtgtagtcaggggaaaaccaaaaaaaaatgccca

SEQ ID NO: 542724 - DNA, 1441 bp, Homo sapiens
gaggcattgaggcagccagctgcaggggcttctgctgcagggggcaggctggagcttgaggaaaccgcagataagttttttctcatttgaaagatcagagcattaatacaactacttcaaacaaatcatcggtcgaataaggttcactcaagcatattggcttcagcgttcaagtttttaacggtcaattattaatcagcttcaagcattttcaagcagcaaaatcatgcacagcacttcagcaagaagtcagccatgcagagcaaggcaaacaagcatcaacacagggtttctaaaaaagcatgcacgggcagggtagcagcatgcacagctctctttccaacggggatgtaacaaaaattggtatttcaacaaatgacacaatatggaagcagcaaaagggcacatacacaggaagacccacggaaatatcaagtaccagaataaggaaagggtgcaaattggctgttcatagcatttcactaattggcaagggatgcactttcaaaaaccaggtctttagacaggtaaatcagatttataaacaaagttttagatacagggataggaatattaaaacatccaaagtctgtggcaatgaggcggacatctttcttataaaaacagaagaagccaggcattttgacacacgcgggcgacaggtgatgcatctaagcaaaagagacgctattggcaaaacatttcacccttgggcaccggacccagcgtgaccacgcacaactgtgtggccagattcccagttctctaaacacacggcccccttcagtgcatacacagcggtcgacctctactaccctaacacaacacggtgaccaagcactagaaaacaacaatgggggcacacatcgcatttcaacatcggggaggcagcctggaggaaagaggcactagcaaccagccacaagtgtaggcgcccaggacaagagacacaacagaaagagactatgcggcacacggcgctgggcgaacagacagaacggttgggtaccagccaaccccgccaagcctaaccgcgggaacaccagggctcgacaagcgcaacaacagcgacacactaccgcgcgagcaaaacacgccattagcggagcgaacaccaatcatacagacaacatggcacactaaacacacaaccagcactatcaagtccgtcataacggcaacctgcaacagaagcaacggacatattagaattcgtacacgcacgaggaaacaccaacgatcagaacaaaccgaccagcacacgaaaacaccaagcagcaccacagatacacaacgacgcacacaacacgaccaccaagcccacagggccgccacacacccggcaaccacaccaactcacagagcacaccaacacaagctggaccgaccactagacacgaccagaagacacacacacaaaagacaaagaatacaagacgca

SEQ ID NO: 542725 - DNA, 1068 bp, Homo sapiens
gaagacaaaaaaaaaaataagcgtaacttccctcaagagcaacaacccccccccccaccccttcgcccgttgcctccctcggcccagccagtgtgtgtgccgggcgtttggctgggcttgccctgtgcgcccgggcccttccaagccaagcctttcttgccgggccctgtgccgctgaatggaaggtgccccaagccgggagcccggcgcctaggcttcggctcttcagtccaagcagagggggtgtgtgggggtggcgacccagagggttccggggcccagacctctccgcgggccttcctgtgcgtgggaatcttccaagtggccttcctgtgggggttccccggtgtgacggcgcggtgccagctttcacatcgcgcgcggttcaaaccaaccacttcagaccccgagaacccaatgacccaggaacacttctgcccgaggccttgcggcagagtcgggaaaaccccccaaagagcatttcaaagggctgagcggacaccctgtgcgtcatctccccgcaaagcgcggtaaaggccgacccgtggaagcggccaccctatatctcgcgcgtgtctctctcaaacgggggacattcccgagaaaattccctccccgtgtgtccgcctcgtgaaaattccctcccgacacattcttccgtaaagtgcgaggttacatcgtggcattgagcactttccccccacaagcccctatatgtggggacccccccctaaaaaatgttgcgcgagagacggcaaacaaccgctgtaggacaacaagggcacaacactcaacagggcaaccctcaatgcccgcggagaaactcattttcacatcacacgagaaagaaaagttctggcccatctaatacaacgcgctttcacaggctcattatcgcccccgcgatgaagcgccttagctgtggggcccacaatggccccagggtgccatatcggggaaaaaattttaaccaaaatctttccccaagtggtgagcctcgatatggctccccggagctggaaacaccaacccatatggggtgggacaacatgtatacacctctcgaca

SEQ ID NO: 542726 - DNA, 1438 bp, Homo sapiens
  misc_feature (230)..(230): n is a, c, g, or t
  misc_feature (262)..(262): n is a, c, g, or t
ggttgatcatagaggacaccgaatagccctgaattcataacaggcaatagaagtcgagcgacgtggagcgtacccacaaagtgtgctcaacagtgtgtcaccgacagtatgcggcatgagtattgactcgtgacactgaccgtaccttcaccgtgttcagcctagactatggtatgcgcgcgcatgacgggttgagccttgttgagcgttgatccaaactgacgacaggncgaacaggtgggacgggctaggctggagaggnaccctaagagctgatttgaagtggtcgcttgagttgatgcacgaagagaatttacatgctgcacccgacgagatagtcccagcaaggaatgggctcggaagagggaattccttgagaagcaatgtgcgacaccttttcggtcaagcgcagttgtcgcgagttgtatgcaattcgcagaggcgccgagagatgctgacagaggaaccatatgaagctaataacagtcggtagggaatttgggcttgtaacgcattcgtaaggttcgggaagaaggaagtattctcaaagaaagcgcgccttatctaagcagaggaattaacgagacacataggggagcacggaagagattgaatcgaaaaacggaacggaagtggattatcgaacaaaaaaactttatcattggaaggacctaggtctgggggtaaaaccgcaaataagtcaaattttagtggatcccagagaatgtggggctttctgttgacatggaattgaaaggacgaagagagttctacggttttatcttttagttatctaggtgaaagcttacaacctttgggccgatgtcaggggatttcagacagatggccggtacatcgaagcgtaacccgtggaagaacctgtgtagagccttggcacttgaggccggatgtccaaggcacaaccaaagtcgccaagaggtgcccgtgggaagtcagggtactcccctaggggtatctccctctagaggaaggctactctaagcccagggctccaggagcgacacaaggacatgggagagggcctttttagacctcgaggttaccccctgagtaacccacagtggaccgaagttccttccaaattagtgggccaagaacacaagcatcaaacgcggcacttcaacgcacgaaattggtcgtaggcgcgcaattctcagaaagtgcgacgggaggtttcaaagggaacaacgcttcgccaaagaatcccctaggataaaaacgccaaattggtttgaaaattttaagccacggcgcacgcgggcaacaacactcaaatggaacttgaaaatgcacgtccctgcaagagatacatggcccgccaacaactgcgcgacatacccacgactttaatatgagcacaaagtgacgctccgaggcacagtttgcgtctagctacacggggctagtgacacacttg

SEQ ID NO: 542727 - DNA, 490 bp, Homo sapiens
  misc_feature (361)..(361): n is a, c, g, or t
  misc_feature (388)..(388): n is a, c, g, or t
tgaaagtattctagaggatcttagtctatacaccatgatcatcaaggatggtttccaggcgaggcttatccattgcactccggatgtgctgacccctgcgatttccccaaatgtgggaaactcgactgcataatttgtggtagtatagataggtcagtatagataggtcagtatagataggtcagtatagataagtcagtatagataggtcagtatagataggtcagtatagataggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 542728 - DNA, 466 bp, Homo sapiens
aaaacaaaaataataaaaatgtgacaactacagagagattgacaaaattctgaaactagcgaggtaaacaaaaatataaacaccatagaaaacatataaaataaattaaacctatctattctcttccccgagattaacagcaaatacagaaagttctcttagaagtgggtctgatgctgcagagccctcagacttcagcactagatgagatggagaccgtgggtagggacggagttgctttgctaattactcgagtgcaggtttggtccactccgcgctttgacaggtacgtccctgcccgtaatctgatacatacatgactgtggagagttcgctagagcatgtccttgtagtgggacctcagttcttcctggtactccagctggtcctctttgatgaggcgctcattcacgtcaagggcctgcccacatgcatctgcaaattgcctgaagatctccttcaaaag

SEQ ID NO: 542729 - DNA, 396 bp, Homo sapiens
  misc_feature (267)..(267): n is a, c, g, or t
  misc_feature (294)..(294): n is a, c, g, or t
ttacttaccttaccctaattcaattaacatacagccacgtaatccagatgatagataggtcagtatagataggtcagtatagataggtcagtatagataagtcagtatagataggtcagtatagataggtcagtatagataggtcagtatagataggtcagtatagataggtcagtatagataggtcagtatagataggtagtatagataggtcagtatagataggtcagtatagatgcggaggtatagataggtcagtatagatangtcagtatagataggtagtatagatangtcagtaatagtagttaatagtcagatagatagtcagatagatacgtagtatagataggtagtatagataggtcagtgtgtatcctctagagtcagctatga

SEQ ID NO: 542730 - DNA, 151 bp, Homo sapiens
gcggccgcctactactactaaattcgcggccgcgtcgacgggagataccatgatcacgaaggtggttttcccagggcgaggcttatccattgcactccagatgccctctgaatgacgcactgtatgccacaccgcataggatcctgctagg

SEQ ID NO: 542731 - DNA, 225 bp, Homo sapiens
aattccttttaatacatggtaggctttgacgcgacaggaaccgggggatccggatgggcttctccaggatcacttggacaaggtagtcctctgtgtacatgtaccgggttgtcggtagatgatgtcgaacggaggaagcgcccggaacatcatcgtcaaacatgatggactcccagtcgcccaccatgtccacgactgacacccgatactccatctccccgacag

SEQ ID NO: 542732 - DNA, 542 bp, Homo sapiens
  misc_feature (236)..(236): n is a, c, g, or t
  misc_feature (238)..(238): n is a, c, g, or t
  misc_feature (264)..(264): n is a, c, g, or t
  misc_feature (336)..(336): n is a, c, g, or t
  misc_feature (498)..(498): n is a, c, g, or t
atctctgcgtggttcgctccctcccttcgggtctccgttcagaggccttttcggatcacttcctctaatccagcgccctctctctcaacactttccgctgattttcttcacagcagtcatctaaaattacactgcacatgcttacggactgggccactgatagttaatgagcccttaccgtgtgccaggaccctgcacgaatcaactcagttaattacaatccgaataggtggggncnatgattagtctcattgtgcggacagnaaactgaggaacagagacgttaagcaactcatccactgtcacatagcctgtaggctgtgaacttggatttgnaagtcaggcttttccaccagggcagagaccttgttttgttcactggtgtatccccagctcctggcccacagaaggtgctcaagaaatatgtgtcgaatgaatgagagtctgggcttctccctctccctgcatcactccgcaacagccgggccggctctggcncgactttctcagcccctgcccaccttcagctacgccggcggccg

SEQ ID NO: 542733 - DNA, 151 bp, Homo sapiens
gcctccgtgttctattgaaagcttctccctggacaggcggcccacttctaatgttatgaatgggctggacaaagcctctacttgagtttttagacggatcacatccactagtaaatgtaaccgaactctaaattccaacctataattgacc

SEQ ID NO: 542734 - DNA, 1581 bp, Homo sapiens
  misc_feature (590)..(590): n is a, c, g, or t
  misc_feature (976)..(976): n is a, c, g, or t
  misc_feature (1581)..(1581): n is a, c, g, or t
ggcactatgtgcgccgcgagccccagtcgaaacgaggccacccgtgcagccgtgtccagttccaggtccgggtcggtgcccgggtggtgccttgtaatcatagcgctcggtaactcctctgcgcttcttgctcctcttctcacttgcgatgtctggtgctcactttgcgcccctcacttgcatagctcgctgcggtcagtcggggatgccgtcgcgagcgacgctagcccgagagctgcatcactgtcgagacatggacgctcgaagcgatagcacgcagttcaccgtcgggcaatgtctcgcattgtagtagctccctgggtattaggaggaaatcgcgaaggagttgaactttccgaaagccagagaatcgcaggcggacgtgcatcttgaggacttaatgtaataccgacggacgaatgatgtccttcctacagaagtcaccatttggtaatggccactcgctttcgctctggaaaggcaattgtagcgttagggcgacccacatctacatctaatggagattttgtctcgatgggttataatggttttcgcggtgaggtccatggcgagctcaaaatgtccaatcnatcacatggggcacctgtagttcacgagaaaaggcgaggtgggggaaaacacatgtgtagccccaaggattccccaaatgaactgttgtgaacaggggcccaaaacgtttatccggccttgttggcccaattaggaagacgttcccctgttggcccaaggaataattcggattgcgacgggttgacacacggaacccaggactggcacgtgaaccaaaaggtgcaacgcctcaatggcttgtcgcggaagttgtacccgggaattgcttttcccacgcttcttcaaccaaatgaaaacacagagaggaacacgctgcaacacgacacaacggtccgaaaagttcccaatgcccggaagaattggcttacaggaacaccacaggggncccacaggcaggggcacaggttcccataggctcggggggacttctcccaaggcccccttggagtttaaccctttatcttcctttggaattggggaagcttcccagggccaagtcttccccaacctttcttttggcgcttgtgagtttgggacccaaccaaggccaagggttaaccacccagggtttcccccagggggccttccccttttgccacggggacccttttgggccaggggttggggcagcccccagggggcgcccttggagagtttcccccagggcgttctctcttggggcacgacaccgcattccgggagctgtggtgtgaaaggcccaaaaccaaagaccgttgtcgcgtttcggggaacacagggggtaccccttaatcttccaattggagaccctctgtggaggtctctagagaccaaccaacctctatttggtgcgtcaattgggggcgagcctttacaccttgtcgtcaacgacgaggcgagagagcgcccacacacacatttttgaacataccgccccccagcggggggggagaacactatcgcgcggcgatagtccgaccaccacacagagtgagtctcacaacaaattan

SEQ ID NO: 542735 - DNA, 99 bp, Homo sapiens
catggatttgctggtgcagtacaactaggcttaatagggacatgcaaaagtctcgttgcatttctactcactagctacaaaccatctaaaaaaaaaaaa

SEQ ID NO: 542736 - DNA, 708 bp, Homo sapiens
  misc_feature (694)..(694): n is a, c, g, or t
cccctgtcctgcaagaggattcgcagtctctattagggaaggtggacaataccctgtctgtcattccaaggccagaagtgactgccaaggccagacatccttggggtgagaggaaccttgctttctatggccctcctgatggcgaggcctggtctcaggccaaggagatgcggaaagcagtcccagagggatgtctgaggcataccaggcactcgaagaatgataggaggtgcacatggaagagatgctagcagcagcctacacttggacttcacaagacgccactgagagcagcctgcactttacacctgcactccacaagacaccactaggagcagcctacactctacacttggactgtacgagacgccactgatagcagcttacacttggactttacaagacgccgctattgcgcgcatttgcttagctactcagacttacatacagactgtgactaacccttgacgacttggctcaacagctaactcctctatgaagtgcttgcatgccacggaccatcagcaagactccagctactgcgccctcacagtcttgatgagaactcctcgagccaggcactatactctgatcctatgaatcgatcatcagtctaattctaagcatgagatgagtttcatatacagcacggatatagacgttgtcattgagtaggagctcagacagcatgacntataggcaagactg

SEQ ID NO: 542737 - DNA, 149 bp, Homo sapiens
ccactgataaagcaatgtacagacccgagcgcagtatgttgctcgaaatgcttccttcgcgatggcgtcagtgttccgtgagggaatgaagccgcagtaggaaataaagaggctgtcgggctagtcggggactgtcgggctagtcgggg

SEQ ID NO: 542738 - DNA, 727 bp, Homo sapiens
ggccccggttttggctttttgtgtggtttgtcctttcgtggcttccctgttccgggtggtttcccctttgtgatttccctgggttctatcggtgcctggcttctgtgctgtcagccgtttcttgctctgtactgtttagcctttgtttcacccccctgggtgtttcttccggtttttttcactttttgcagtttgctgtatgttttacttgggctgttacttcctcccagggttgggtcgattttggtgccagctcgtcggcgttttgctcgtttttccccgttgtcgtttgttgtccggcgttgatctgtgttttaggtcaccccttcccctgttcttgttagtgctcgcttgagttgttattagctccatttttctttgatttgtctgcgtaattggctttagcgtttctgggcgccctttagcttagtccctctctgggtttagttcccccgctatgcttagccctaccgctctgcggtttgatcttctgttctgctcgcctgatctgtccgatcctcggtttggatctcttaggccctgtcggtgcttcttatccctctagaggagcctgttctgtactcgatgtgccccgttcttcctctccgcctcttgctcagctttttttccgccttcttcagcaatccctgatggtggcttctatgttagcgctagtaccctcgtacggtcgttaggtcatgttgtagcgtgttgtattgttattttt

SEQ ID NO: 542739 - DNA, 414 bp, Homo sapiens
gggggctgaacgtttgttgctcttttccgggaggcaggctaatccagggtcgtaggactgccgttcaaaggttcagtgcaatcggggcaagtctttggaagcaagaagacatcgacagctgtggcgcacttgatacgcggctatgggcttatcaaggcgaacgggcggcccctggagatgattgaaccatgcacgctacagtacaagctgctggagccagatctgcttttcggcaaggaactgatctgctggcgtagacatcgcggtacctgttatgggtggcggtcacgatacccagatttatgttatccatcatgccatctccaaggcctggcggccattaccagaacttttttaggtttccagatggggagaatactccttcggctccggaccctatgctagctgccctct

SEQ ID NO: 542740 - DNA, 311 bp, Homo sapiens
ccggcgaagcgagaagtctctctccggtgggtgttacagttgtacccgtgggtaccatggtcacctgagaccaggtgggggctggcggagtagcactcactagcccctgagaggtactggagtccatgtcccgtggttcaacctgggggatgtggtaaatgaggagaacatgatccctggctttctggatagtctgggtcaaacgcttgtgctgcttcacacagactcctgtgtattgagcatagaagatgataaccgtgtaggcgcagacaaaattctccaagaactacacgttcctcctaagttcagag

SEQ ID NO: 542741 - DNA, 144 bp, Homo sapiens
gctacagaactatgcatggaccttctatttctgtgccccaccatggggttacgcccctaaaacacactggcccagcaatgatatgtgtgctggcatagccagccaagtggcccgaaactccgaattgagatccacaattttaga

SEQ ID NO: 542742 - DNA, 521 bp, Homo sapiens
  misc_feature (13)..(13): n is a, c, g, or t
  misc_feature (15)..(15): n is a, c, g, or t
tgccccatccttncntctctcacggtctttgaccaccacatgaagctcagagccctggtccagggggatgcccttgaggtcccattcaaatccctggaagaaaaagagaaaaggcatcttaacctatggccctctaggagaagagactgtgtctggttcaccttcgtgccaccagggcactgagtaggcattcatgaatgattctagtggataggcagatggatcaatggatggatggaagcatggatggatggatggatggatggatggatggatagatgaagaccacagatccagaaattcagaggtgacagtatgagctgaagacagcagaagagaggagagaggtctttcacaggcccctctcccaactcagtttcaacccatccccaggaagccaagccaggagtgtggctgggaaaaagccaggtgaccctgaagcatcctcaaggaccaagattattgggctcatccagacgccaggccctggcgtgaaagaaggaagggggtaccgagctaaa

SEQ ID NO: 542743 - DNA, 229 bp, Homo sapiens
  misc_feature (28)..(28): n is a, c, g, or t
  misc_feature (134)..(134): n is a, c, g, or t
  misc_feature (145)..(145): n is a, c, g, or t
  misc_feature (164)..(164): n is a, c, g, or t
gccagttctacaaggaatcattgatganagttatgccttatgttgatatactttttggaaatgagacagaagctgccacttttgctagagagcaaggctttgagactaaagacattaaagagatagccaaaagncacaagccctnccaaagatgactcaagagncagcgaatcgtgatcttcacccagggagagatgacactataatggctacaggtccatgtgggaat

SEQ ID NO: 542744 - DNA, 468 bp, Homo sapiens
ctatcaagtaccttaaagccttgttgccccattcaaagccttgtactagtaatagaagtggcatacataataaaggccttatcaccaatcaccatgagcatggaacacctatgtgccaccagggcactgagtaggcattcatgaatgattctagtggataggcagatggatcaatggatggatggaagcatggatggatggatggatggatggatggatggatagatgaagaccacagatccagaaattcagaggtgacagtatgagctgaagacagcagaagagaggagagaggtctttcacaggcccctctcccaactcagtttcaacccatccccaggaagccaagccaggagtgtggctgggaaaaagccaggtgaccctgaagcatcctcaaggaccaagattattgggctcatccagacgccaggccctggcgtgaaagaaggaagggggtaccgagctaaa

SEQ ID NO: 542745 - DNA, 290 bp, Homo sapiens
  misc_feature (13)..(13): n is a, c, g, or t
gtcgacatctagnaggatccccgtgattattaaacaagtaccataataatatcagccatttgtcagttatgcggggagtcaggcatggtcccacgctgcaacatcagagatccctctttgaaataacccagctttgccaatgacatctcttttctcaactgcataacctccctaaacatctgatcaacatcctgctgttacacgagtccctgctgaatgtatcgaatgtttgtcaaaaagttacatacagaaatgatcctgtatctgcaaaaaagagaaatattataata

SEQ ID NO: 542746 - DNA, 294 bp, Homo sapiens
tttatagtatagaaagagaagagcaacattaaacaggatttcaatcttcttttttttgtttttgagacggagttttgctctgtctcccaggctggagtgcagtggcccgattttggctcactgcaagctccgcctcctgggttcatgccattctcctgcctcagcctccggagtggctgggactacaggcgcctgccacgatgcccggctaatttttttggtatttttttagtggagacggggtttcaccgtgttggccaggtggatcaactgaggtcagaagtttgagaccag

SEQ ID NO: 542747 - DNA, 232 bp, Homo sapiens
cctgggggcccctgtggacaaacgtgggcttcaaaagctcgctggcctgggccccccagcatttttttttatgaacatgaaacactttggccttcctttccccagcgcccctaagggccaaaggcaaatgtgggctgcaggctgcccagcccaagggtctctggctgcgggcggtgggccccttcatggggctcccctggtggattcacattaaaccggtttttgtgggcca

SEQ ID NO: 542748 - DNA, 211 bp, Homo sapiens
cggtctcaccctcccaaagtgctgagattacaggttgtgagccaccacacccagcatatcgagaagttttttccatttttggggtttggggggaagtttttggtcgtatgtgggtttacttggtttgggtattaattttggtctctgttttgagacaggatctctgttgcccaggcttggtcatctctctacttagggatcagtgggcatc

SEQ ID NO: 542749 - DNA, 769 bp, Homo sapiens
gggctgggatgtctgtgcttatcttgggttcatatcttagagttatgaaagtaatataatcaatactcatcacaattcagatttatccaagaaactggagaaatggaaaaatgccagcccttatgctatatgattaatataaatagccattattagcttagtagtatatctaattaccatcttttatccacagcatatatttaatgtgtgtatgatcataatgaacacagaatttggttcctgcctgtgttgcttccattagctgtgtgtcgacgcgtatgttgagagctgcaacataatatctatgctcctttttccaaaggctgttgttggatgaagggtctgccactttgtctgtaattgactcaaacagtccacactagttgggcacagagtccatccaccttttcactggtgtacccttgagctctgtgcatacagtcttctccgtatttaggatcactttccattggcacgactgtttgatcaaaatgctccctttccctgatcccggtgaggtgtaaacatgggtcaccaaaaagagagagagtgggtgtaaagaagaaaaccacatatactgggaagggtcacctcccacaccctaagggaaccttccccaaccgggtgtaaaacccaacctggagatgaagccagcaataacgctaaggggggctctaacgggccgccagaaaaagccaggaacgacggggcgcaaccacacaaaataacgaacacccccacacaacaccagaggccacagaccccgggc

SEQ ID NO: 542750 - DNA, 993 bp, Homo sapiens
ggagtgaagggtctgctgctgaacattggggggcaaataaccggagtaggtttgttcctgtgccttggcgagtcgccggcctgctgggaacgggacttctaacaaggaactatgtctggaaggctgtggtccaaggccattttggctggctataagcgggtctccggaaccaaagggagcacacagctcttcttaaaatcggaccggtggtacacgcccgagatgaacaacagacattctacttgggcgcaagagatggcgcttactgtactatacaagcaacagacacaacacacgtcactcctgggcggcaaaccaaaccaacaaccagagtcatctggggacacaagtaacctcgggcccagtggaaacaggggcaagtggttcggagccaaactccgaagcaattctacctgctaagggccatgggcacccagaatccgagtgctgctgtacccctcaaggatttaaaactaacgaaaaatcactcacctcactgtggactcgtgctctagtcataacaaagtggattcacgaacacgttacaagccaacaccagacacagaacacacaccaacaaacacacgcgagggcgccgccagcgcaccccaggcgcaaggctaaacgacaccacgcgccgggacgaccgggcggccacagaaggaaccagaacaaggagcactacgccgagcacacgaaggaaaaccggcggcacgacacacagcgcgcgggacacatcaaccacaaaaaaaacaacaccggagacaacacacaagtcagagaacaaaccaaaagacctccaggagaccaaggggaaatacgaaaggggccacaagggagcccatataaatctgcgccgccgcgcgaccaaaccgcagcacccatcgcgacgcacgcccgacgacgccacccgacgcgccgccacgcaccaacaacacaacccaccacacccgcgaagccgcacacaccactacgagacatccacgacagcga

SEQ ID NO: 542751 - DNA, 106 bp, Homo sapiens
gtttctcattctttagtgtattaacattgtcttcctcttctgcagttgatgtaattccttcgtttgaattagacagctgcataatccagtcaggactgtattaact

SEQ ID NO: 542752 - DNA, 490 bp, Homo sapiens
  misc_feature (142)..(142): n is a, c, g, or t
agatctcaatccttgcccattctaactgaaccttccttagatccgttcactgcccccttcctctggactacactccaccatctcttgcctggaccctgtgagaactttctgccttcctgcctttatccttctccctgctccngcgctttagctgatgatagttccggatttcaaaaccccttaatgattccctccattgatcaaagtcttccatattctttcaagttccttggtgatccaggacctgccgccttctgcattctccctactgatgccatagttttggcttctggcctcatatgtcccgtgtcatttctctgtgtcactggctctttttacccctgactcagctggcttcactgctttcccattggatctcaaccctgtgtacctggggagagtcgtgaactctgtatgtcttgtcttgtgcttgtagtcactcagtgtttatgtttggatatttatatatatatttatatttattttaaaa

SEQ ID NO: 542753 - DNA, 324 bp, Homo sapiens
ctgctccgcccctctctgtgagaaacacccaagaatgatcaataaaaaaaaaaaaaaaaaaaaaggggggggttatccccatttttggctaatcggccaggaaaaaggttttttattttttggggcaaagagcagtggacctaattcagtaaaacatgtttagggggttaaattaaaggaaggttcccatgatcaaaaacctcgaaggagctttaagtttctggggggacccccttccccccccccggttattggggctttgggacaggggctggggaaacatggtatgtggggcctttttgggaggcaaaaataacaaatgtg

SEQ ID NO: 542754 - DNA, 132 bp, Homo sapiens
ccacaccctcagttggattgtatggcttgcgacctgggggcccgacgggcgcctcctccgcgggtatgaccagtccgcctacgagggcaaggattacatctgccctgaacgaggcacctgcgctctgtggac

SEQ ID NO: 542755 - DNA, 602 bp, Homo sapiens
  misc_feature (44)..(45): n is a, c, g, or t
  misc_feature (55)..(55): n is a, c, g, or t
  misc_feature (59)..(59): n is a, c, g, or t
  misc_feature (63)..(63): n is a, c, g, or t
  misc_feature (65)..(65): n is a, c, g, or t
  misc_feature (69)..(69): n is a, c, g, or t
  misc_feature (74)..(74): n is a, c, g, or t
  misc_feature (79)..(79): n is a, c, g, or t
  misc_feature (93)..(93): n is a, c, g, or t
  misc_feature (95)..(95): n is a, c, g, or t
  misc_feature (98)..(98): n is a, c, g, or t
  misc_feature (101)..(101): n is a, c, g, or t
  misc_feature (106)..(106): n is a, c, g, or t
  misc_feature (110)..(110): n is a, c, g, or t
  misc_feature (113)..(113): n is a, c, g, or t
  misc_feature (120)..(120): n is a, c, g, or t
  misc_feature (129)..(130): n is a, c, g, or t
  misc_feature (132)..(132): n is a, c, g, or t
  misc_feature (136)..(136): n is a, c, g, or t
  misc_feature (156)..(156): n is a, c, g, or t
  misc_feature (159)..(159): n is a, c, g, or t
  misc_feature (162)..(162): n is a, c, g, or t
  misc_feature (165)..(166): n is a, c, g, or t
  misc_feature (168)..(169): n is a, c, g, or t
  misc_feature (171)..(171): n is a, c, g, or t
  misc_feature (173)..(173): n is a, c, g, or t
  misc_feature (179)..(179): n is a, c, g, or t
  misc_feature (183)..(183): n is a, c, g, or t
  misc_feature (189)..(190): n is a, c, g, or t
  misc_feature (199)..(199): n is a, c, g, or t
  misc_feature (251)..(251): n is a, c, g, or t
  misc_feature (254)..(254): n is a, c, g, or t
attggaatgccacagggctcactaggcaggcaaagtgtgtgagnngaaggaaaanattnatcncngttntggtnaaagnggaagagggccctnanttnttnaagtntggngangccgccntggttaaanngntccnggccagcccatgtgtgtganagnttntcnnannancncccttngggncgtttnntgtttgtantaaaacacaacacagttcgggtgggggtattcaaacaggtggacaaaaaggntgntggaggtggcaaggtccccaagtttgcccaaaaagctcagaagggttaaatgaatattttccctaaaaccggcccccccctttttaatcagggggggaagaggggtttcaaaactgtttgtttcaattggccctttaagtttaggaggtaaaaggcgggttaatgaaaccaatgcctggtaaacccttcaaaaggaaaggaaaatgttttggggccccctttggttttttttttgggggggggcagttttaaggtattagtttttaaaaacaggactttttaaggggaacaacttggccaaaaatttgtcccagaattttgagcccccttaaaaaagtttaatgggga

SEQ ID NO: 542756 - DNA, 612 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 542757 - DNA, 1418 bp, Homo sapiens
aaaaaaggtcaattcatagaagaacttataaccaaatggcaaaagaatgatcaggagttgattacggatcctttgcagcacgtgcttcaaacaaagatgaaacttttacgatggtgcacgaaatcaggcgaccatctaaatgcggggtacggaacgaaacgggacgaacaccagacatggaagttcctgcactttacctgaacctgaccacgactgcagagtgttaaaacacctttagatttggccaatgcacaagagaacagcaactccgtacagaagaatcacaaagtttagtcacaaatatacacaagagcagggacaggacacggcttgcacgtcctgctaccctggtcgtacaacccttgtgatatgcctgggccaggaacgcacacagctcatcaacttaactgtctgatctgtggcgcgcatcgtctgtgaacacgcacaggctcaggcccttgctctcatctctgtaggcactctggtgatgttactcatgacggcaacaacgcatactactacagcgctgactcaacacaccagccctacaactgcctaacgcacacacttcatgtcacggcagtggacgactcctggacacagggtgtgacaatctcctaacaaaagaaccgttatctacacacattccacacattcgccaaattaacgacatggtctgctcagaaagtctatcgaagccattcaccgacacaactgttaaacagaattgacaagaaactaaatattacgaaggaacccagtatttgtcttcatgaacacaacacactacctctgctccagacaattccaaaacccaatgacatatccacaccataaacgctccaacacattagctaacacacatcaacatccttacaacacactcactactaacaccacctcacctctctaacaagagctcccctagcaatacaaccgcacaaacaccctacacaaccaaccactacaacaacacacctctctaccactgcttccttaccacaaccagcacctattccataccacccccaacctccaatcaaaatcgcatcaatcatcacaaacataacaaacacataaaaaccacaatcacacccacatcaagaaactacctaacatactaaaaactgctaataatgtactgaaaatataatatacaacaaaacgacacaacgtcaacaccatcctacaatgccgaccacacacacattctataattatctcactcactcactacacatatcaccaaacaccaaaataaacacacatcaaacacaaccaaacacaccatcacacacactgcactcactaacaataatacacacatctccaacccacttaaacaagcacctccacacccccatcaatcacccacaaacaacacaaaccactcaccagaaccatgacaaagccacaaa

SEQ ID NO: 542758 - DNA, 596 bp, Homo sapiens
cggacgcgtgggtcgacccacgcgtccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 542759 - DNA, 807 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaaaaaaacaaaaaaaaaaaaaaaaaaaaaaaaaaaaaaaagcggggggcattattggggggggggaaaaaaaggagttataaaggggggagtggtaaagggtttttggaccccttttttttaaagagggggaaatggggggccccaagagggggggataattggaaacggggtacacgtataa

SEQ ID NO: 542760 - DNA, 866 bp, Homo sapiens
ttggcctctgcctattcatgtgaaaggctttcgctcatgtctggtgatcatctcatcactgtgtcatgtgtgcttactgagcttggagtttcactgaaggaatgatctggctggactgcttattaggtggtagccctgaagccagaatcttcagaatctttacttttgtgtcagttatgttcctcagaatatggctttgacattctcctgcctgtgcagacgctgttcatgaatgatgattgtggacaggcagtatatgggcgtgtctaaagcggaagtgcatcgtgtggggtgtctgccttcttgtaccgatggcactatcataagtgtggactctgctgggaaggtgcagttctgggactcagtcactgggacgcttgtgaatgagccatctcatcgctaatgctgactgtacagtccattgctgtagcatgaccaagaagacagtttcgtggtgggcgctgccgaggcgaacagtcttaccattttcagctggtccctgtgacgtctaagcagcagtgagaagcagtgggtgcggacaaaatcgttccagcatcacactcatgacgtgctgcactgtggcccacagcccaacatgcgctgatatctggcagggaactgaagtacgccacttagtcttttcggtacctctcatggaggaacgtgtgggaaccgtacacgaagtttaccgaatgccagtgactcccgaatgacaattcgcccttttcccccacgcgaatgttcttcagtccaccatggtttgtaacacgacgaacggcagtcttctccctcgttaccaaggtttggctccatccactttaggaaccttgagggcgaattggggagtccatccatgtctgctatgc

SEQ ID NO: 542761 - DNA, 229 bp, Homo sapiens
cctcaccagtctgaagtgctggcctctgtcggagggagcatgatcattggaggtatcgaccactcgctgtaccaggcagtctctggattacacccatccggcgggagtggtataataggtcatcattgtgcgggtggaatcatgtacaggatctgaaatgactcaagagatcactatacagagcattgtgacagtgcacacaaccttcgtttgccaagaagtgttgagc

SEQ ID NO: 542762 - DNA, 154 bp, Homo sapiens
aggttccttttttgtttgggtaaactctaatttctatcaaggggtcagggatttttaaaattagtatttcatcccaaatgtttcagcattggttaaataatttttgcccgggccattattgatcaagcaaataaattccccagccctttgggga

SEQ ID NO: 542763 - DNA, 755 bp, Homo sapiens
cggacgcgtgggtcgacccacgcgtccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacttaaaaaaaaaaaaattgggggttttaggagggggggggaaaaaggggtttggaattgggcttgggtattagggttgttcctggacccagtttttttggcccaggggtagtctggggggttccctaaagggagcgataattgaaaagcagtaactgta

SEQ ID NO: 542764 - DNA, 157 bp, Homo sapiens
cacgaggcgtactgctgaccaccaagtgtctgctgatccaccctaaccccgactctgcactcaacaaggatgtgggccgcctgctcttggagaactattaggagtatgcggtccgggcctctttgctcacagagatccacgggggcgcctgtgggct

SEQ ID NO: 542765 - DNA, 512 bp, Homo sapiens
cagggtcccggtccggaatttcccgggtcgacttcctactactaaattcgcggccgcgtcgacgccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaagtcgtatcgatgtcgagcgatcatgatgatgatgtcgacc

SEQ ID NO: 542766 - DNA, 103 bp, Homo sapiens
tggctcccaggtaaaaaaagaaaagaagtatcaatcctcccttccactaagatgccagcctgcattgtgtttgtgtcaaaagtaaacacaatatcatggaatt

SEQ ID NO: 542767 - DNA, 656 bp, Homo sapiens
ttttgacggggcccccccccctctggtgtgcctttatgcgggcccctcttttgccgtctcggcctaatttgcggtttccgcacggtggcaccggtcgaccctgttggggttaccgacgcctgttgtgcgtggatgtccccccgcgcctgtcgttctggagcgggtttggtacttcggtcacgttttctgctatcacaccccgtggggcgcagcacgcctctcatccccgctcctcgccgcgaggtcatcttgcggggaattgtacgccgccaccaccctcgggtgaaccctccttatagaggatcggcgtacaatgctgggtgattaaatgaagcacgcctcccggtgtggtttctcctccctgcaaacaagcgagcgcccctctcataatcagagaggttgtcatttgcaaattctatatgcctcgtcctgccgaggatataacgcacgcttctctatctatctggtggggcataatacatctacttgtgccaaataatttctttcttttccttctggtgtctcacaaattccaccaccttagcacccttctctcttctaccatcgaccccgaccattgtcatctgcacctccctctttgacaaacaaacatcagatctctctatgcaaacagcccaacagaaataacaaaacaa

SEQ ID NO: 542768 - DNA, 781 bp, Homo sapiens
  misc_feature (12)..(12): n is a, c, g, or t
  misc_feature (28)..(28): n is a, c, g, or t
  misc_feature (93)..(93): n is a, c, g, or t
  misc_feature (115)..(115): n is a, c, g, or t
  misc_feature (137)..(137): n is a, c, g, or t
  misc_feature (155)..(156): n is a, c, g, or t
  misc_feature (183)..(183): n is a, c, g, or t
  misc_feature (187)..(187): n is a, c, g, or t
  misc_feature (228)..(228): n is a, c, g, or t
gagaggtgagtntctgtggcgtcgagtnccatcggctcccatccgggctatcctgccgccttagcggtgcttctccccaggatgcgggcaggnggcctctctcccactccccacncaccgatttctgagtagcgatnggggctgaggcttatttnntggggtagggggccgctggtaggcgangatngtccgagggagagggggaggatgaagccagtgcgtgcgganacttgccagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaa

SEQ ID NO: 542769 - DNA, 761 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaaaaaacaaaaaaaacaaaaaaaaaaaaaaaaaaaaagagggggggggcgcccataaaaaattctcccgcggggggccccccaataggggcacccccatttttgtggaacaaaggggggccccaaaagagagggggccgcgataa

SEQ ID NO: 542770 - DNA, 994 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaaaaaaacaaaaaaaacaaaaaaaaaaaaaaaaaaaacaaaaaaaaaaaaaaaaaaaaaaaaaacaaaaaaacaaacaacaaaaaacaacacacaaaaaaagacacaacataaagaatcgacgctcgcgagacggcaccacaaaaacaaaaagaaatgacacgacagtgcgccaacaccgagcgaggcacatcacaaaaagaagtgatacaggtacaaaagaagaaaacaaaagaacagcacaacacgccagcaagaaggaaacaaggacaatcaatcgttcgcgcaaaaaaggttggcacacacactgagggcgacggaacaacgagggagacaacactaacaagacaaacaggaacgaagcgaaagcaaccacgaag

SEQ ID NO: 542771 - DNA, 362 bp, Homo sapiens
  misc_feature (242)..(242): n is a, c, g, or t
  misc_feature (249)..(249): n is a, c, g, or t
  misc_feature (296)..(296): n is a, c, g, or t
  misc_feature (332)..(332): n is a, c, g, or t
  misc_feature (336)..(336): n is a, c, g, or t
cggcccgaccggagttaactcctggggtgcattgaatcgcacaggggacttaaatctggaaggtaaaacgtgaaactttataaagtcagcataaaaagcaccataaaaattggaggaaagttgttagttatatgacggaggatgactgcccgtttattgctcgagtgtggtcgtggagattcactctgaggctaaagtgctcttaggcagaaggtaggtggaactgcaggctgctgcttgcnatagggnacaataaacccagttacttgggaggtaagccttcagtctgggttgtnaaattatactccatgctcaaggcttttcagagggcncaancacctgtacagatgagtgtgctgcca

SEQ ID NO: 542772 - DNA, 727 bp, Homo sapiens
  misc_feature (101)..(101): n is a, c, g, or t
tccttgttaacccccctctttgaaggggaaggttgtgtctcccccttgtcagactgtgggggatatttgatggggcccccgacccacaccctggtgttccnacagccccgtggccatctccatacattgtgagcgtgtccccacggggtgtgtttgggggcccccagccatccgcgccctgtgcggtttagcccgcacaccccctttgtcggggtggcaccccctgcttatgatcccccgcgtaaatctgctaaggggcccctcttgttttcccctgataagggccccgccacccaccacccgggtgtttttggagggagtcttctcataatgtgttttatacacggggccgacccttgtccccgttccctcgagaggcttccccagggtggtcttaaaaacccctgggcacgacgagacccgcgggggttcccgggcccctccctgtggttccccacacgcttttcacgtgttcccctcttcctctggtgtagtcttcttattgtgagtactcacgggtttgcccgcattccgcggggcaccaccagagggtgtgtggtgaacactctgggggtatttgttctggggaaaccacccccacggtcccccccgcgccctccccccgcggccactcctcttttgggccccccgaatcttttctaattttaccccccggggccccccttccaaatgactcggggaaaaaagaaaattttttttaaattta

SEQ ID NO: 542773 - DNA, 971 bp, Homo sapiens
  misc_feature (767)..(767): n is a, c, g, or t
  misc_feature (776)..(776): n is a, c, g, or t
  misc_feature (780)..(780): n is a, c, g, or t
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaacaaaaaaaaaaaaaaaaaactcgaaactagttctctctctcccgggaagggcgtggaggctcacacctgtaatccagcacttagggaggccaaggctggaggatgcgctgaagatcaggagttcaagaccagcctgggcaccttagttagacctngtctcctantctnaaaatatacacgaggcacggttggccacgtcttcagtcaggggtcagaaggtgaatgggagggccttttaacccaagagttgaggtgggcgaagcatgatcacccattgactccagtgggtgaagagaaaacccgttcaacttcttaaaagaagagacaccttcacgccgggagggagagggggggaattg

SEQ ID NO: 542774 - DNA, 106 bp, Homo sapiens
gtatgctacttaccctgctgctgtaatgttaaagcagccacagacaatatataaacaagtgggcatactgtattccaataaagttttttcaagaagcaggaactgg

SEQ ID NO: 542775 - DNA, 1057 bp, Homo sapiens
tatccttagttgagatagtttggtgaagttgccgacggggataagttaactctggatgcgggtgctgtataagggttcaggccatttcgtcaggccgccggtcattgccgtggaaccagcggactaccattcgggttttgagctactgcacgggcatttttgggcgaacgatgccctggctacctcacagcttgctgcacccgttggggcgtaatagcagtttagagcgttcttccgccgggccgtttgcaaaccagccgtctggtccttcacatgcataaccagccgcacgtccggctgtcgttggccgaagtgaactgtgggagaagatgcccagtttcaaggggaaaagctggcgagacccaacctccaaggacacagcacggaaagagacagggttcacgggaagagaagcaggaagccccaggctggagcggaaggaggagtacaagtcgcctgcccctgctcctgaggaggagatggatgcaatgtgagcaggcgacctgggctggctagagcaccaaggccaaggaccccttcgctcaccggcccaagagtacctttgtgttggaggaaattgaagcgcaagtatctccaatgaggacacactgctctgtggctactgccatactttctgggagcactttgataaggacggctggtccctgatggtactcagagtatcgcggtccctgagagaactcactcagaccttcatgagctgcgatctcatcactggaatgttcccagcgactggacaagtcatgaggaagaacgccttcgccagtgtcatccttgttcggaaccaacaatcgcagctccatttctggagtctgggtcttccgaggccaggagcttgcctttccgccgagtccagattggcaggtggactacgagtcatacacatggcggatactagatcctggcagcgaggagacccagatcgctggttagatgagtactttctcctgtcagtgcgccatgacagcatagtagggcaaagccttcaatccagggcaagatcctacaagcgaacataatctggccagtcacctag

SEQ ID NO: 542776 - DNA, 402 bp, Homo sapiens
cttttcccgcccccccccccccaaagattttttatcccccgggtttccaatttcccaaagtttacctgagtaagtgttcctgggggcccagggggccctttggtaggcccgggggaactttttaaagcctacccctatttttctggggcccccccattttttttttcccgggaatttttttgggggttttccctttggggcccgggaccgggggtgccccgggtttttaaaggggtttccccccccccttttttttgttttttttattttgtttgggggttaaaaattcctttttccgggtttttttttttcccgggggggtttaaccccccccccttgactggggtttcccccttttggtcttttgggttggggcttaattaaaaaaaaaagcccaagtta

SEQ ID NO: 542777 - DNA, 818 bp, Homo sapiens
gcgtcgaccgcagcaccgcgcatgctccttcttttccagccccggtaccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaaaaaagaaaaaaaaaaaaaaaaaaaaaaaaaaaactccggggggcttttgggggggggggcacaaacgtgtctataagaaggcgccagtgcgcaccaaaggttgtactcgtggacccagttttctctgcgcccaagcgcgaaaatccgaggggaccccaaaaagagggagcggaatagatgcagaacacggagaacccggttagga

SEQ ID NO: 542778 - DNA, 112 bp, Homo sapiens
gattagcaggatctttaggcacgaatcgagtcagcctcttgtcgccggggacgccggtcgcgagtcgcaaactcggagacgaaggcgggtagctgaagaccagaccgtggac

SEQ ID NO: 542779 - DNA, 114 bp, Homo sapiens
  misc_feature (69)..(69): n is a, c, g, or t
aaaacagtaagctctatgccatacggttaccctccacgatgccattataaagccgcgacaagctgggtngggaatttgccaaaatactcaaccaagaggcctaagagctggaga

SEQ ID NO: 542780 - DNA, 160 bp, Homo sapiens
agcaaagcaaacggtagaattagagagatatacaagatgcatagaaggcggatgcaaactgaagtgtccaccgcgccaggcaggttactgtcaacatcaatgaagcaagccacacaaatagttcctttttcatttttcctgtaacatgtggctttctcca

SEQ ID NO: 542781 - DNA, 350 bp, Homo sapiens
  misc_feature (165)..(165): n is a, c, g, or t
atccggaaaaaaatagtggaattttttcccccgaggggggcgccaaaattttttaaaaaagggggccataaattttttccccccccccttgggaaaaaaaaaaaaaagggggccccccttttttttcccccccccggggttttttttaaaaaaaaaaaaaaggtnaaaaaaccccctttttttttggggaagcccctggggttttttggggaaggcgggggtttttgaaaaacccccgggggggaaccgggggttaaattttaacaaattttgggaattaaccccccccccccaaaattttttttaaattccccctccaaaaagggggaaaaaaaaaaggttttttttta

SEQ ID NO: 542782 - DNA, 127 bp, Homo sapiens
tatttcaatattcgtctattctttatgccttgccctagccagttggaagaagatgaagaaggaaaccaggtgaactcagcagggcagaagcaggaagcgggcagaagcaggaagcaggcagaagcag

SEQ ID NO: 542783 - DNA, 137 bp, Homo sapiens
tatactccgccggtaccggactccacctctacgtccaggacctgccggttaccagtgtctcagcgccgtgggggctccaggcggcctagggcctcatcatagtcttgctctggctctgggtcttcattggcttcact

SEQ ID NO: 542784 - DNA, 712 bp, Homo sapiens
  misc_feature (561)..(561): n is a, c, g, or t
  misc_feature (634)..(634): n is a, c, g, or t
  misc_feature (669)..(669): n is a, c, g, or t
  misc_feature (680)..(680): n is a, c, g, or t
gttataatctatgcaataagattccatgagtctaatattaatataaacaaagtaaattggggaaagtaaagtttattccaaataataaatgtagatgcccagtgtggtggctcatacctttatgtaatcccagcactttgggagaccaaggtgggtggattacccgaagtcaggagtttgagaccagcctggccaacatggtgaaacctcatctctactaaaaatacaaaaaattagctgggcatggtggcgggcacctgaaatcccagctattcgggaggcaggagaatcacttgaacccaggaggcagaggtggcagtgagccgagatcgcaccactgcactgctgcctgggcgacagagcaagactccatcttgaacaaaataaaaaacaaataataaatgtagaaaaaataaagagaagtagaaagccactatttgacagccactatagtagcagtgacagttgctgacaagaatcatcaatggatgctaaaattagtgaaagtattgagagacagaatctctacattgtctcaaaatatctccccacaaagttctnattacaaaagaaaaaatagtaactttaccctgaagaacctggcagacactacttaaccaattggtccaagttncccccactactgaaacaaaaatccacaaaacaccntgtgcctctanatgaggtgccctgaaagcaatatcacttctga

SEQ ID NO: 542785 - DNA, 358 bp, Homo sapiens
  misc_feature (93)..(93): n is a, c, g, or t
  misc_feature (137)..(137): n is a, c, g, or t
  misc_feature (195)..(195): n is a, c, g, or t
tgccaaagcgtagtacagacccaactcggttcccatgcatgtcctactcccgccttcccggagagtgtgtgtcctgattttactgggttgccnctgttacagccgagtccccacgctcacagccagatcacgggctncacgatggctgttccttttccgtgtaccttttttgagttaaaaatgttattttttttngtttgcttaatgtttacatgcttatccctgagtcagcaccatgcgttctgccggtatctaaaactcagcttgggtactcagatgtgatacctgaattccacctgcggaactctcagagctgcttgatctgctctgttaagaccaaggagtagagctgccatcc

SEQ ID NO: 542786 - DNA, 176 bp, Homo sapiens
gtcaagtcatatggctcagtgactcctggttcactgtggcaattaaacatttaaataattggctattctacttgtaaaacagaaaatcacataagccccaaaggaagataacaaattatgtctactgtatgtgtgacgcagaatttcaatgagatggcaatttgcaaatattggca

SEQ ID NO: 542787 - DNA, 147 bp, Homo sapiens
  misc_feature (75)..(75): n is a, c, g, or t
  misc_feature (100)..(100): n is a, c, g, or t
  misc_feature (109)..(109): n is a, c, g, or t
  misc_feature (128)..(128): n is a, c, g, or t
  misc_feature (136)..(136): n is a, c, g, or t
gatctgcccacgttggcctccaaagtgctaggattataagtgtgagccaccacaccaggcccgtttcatccctgnctcagcctgcatgccaagctccctnggtgcccgnccacaggtgtcaccctttnaggagaangtggcctgggg

SEQ ID NO: 542788 - DNA, 337 bp, Homo sapiens
  misc_feature (295)..(295): n is a, c, g, or t
cacgaggaccatcgcgtactgcaggtggtcgggcgggatgttggcctgcacgagcggcgtgtcgaccacgcccggcgcgagcgcgttgacgcgcacgccgaagcggccccactcgatcgcgagcgcgcgcgtgaggccgatcacgccgtgcttcgaggcgctgtagtgcgcgcggcccgcatggccgccgaggccgtcgatcgaggccacggtgacgatcgcgccgcgccggcgctcgagcatgcgccggcccacgggctgcagcgagcggaacatgcccgtgaggttgacgtcnaggcagcgggtccagagttcgtcgggcatcgcgtgggcgggc

SEQ ID NO: 542789 - DNA, 935 bp, Homo sapiens
  misc_feature (3)..(3): n is a, c, g, or t
tanctctctcgaagatatataacccgtcgaacacaacaacgggtataaaaactcatgcaatgtggtctacgcggatttccactaagaagtcggcctttaatatatagtcgccctaggttgttgattttcccgccggtgttgattaattccttttttctcggccccctcttcccgatccttaattctttgggaccccttaaacccggaagggtttttcaaatggaaaattttaagcctctactttcggccttaaggacaatccttcacccggcgctaaaattttcacccattgcgggccaacctatatgtgctaaatcccccggtaccgcccgattttgacaagccttcccacgaaggggtctaccaatgatttacgcggcgcaataattcttttggccaagtgggtcgattcccaccagttctcaagatcggcgttctctcaatcgaggagacttcacttcaatctgcccgcaattatcacccagaaagtttttacattggagaatgttctcccccagcagaaggtgtgacgcaccaataaccccggggtcgcccaaaaaaggaggaagaatccttcttgactctcgccccactggttgagcgatttatcaaatacccctttgtgagtccacccccacagtttttaaactctcccagggatttcccaccaatgttcaataaatatttaatcctgcggctcacgggattacaaaatcccacattttgtgtgagaggcgactataaaccaaactagtttctccctactggtcacattgaagcttaaattctctctattgcatataaactgagtaaacaagagaaataagaaatctccacaccgaataatccgccggagtgtgtacttaacccaaatttttaacccattacgttttcccccccccaaaaaaaaataataaactttcccaaacaaaaca

SEQ ID NO: 542790 - DNA, 414 bp, Homo sapiens
acatccttctcctgtcacttccatcgtgtattccacagacatctctgccattgacacttgtcacagtcacagccggttgttgtgtgtccacttgaaattcgctgaaaaatgtccttgaagcctgaatagtcacttgtacagccttcacagtcttggtaaatgtgcctgctccatatttgcacaaattaagccattgtgagctccacaaagaaggcttgaaaggctcgaagagagccagtgaaagagatcccaagtccagctatcttcacacaggcaagaggcccttgctcttccactcggtaatggtctcaggctcgtgtcactcctacctcagccacacgttctgagtttccccccaccatatcacagatacgtgtcacaggagagctctctcgtgccgaactcctacagccc

SEQ ID NO: 542791 - DNA, 858 bp, Homo sapiens
aagttcttccatgatgttgtaggtgtatattcgcgtgtgctatgttggcaagagcatagtcggtcgtgagagtactatgctaggagcgattcgtggagatagattgcaataaaggtggtcggaaatctggggactagaggtcaatgcctcggagtaggacagtgggaacgatacctgaaaggacccttgaaggtaacccggggtgtccagggtgggcttcggggcacatggttgcgtgcggaggggaaatcgtcggtgtgacccagacgattctggctggttgcagttactgggcatgctgggcgaccatttaggcaattccagtcaaattgtgagggaagcaagccatattccgactgctgtttacataatctcaagtcgcgcaggacaagatggtgtttgatcttgtgagtgataacccagtggaaatttgaaatcccctttagctgacaacggttacgtggtgtgagctgcatccatgggaaagacatgtgcttacacttgtgagcatggcttgccggggaaaatggcgagattcgcacatgagcgattgcgtgctcatccgttgcaagagtatagaatctactgtggtgtgcgactagtagagttgaactttcgctcctagggtgtacaggaattagacttaggttgttggtctatcaggaagtacgatttaacgtcttgtctcttgggaaaatttaggctcggagcactttaggaaaggcctgggttatcccctgagctcgtcgggactgcacatttggacgacgttcttaggggagccccatttttcggcaaaacgcttacaatttcaaaattgccctgatttgtccaccacaagctcgagaatggttacgg

SEQ ID NO: 542792 - DNA, 101 bp, Homo sapiens
gaactgcgcagaaagttggctgctatgcaatggtagtcatacgcaagaagcactggaatgtgaactggtgccccggagtctgttgaatcccagaacccatt

SEQ ID NO: 542793 - DNA, 914 bp, Homo sapiens
cgcctcttccatccgactcctccattcgcctcttccatgcctcctcccggctatccgccgccgccactccagacctaatcccaaccccagtggcgaagcgatattcttatattatttcctgttttctcgccactacatgacctcctgacaaggtgatcctgtggcgggccccgcatggaattttatccccgtcaccgtgcctcacactagtatctgcatgtccactatccagaacctccaatcatttcgaccccatatgcatgactgcaacgtaagggatgacagacataacatcccgagaagggaactgcaggattacaattcagtatacagaatcacagccaactggaacggacagcaacatgaccactgcaacttcacatatgtatccaagggccacttggccacccattgcaattattgcacccaacaacaatgaaacctctgttgcaataagctttattcccaaacaaaagcacaatttcggccgtgctcacatgcgtaacctggctggccacaacgacacaactcccatgcacacttaccgcggcacacagtgctccaataacacagcccatatcaccccggctggcacccacacacgcacacacacacacccattccttgaccccacgcattccgtcatctgcgaacagcgcatccgggcacatcccgtacacacgcgggggacaggcggacaaccacgcgacagtacaacagcaggctcaacccaattgacacactaacccatacagcaccaatgcaaccacccccaccacgaccacacccggttggcgacagcaacccttgcccctctctgcccccacaacacgaccacggctcgcccaccttaaacagcaccccgccagcatcgtgcgccatggaccactctgatcgagacaacactggacctt

SEQ ID NO: 542794 - DNA, 271 bp, Homo sapiens
aatgacagcagacaaggccaccatgggatttgtccaccctgggtgtggcaactgtctgtgcagtgcctatgccctgcacagacataggcagaggcccacagcaactctaaagggccctcccagaaatagccagccaggttgagcagggctaaaaaagaagatgaaggggtctctttcctttccaatacctcctctcttcctgagcatcgtcccctcattccaaaaaggagctgtaacggagtgaaggggaatggagtgggaaattagtgac

SEQ ID NO: 542795 - DNA, 129 bp, Homo sapiens
agaggatcccctttaaacatgacgacctttgagacatgccttgatcagccacatcaactcagttgtccaccacagtgggaatttttgaatgtcttttgtattatgtatatattttatattatttttttt

SEQ ID NO: 542796 - DNA, 1142 bp, Homo sapiens
tggggggggggggggggagaggggggaaccccggggggggggggggggggggggacacaagcgggggagagacccacacacaaaagtttttggggggggggaaccccccacgggggggggggagaaacaaacggggggcgcggggggccacacaaccccacacacacccttcttggggttcttccacccgagagagggggcgccacacagagagaggggagaggagcagcacacacggggggggggggaggaaaaaaccccgggggcgccccacagaacacacacagaggggcagaaaagagagaggggcgccccccacccacacacaaagaaaaatatatatataaggcgagacgagaggggggggtcacacgaggggtggtacacacacagacgaggggagagaggtgggtgtgccacgagaggtcggggaaacaagaggggacaccgaggaggaaaatctcaaaaggtgggtcgcccggaggtgtgggtagggtgtagcgcgggggagcaccccacaccacccgcgcggtgggtgggtggagggagaaaaggtggggtggccctcatctaatatacaacaacaaaacaaaaaaatatatattcacacaaaggagtggtgtagaggggggtgcaaacccctcaccacacaccgcgcgggggagagaggagggaagcacgagagggggcggagcaaacacaaaaataacaaggagagcgtccggatggaggagaggggtgggcagggaggggtggaccaaaaaagtgggggagaggtcaacaaagcggtgaaaaaaaaacaccacgaaagtaggatggcgcaccccgccaccatggggggggccccaacataatgaataaaaacgcggccgcggaccacacaaagggggggaacaaacaaagaggggatccacaacctaggatgaggaagcaaaaaaacacaggcacccacaaaaaatagggcagccgcaatacaatactactcacagacgggctgctcaaacaagcgcacacagaggccgaagcccgccagtatgaacacccaccacatgaggtgtcgcccccaaccactgagtggaggggaggaaagaatcggaacacaccacatgatgtagcaaacacaaaacccaccccacgacgtg

SEQ ID NO: 542797 - DNA, 296 bp, Homo sapiens
  misc_feature (170)..(170): n is a, c, g, or t
  misc_feature (218)..(218): n is a, c, g, or t
tcttttagtagttttctactcaatcccagtttatggaaaaatcaggtctattgtattagattcagtattagtatcaaatatacaacaatatctagaattggtttatattaatttacaaagaaaacatttcatctattggatatgccattttcaaatcttttgaaattggnttacatagttagaaattataaaagcagaatcagaaattacagatatanagattggtgtgttgaagacagaaaaataaattgatccattaaaatcaatacaatgcttgaatttcgcattcaaatttt

SEQ ID NO: 542798 - DNA, 451 bp, Homo sapiens
atgtgattaaattgatgatttagatttcattggaacctgttgtgtgcccatgatatttgagaataacttcatatatattatttgagagataggttatagatggaaggacataactatacaacatgactacttgcactttaatatctctttgggggaaatttgaggctctctaaggcagcatttggtatcttgctctttgcaatcgtatgaatctttgagagcatactaaaatggtaattcaactgaatgcttattttgtaaatgttaataacaccacaatacagccctggtagatagcaaaaggccctgaaaaactgccctttgaggccgggtgcagtggctcagcctgtaataccatcactttggtagaccaaggcgggtggatcatgaggtcaggagattgagaccatcctggctaacacagtgaaaccccatctctactaaaaaatac

SEQ ID NO: 542799 - DNA, 198 bp, Homo sapiens
tcatcgaccagaatgacacacatgccgtgccctgtgtagccctgacgcccaggccgccttcacattcaggtcccgctgagtgacaccagacaggtaccactgctgaggaagcatgggttcctcaacctggtgccagatcttcggggactattaccacttcgtggcatcgagtagtgacgaagcggtccctgtcgcctc

SEQ ID NO: 542800 - DNA, 277 bp, Homo sapiens
ccggcacggtggctctgctgtcatcccgcactttgggaggcacgaattccaaaatgatttctaaaagggatattatatgctatttatagaactttaatatcgttaacattgttatctattattggtaacggcaatacattctcattataaatgacatgtactttcagtacaatattcagaggtaagagatttagtcggttaacttgtaacagctatgcttaatcattcacttgtagactgaatggctgagaaatccctggctgagaatacatcccaa

SEQ ID NO: 542801 - DNA, 1722 bp, Homo sapiens
  misc_feature (1172)..(1172): n is a, c, g, or t
gcaaattttttaaacttattgcactaaatacaggctctgtacaaaaaaaaaaaaaaaaaaaaaggcctcagcttttaatcatcccatggaaaggaaattctttggaaaaaaagcattggccttcctataccagaaatcatacaacgggtgaattaaaatctcggatattaagtcgaaatgtgcattacaacgttaaggtgttcactataggggcttaacataagcagcccgtttggactactgtgtgcttctcctttctcacaagggttgggaccctttctacaatgtggcttgacaacacagggtatacaaatgtggatatattatatttttaacaagtatattagggcgagatccttataaccacccataagctatgaggctatagaacattatggcctacaaagtgcctatggagactacacttatctacacaacacgctcacagtgataaatacttcccagtgaaaattatctaccgagaacatctatttggtgacccattcaacgaccgcatcgcgagacatctgttaccaaaccaagaccccacatggggcttttccagcacaccaaatatcaaagcacgactctcaagtgtgtccttacagcaccccacagcatctcgtggcgcacacaccccaaccatttggccgaagaaagcatcggcaaataataagagagaaaagagaatatacatccccctcccaagaaatgactaaaccgcaattctataagatattctacaggataagctacccgcaaacaaacagatctaccacggagggactctccctcagatagattaaatcctacataggcagaaagtgtggcaacatcactagccgtctatcttaataaagcattaagaccaaaataggagatcaaaacaaagatagcaactacaagcagagcagcccaacatgcccgtggatcgcagcacaacacagctgccccaagcaaacaccccagtagacgagactcaccaacagagaccccgcaaaacaagacaacataagcggacaataacacaccagcgacaaaccatgtggggccacaaccccaacttgcaccacactggcggccacaaaaagctaccaacgacaagaagagagggataccacatacacgaggaaaaagaactactaccccagaagcagcacatacgcaataanacagaaagagggtgatcaccacacgaacagagtgacaccagaaaagaacaacgccaagcagaacagtggcaaacaaagacagcactacaacaaccaccagagaggaaaacaccacgcaaagatcagaaggagaccggtccgcgacataccacaagctctcacatataacaacagcaacccgacacaacacacacatagacaaccactacccagcaaccgcacgcactcaacaccaccccatgcgcccgccagcaggactgatccgaaccagcaaaacccagctacacaggagaagtaccgaagagtgcgacccaacacaacagacgcgacacaacacaacacgcgcaccacaccacacacacgggccgcacacacacacgcccaacgacgaccccatcacagagctctgaccacctaacgcgggccagccaagaggagcagagacacagacgtgagaacccaaataacagaggaatagtaagaacgaaaacgagccgcggacgcgactgaccagcgcaggacaagaccgcagagacagcgccagccgaca

SEQ ID NO: 542802 - DNA, 279 bp, Homo sapiens
  misc_feature (250)..(250): n is a, c, g, or t
gttctacaggtatccccgcacgctcctgtggcgctgaacgtgcctgttctgagcgatgagacccatggtctgacagagtccggttacgcctttcccggtctcctcagcctttctccctgtgatcttatcacagtacatgatcagaagtagaaattctcatgttagctgaaattctcttcatgttttttcttgtgtgcagacctcgtttatgtttatagcgtcccatgttactgatgtatggccactgtgnaacctctgtggatatgattccctatgctt

SEQ ID NO: 542803 - DNA, 281 bp, Homo sapiens
ccccgcctgggatcactgagaatggggttcttcttctctcggtacctaactggggcccgccacagccatgaaaagccttgaagggctatgcgttgctatacgctatgagtcctttagcaacccaagctcagtatattcagagaagtccgccaaggatggtcccttctaaattgtcggacactgcagttgccagggcaagttgtgcttatcatccctaagtaacaaggtgcttcacggttgctacggagattttccaggcgccagtgaactccacgtctgcg

SEQ ID NO: 542804 - DNA, 150 bp, Homo sapiens
  misc_feature (63)..(63): n is a, c, g, or t
acgacctgaattttgtgaagtgtcgtggcgttaatcttaaatcaccatttccctaaaaatggngcactttctccttagaaatgctggatggcaacttgatgaaacagcccaaatgcacccagggcgagggcacttttcccaatttcgacg

SEQ ID NO: 542805 - DNA, 215 bp, Homo sapiens
agcggcgggtcgatctagaggctcccggctcacagaggcacagggccagggaactcagttaggtaccaacgctcctaccaggacgaccaataaaaaaaagggggggttttttttttttttttttttttttttttttttttttttttttttttttttttttttttttttttttttttttttttttttttttttttttttgttggattcccccccga

SEQ ID NO: 542806 - DNA, 621 bp, Homo sapiens
  misc_feature (171)..(171): n is a, c, g, or t
taggggactacgatgcccaagtggtagtatcctctacttctctggctgttctttaaataactatctacctacatttatatttgcttcaagaaaggagaaaatgaattgtctttagagtagtgtgtgtgtgtgtgtgtgtgtgtgtgtgtgtgtgtctaagtcctagcatantcattcattgaatgagaaaaattagtcctggagttcttttgttagctttaaataatcacatatacctacaattgggctctaagcaagggtgaaatcctattgtttgcaaattacatccctaatgtcaatcaaaatctgattaaatgaaaaacgttgaactgagaccaattcatgaaagattttatatttttaagagatgtccattgccctttgaaaatgtatatcacttttatatcaacaaatctatgttctcaacaaattatctgatattaggaatattaggaaatttgtaaatagcattgtatcagcttagattagatacactgattccctctaaaagaattgtctatgcatagcaaaaagttcactggaacaaatgttattgtctgttaaggtcaattctttttaaaataaactttcttatcaacatgtaaattggtgaaaaaaaaa

SEQ ID NO: 542807 - DNA, 223 bp, Homo sapiens
cttttggggccttggctcttattaaaggtgtgatattttggcagccactttcctgcgctattacagcccccagcgtggctgtacctgagtgcatccgtcttggggttcagtcgttgaacatgctgccaaaccaggacactggctccagctagtgtttctgctcttggccatcgtctggcagtggacatgcaagctacgtgggtggaggactcttataacgaga

SEQ ID NO: 542808 - DNA, 757 bp, Homo sapiens
cacgtggtgactcacgcctataatcccagcacttgggaggccgaggcaggtggatcacctgaggtcaggagttcaagaccagcctgaccaacatggagaaaccccatctctactaaaaatacaaaattagccaggcgaggtggctcatgcctgtaatcccagctactctggaggctgaggcaggagaatcgcttgaactcgggaggtggaagttgcagtgagccaagatcacgccactgcacttcagcctgagcaacaagtgcaaaatctgtttcaaaaaaataaataaatgaattttaaaaagtaaaaacggcaggcgtagtggctcatgcctataatcccaacactttggtaggccaaggcgggcagatcacaaggtcaagagatcaagaccatcctgccaaccatgatgaaatctcctctactaaaaatacaaaaaattagacgagtgtggtactgcaggcctgtaagtcccagctactcaggaggctgaggcaggagaatcgcttgattcctccaacagggaggcacaggtgtagtgagctgagatcgcaccaacaaatgccagcctgcaacagagtgagactccatctcacaaattaactatctaacactcaacgaattaaacaaacaataacagaaggtggcagggggggtcacgctggtatccagtctctggaggcaaacaggggatcaaagcgcagggtagaaaccggcactgggaaacccgtcacaaggcaaaaataccaggtggtgt

SEQ ID NO: 542809 - DNA, 217 bp, Homo sapiens
  misc_feature (37)..(37): n is a, c, g, or t
  misc_feature (60)..(60): n is a, c, g, or t
  misc_feature (160)..(160): n is a, c, g, or t
  misc_feature (196)..(197): n is a, c, g, or t
  misc_feature (201)..(201): n is a, c, g, or t
ctttatttgctggttgtctttctcacacatctttctntctgtctctctctttcctgctcntgtttttctgcccagaaaaacctgacttcgataccaaaaagataaatacgaactcaaatttaaaaaaaactttaaaagaaacaaaaaaattactcaacgnttctttcagctttattaacaatttccattgtttctnngcgncttgtgtctcgttctt

SEQ ID NO: 542810 - DNA, 87 bp, Homo sapiens
gatatagtaccgtcgaggcctcagcatggtaacattcattacaccgaggcataatatagtcaacggactaacccctataccttctgc

SEQ ID NO: 542811 - DNA, 652 bp, Homo sapiens
cggacgcgtgggtcgacccacgcgtcgcatctccgcatgatgaaacttcggctcactccttggcgcctgtcctgatcctccaaatcaccacaggactattcctagccatgcactactcaccagacgcctcaaccgccttttcatcaatctgcccacatcactcgagaccgtaaataatggtctgaatcatccgctaccttacatcgccaatggcgcctcaatattctttatctgcctcttcctatcacatcgggcgaggcctatattacggatcatttctctactcgagaaacctgaaactatcggcattatcctcctgcttgcaagcatagctaacagccttcataggctatgtcctcccgtgaggccaatatatcattctgcaggggccacagtaattacaacatcttactatcctgtgcatccctatactaattgggacatgacctagttcaagtgaatctgaggaggctactcagtagactagtcccagccctctagacgtattctttacctttcacattctatcttgtcccttcattattgcatgccctagcagaactccagcatcctattctgtgcacgaaacgggatcaaataagcccctaggaatcatctcccataccgataagatcacttcaccctttactac

SEQ ID NO: 542812 - DNA, 112 bp, Homo sapiens
tccaagcatcattcaatccgttcatcacattctcatgttttcaaccattcaatcaaccaaggcacatcacatgcatccatttccgtggaggtcaccgcagctctgcacattc

SEQ ID NO: 542813 - DNA, 414 bp, Homo sapiens
  misc_feature (23)..(23): n is a, c, g, or t
  misc_feature (31)..(31): n is a, c, g, or t
  misc_feature (33)..(33): n is a, c, g, or t
  misc_feature (157)..(157): n is a, c, g, or t
  misc_feature (195)..(195): n is a, c, g, or t
  misc_feature (218)..(218): n is a, c, g, or t
  misc_feature (303)..(303): n is a, c, g, or t
  misc_feature (310)..(310): n is a, c, g, or t
  misc_feature (354)..(354): n is a, c, g, or t
  misc_feature (393)..(394): n is a, c, g, or t
ttatttaacgccccaaactcacncccatacntnccctcagcctcgcgccgccctccactaaagtcagctttcaccctctctcccctctcagtgccatccacaaagcaaacgcacagtggcaggctgtgaaagattgtgtgaagagtgtgtttcgtgnatgtgtgtctgacaacgtaaagagaaccaaagcccatnagttggaatggaccacagtagcnataacaccgcaatcgaggagcgtctcgagagcacctgagggattacaactccaactcgagaagaagtcgttaaggtttttactgnccctctnattgcgcgcccggtggtgttaacgcgaaaacaggaacgagagtnaacacgtgaaataagaaggtccaattcagtcccagcctnnccgagtttggggcgttaaga

SEQ ID NO: 542814 - DNA, 181 bp, Homo sapiens
ccccccccccctttttccctttcttttggggggcgggggggggttttttgaccccttttttttcccttttttataagggggccccccggtttgaatttttgtttgcccaaaccctttttttttttttccccttttttccccgggggggtccctttaaaaaaattaaaggggttttttttta

SEQ ID NO: 542815 - DNA, 761 bp, Homo sapiens
agcggagaagccgagatggcggcagtcagcgctgggtgcaactccggcgtgctcctgctcttgctgatggcggtaacagtgcccagtcgagcccggggcagcggctgcctgggccgggactggtgcgcgaggggctggcgcggaaggtcgagagggcgaggcctgtggcactggtggggcatgctgctggagcactcatttgagatcgcatgacatgtgccaacttccggaagcggggctcactgctctggaaccagcacgatggtaccttgatcctgtcacagcggcagactcagcgaaggaggagctggggccgaatccgaggatgtggccagcgctgaatggcctgtaccgggtcctggatcccaaggcgacccgtggccctgtgatgggctggaagctggtgggctatgtctccatcctttgtaccctgtcgtgagtcctggtgggagtcgcacgatgtcggaccacgtgacccatgcaccgtggaattagatggaccggcaagcggctgcgtcgggcgtgatcacggccgtgtgacaggcacccattggggtggcacctgcgccgagggagccagaggagcgctgcgaccggcaccgttgtgacccatgggagactatgctccacaaggccaagccaatccatcagccacgagctgccacgcccgcggacccgaccaaaaaaggccacacagggacaccacgaggcacaggagaaggggcatcatggccgattggcagccgccctggggacagatg

SEQ ID NO: 542816 - DNA, 299 bp, Homo sapiens
  misc_feature (17)..(17): n is a, c, g, or t
gttttcccctccaaaantggggggtaaaaagggtgtacagttattttcccctccctgccttaaaacttgggaaaggagcactcaaggctggccccccaaaaggttttgtggccttttttctcacacaaaaaaggtcaacaataatgtccctgtgggcccagtttccctcctcccccccccccacttaaacagtagtttttgggccaaaggtcagggtgggcgggggcctgggaatacaacctttggaggctgcttactcaacttgtgttttaattaaaaatgacaaaggaaaccccgga

SEQ ID NO: 542817 - DNA, 1041 bp, Homo sapiens
  misc_feature (1041)..(1041): n is a, c, g, or t
accacgcgtcggagcctgggatgcattgctcagggtgggcgtggctagaaccatggtccgaaagatgcactgcacaggttgtgagaggcgtaagatgctgtccccccatccaaaatccgtgcgccactgcagtgagtgttgagggcacctctcctcccctcttacacctactcacatgagcgcagcggcagatcccatctcgcggaggagtactgttctgtatggcgcactaatatttctcatcctcgagtcatcttgctaacaggtcagcgcgtgagaaatcctttcccaggcgcaggccgtctgcgtgtacgctggaatggttctgccacagctgggcccaattggaaggagattcctcttaatgcatggtgggacaagaggcctgggttggcccctgcttgggacatgcccaacagctgggggagacgttactaggccagtcactgtagagattgagcagttttagccctcgcctggctttgctggcgggaggagtgggcctccttagggagacaggtgaccctgggtgtcatccctgtacccgtgtgtgccccgggtgttctcagtggttgctgaacgcaggtagagggtgctgtccagtattccccatgtgaatggtcacttccctttctcatggagtcagctgagcattagctcagcctgcatgttcccactcacctcctcggctctgttcgggcctgggtttctagcggagctgaagcatcactctgggccattgaccgatgagaggtctgaagccttctggcccagggcatgacaatttccactctcgatggccgagctgacccgtttgcggtgacggggccttgaagcagtgagacacaaacctaacacgaatcgccaccatgggtgggggggaaatcgcaaggaggcccaccctagaaggggtaccaccacacatgtgaggggggcatagctcgtggttcaattaaaaaggctaaaagcagggccatacacatacagcaaggaagtgctcacaaagctacaaggtacttcatctataaatttatcacacgn

SEQ ID NO: 542818 - DNA, 949 bp, Homo sapiens
tatttagggaccattcgtgctggcgcgcggtacccagaagcgtaatgtcacactatgcatcatagcatgctttaccctagcgaatgatctcgtggtctcagtgacttcagttgctctgtgtattcctctactcatagtatatccatacgtccctggtgtgccactcgatccgtatctgatcacaaatccaagattgagacgtatctagataggtcatttacatggagatctcatcgacatgagaagtcccaggctgaagcctcagttcatgaccatttactgcctcgtacgtgctcatcgccctcccatccctacgcatcctttacataacatgactgacggtcaacgatccctcccttaccatcaaaatcaatttggccctcccaatggtactgaacctacgaagtcacaccgaacttccgggcggacataatctttcaacctcctaacataacttcccccccaattattcctagaaccaggcgacctgcgacttctcttggcgttgaacaactcgcagtacgctcccttccccgattggacagccccgcacttcggtactaatacatgacactcaccaacgaacgtcttgcccttcattgagctgctccccaactattaggcttaaaccacaccgatgccccgtcgcgtgaccgtctaaacacaaaccagtttcaccgctacaaccgaccggggggtttactacggtcatgctctgagtctgtggcgcaaaccccagttctcttgcccatcgtcctagactttattcccctccccccttgccctcgggcggtttcctatgctcccctttacccctttgggcgagcacacatcctccctcttcgcgttccccccacacctaactctcgtgccggccccattcctgtcccctcccgctgctcaccgcgctcccccagccgcccccccccccctgtctcctgctcccgcc

SEQ ID NO: 542819 - DNA, 663 bp, Homo sapiens
cttaggcttcgaaccacacaacatgtggacacagtcacatcttggaattctcccaattcgcggttccgaagaaaagaagttggttgaccgacgggacccccccgcgcgtccccaccctttttattctgcggacccgagggcgtgttgttgtgccccgacaccccccaccagagacgggtggagtagtacttttacacgagacatccccacagtcccccgtagcgcgctagatcttttgccccgtactcccaataaatattttctgttatactagacatgccctttaaaacaaactccgcatctatgatgctactacgctttaatagagatactctcaattgcttcagcaaagagcatgaccaacccccccacactttttacagtggagcaggtttatatctccaccaaaatattaatgtatatttagctcacctaaacactagataatatatacgcaggcctcgcgggatctacaaagataaatgtgtattttcacagaaggacacagtgagtttagttttaacaggggcgataattgtgcgcagtaacacatcccccaccacgcgaaacatttctggagtggcagcaagctgacgcaccttaacacactgacgacaataaaaccactaggcgttcttcgaaccaatcattagaacaagaaga

SEQ ID NO: 542820 - DNA, 254 bp, Homo sapiens
cacgaggggagctcgttagtcatttctcccccagttcgaacagctagagtctcgagtcgtcttacctcacctaggagcccctctacactttccttgaggagtgagagtgagtctgtctcagcaactgaagatctggcacctgagtcatcccaaggggaggacaattctgggatcgaggaggtcttagaacaggaggaattcgaaaaggaaggatctgaaggaagctcctctgaggaagatgagcctctaccagc

SEQ ID NO: 542821 - DNA, 811 bp, Homo sapiens
cggagttgtcttgtttttccgaagtgtgttcccgtttctcccccttaaactgatgtcctttggagggaccttggcaagttcccagacctcctgggcgccaatttggcgcatttggaaaaaatggggccaaccttttgccacaattagcagggctggccccgccgcctttctcgcaccatgccccatccagcaacgttgggcgactcatagcctctgcctcagatgggcctgtgggagcctttctggagcccagcacttactccccctgtgcacgacctgctctgtctccactgtcccagcgctgagggcccagggtcttgttcttggggctgggggatgccctcttttctatatattatttcgatagaaagtctcctgcgggtagcggaaatccagtccggcctagggctccccagccccttgactgtcctcctgtgagggcctgaactgggcccgggcccgtcgctacggagccccctctcagcgagcccccacgggtccctccaggcatgctgcccgtgcgtggtcttttcttccgtccgttttcagaagccaatagccgccgggtctgcttaagccctgtccagcaccagactgggcccttccaaggtcttagcccatgtgtctgatgaccattcctggtgaagcacaaggagcaggaggatgggtcagaccctcactgggtgtcacaccctgagagaagtcctattgttaaggaacggaaaagtcaccaaaaagtttgtattaagacatatttttgtactacatggggactcttcctgcatgtcagccatacacttcctgatctgga

SEQ ID NO: 542822 - DNA, 104 bp, Homo sapiens
gtgataacaagatgataaccatacgcaacacttaatggacgaacctgatctcttatactagtatccttaatcatttttatcggcgctaaattagctcttcggaa

SEQ ID NO: 542823 - DNA, 342 bp, Homo sapiens
gattagtacctctcctcagctcccgaagaggttacatccaatctctcatgagggaggcgttcttcgatgcccctccatgtagttgcagcctccctcccttcttggcgcttggcagagcatacacgtatgtccaggatacatggtactagcctatgtgttgctgttcttcctccacacagcaggatataaactccataaaggcaggaatctttgcctgtttaagtcatggtgtctccttggcgccttgcaattagtagggactccataaatactcagtgactgaccaggaatggtggctcacacttgcagtaccaacattttggcaggctgaggcgggggcac

SEQ ID NO: 542824 - DNA, 275 bp, Homo sapiens
cgcccaggctggtctcgaactcccgacctcaggtaatctgcccgccttagcctcccaaagtgccgggattacaggcatgagcaaccgcatccggccgggatcggctattaaaggggtgaagttggggggcctttaacgctcttcgcgtcccatcccatccttcccttcccccttccgttcctgcccagtactctgggtcctgcggcctcaggggtgtccaggacccaccctgttgtgctccatgtccgtgaactgctgcacgaagaagcatatgg

SEQ ID NO: 542825 - DNA, 166 bp, Homo sapiens
acacctgtacgtcgctaaccccactaaaactcaccaagactcaacctctgacccccatgcctcagtgatactcctacaatagccatctacttgttcctggcatctactgttcctggcatcttggtggatccgtctacgagtctgaccttgcatggcattgcaatgc

SEQ ID NO: 542826 - DNA, 210 bp, Homo sapiens
ctcctgccatgtgcatttccaaatgtgaatagctggaatcaaaaatcattaatttaattttcatttcagttgaccctcgaacaacaaaagtttgaactgtgtgggtccacttatatgtagggctttttttcaataaacatattggaaaattttttgggaattgtgacaatatgaaaaaactagcagatgaaccatgtagcctagaaacat

SEQ ID NO: 542827 - DNA, 338 bp, Homo sapiens
ttgcagagacctcatgaacccacttaaccaggtcttcagtctgacacacaaaggtatgtggagtctcagcagagcagccactcaggcacgtgtagagacgtgatgcctttagatactctggctttcagggcttcctggcaaaagtagctgtagctcttgcaaagtggaaggttagaattgcaaagtgggaggctgaattcagggggctgagcagtgacagtctgcgggccccattttcacagcacctcacaggataagatccactggcttggaatttcaaccagccgtgatagcagtgttgggcctccctggaatggaactctcaggggtaccgagct

SEQ ID NO: 542828 - DNA, 223 bp, Homo sapiens
ttactaggtgagctttttgtgtgtatgtgcataagagtgatgggtctgtggtattcttggggtggtattgtggtaatgcgggcctcatgaaaatattgggaagtattctcttgcattttgggggaaagttcataatgaatatgaattcttatttaggatgaaagattgttgatttacagtgctatgttagtttcaggtgtaccacgacatgcctcgttaagct

SEQ ID NO: 542829 - DNA, 1051 bp, Homo sapiens
  misc_feature (737)..(737): n is a, c, g, or t
  misc_feature (739)..(739): n is a, c, g, or t
  misc_feature (745)..(745): n is a, c, g, or t
  misc_feature (750)..(752): n is a, c, g, or t
  misc_feature (755)..(755): n is a, c, g, or t
  misc_feature (757)..(758): n is a, c, g, or t
  misc_feature (763)..(763): n is a, c, g, or t
  misc_feature (765)..(765): n is a, c, g, or t
  misc_feature (767)..(767): n is a, c, g, or t
  misc_feature (772)..(772): n is a, c, g, or t
  misc_feature (774)..(774): n is a, c, g, or t
  misc_feature (788)..(788): n is a, c, g, or t
  misc_feature (796)..(796): n is a, c, g, or t
  misc_feature (798)..(798): n is a, c, g, or t
  misc_feature (802)..(803): n is a, c, g, or t
  misc_feature (810)..(810): n is a, c, g, or t
  misc_feature (820)..(820): n is a, c, g, or t
  misc_feature (822)..(823): n is a, c, g, or t
  misc_feature (1051)..(1051): n is a, c, g, or t
acgggatattcattcatgtatatgtatgtacgtatcaaccagctggcacactattcatttattgagatcttactcataacaagtcctctgttatatactgcagatatagataaactaattccttccctcaaagagttcaattctataagaagagatagttatgcaagcccataaattgcaatattgaaaatttcaagtttgaaggtaatgctgagaggtaggctctcacaggtgtgatatgaaaagtgaagccgtaacattttgtacttctctaccccttttgtatctaggctaacctagcagaatgtggtagaagtgatggtatgaagttctggagtgtaggccacaagagaccttgcagcttccaacttttgtctttctggaacattcctgataccatgtaaagaagcccaggaagccgaggcaggaggatcgagcgcaggagttcaagaccagcctgggcaacacagtgggatcctgtctctaattttaaaaaaatgtaaaccacaatgagatatcactgcacatacccaccagaatgactaaaactcaagactgacggtaacaagtgttgacaaagacatgaagaaatagcagctgtcatacattgttggtgagaacacaaagtggaacaaccactttggaaaacagttttgtagtttcttataaagctaaatgtaatttttttccatagaacccagccactcaccttctagatattttctcaagaaaaatancncactgncacannnacntnnatatnantnttcanancactttcttcatantggccctnanctgnnaataacncacctgtttntnnactggagattgaccgccttctctgctttacccatcccccgaatgcttttctcttatcatccttctctcttacctctttattgtgttagttgatcattgtcttatgtctttgcgacagagcccgcaaccctatactctctatctagttccttcaccgaatcaccatcatcatctctattgcccctttaatcctccctcggtgcttatttgattttaaatagtcctctan

SEQ ID NO: 542830 - DNA, 299 bp, Homo sapiens
  misc_feature (180)..(180): n is a, c, g, or t
  misc_feature (221)..(221): n is a, c, g, or t
  misc_feature (240)..(240): n is a, c, g, or t
  misc_feature (291)..(291): n is a, c, g, or t
  misc_feature (296)..(296): n is a, c, g, or t
atgattttgaaaaaaaactcacactaccatgctaaaaagtaatcattttcatttattattttttacttatctgtgcacctatagcattgtacaaccctaagtattcaattttgtatccttatttcatctacctcatgcttttaaaatgtcccaatattttctctcctagtcttctatcanataaaatgtgttatatctttttacattttaatatgatttgnaaactaaatacactatggnaaatccttaaaattcaccataatttttcttaaaaaatagttgaaaatacanaaaantat

SEQ ID NO: 542831 - DNA, 258 bp, Homo sapiens
  misc_feature (98)..(98): n is a, c, g, or t
  misc_feature (200)..(200): n is a, c, g, or t
tgtagtattgaattttcttgtcatagaatagaagaaatgctaaagaaaaccatgcttattccatggctcttgacattgccttgaagaccttgctgggnagcggggtggttccgcttagatcattacgtaacgtgaccaccccaaactggttctgatggtgtgagcgggagagggaggctggcctacaccagagccacagnagtgtgggatccgagccgtgtctgtgacctttcccacagctcatggcaacgctggatc

SEQ ID NO: 542832 - DNA, 628 bp, Homo sapiens
ccgttgtctggtgtacatcgatccacatgatactttttgaaatcctgaatccataaattacactttttttttttcaaattcacaaaattcccagtggtgctgactgtgtactaaccactattgggaaacttcccgtaaacctgcctgttgccttgccatatggagtgactgccctgctcaccacagaacaagcatgctttgtgtggctggtcgactgccaccgtagtgcatacactttgtacatcaggggtgaagggagggttttctagattatagggggagggtaaaattgggatttttttgttgtccctttattgatgggatgtgggggtctagtcactcagcttctgccctaaaataacatgtataaaaacccctgaagtatagtgtagggtgtgtacgtgtgattgtgtgtaagaatacgtctggcaataaaagcttggtctactggaacttagtgaattctttcctctttttcctccagaagtattggtaacaaaatttgtaaataagagctctacttagttggtatacccatgaacatgtagcagcaaaccttatgcatctaatccctacaaggtaacagaaaggcttaagacttgcaggttaagcacagccaagtctcaga

SEQ ID NO: 542833 - DNA, 332 bp, Homo sapiens
  misc_feature (172)..(172): n is a, c, g, or t
  misc_feature (330)..(330): n is a, c, g, or t
catattttcttttgctgacttgtctcctgatttttccctaccacagcttaatccttctcatttcaaaacaaatgtgtaaagcaaagctagaaggaagagtctttagatgtttcttaaaatatacaaaaaaaggtagggggtgatgggaaaatcatcacttttcaagtaagtntgccagatatagctagccacattttccagccatcaacctgcatggttgtgcatcactcatagactatctgcagtttgcttgatacatttacacaaatctggatacacttagaagaatataaaatttccatatttacctatcttcaaatatatattaanta

SEQ ID NO: 542834 - DNA, 105 bp, Homo sapiens
tccctcgtactcaccgaacaggacctgacaagagtaacttagtacctttgccagaagtacttatggtgcaggtcaagaaagatcttaagactggtcattcaaagc

SEQ ID NO: 542835 - DNA, 158 bp, Homo sapiens
aacaacagtcagaatgttgacacatctttatgtcactgaattgaagaaaagtgtcactgtttttcctgtcaggttccatgtgcgcatcaatgctaatgggcaatctcagctaaatagactgctagaagttatctctaggtaaaatccagaccagacaa

SEQ ID NO: 542836 - DNA, 925 bp, Homo sapiens
tatttttttaaaagttgccttatgtggagcgggaacctgaactaatgcccaaatgcctgttttccttgagcctccggaagagctccacctgcccgggatgtccctggacttggactgactagaactttcctcgagactgagttgcatgtacggggcctcctacctggaggcaagagttggggcagttctatcagagctgtgcccaggacacccctgctgttgcattgtctgaagccaatgtcctgtgtctgcacactgttgccactgtccttgttgtgcttgctgtcgcctctccaggcccactcagctctgctccgccccggcccgcccagccaagccctgggaaaccccaagggcaagtttgcttcagactgttgtaaacataattggtcttgcctggtacacacttgtcctcagtgtgcacatctccccaatccagaacaaggggttgaacacccactgatgtccacagcttaggtctgtgtctaaccttaacgacctttgacctcaaggaggtggagaaaaggtaccattctctaagggtctggtgtggtctttccatcttattaccaccaacccctggaagccatctctgccacctctcattggccctgcctggatcaaggggtgagaggaaccatggctggggaatctacggttggtgagcccatggcagcagcactgtcggcataaggtaccgacttgctcacaagcaatggtgagtggactagatgcaagatggtgagctgtgtacaggaccagagggagaagaaggccagggggagacaggaccaattgccggcccggtgccacgccagcaggaagtggacccacacacttacacaagggagcaccgagcaggttgagagtagaccgccaccggggaaacgccaaaccgagcacggccacccaccgtgaggggagg

SEQ ID NO: 542837 - DNA, 402 bp, Homo sapiens
  misc_feature (267)..(267): n is a, c, g, or t
  misc_feature (304)..(304): n is a, c, g, or t
gggaaatctgacccagaccaaatgatgtctaaaaagtatctattacaggactttatagatggtcccaagaactaaccaccatagttcaacatcttggcataaaactccatgatctgaaggccaggcgcagtggctcacgcctgtaatcccagcactttgggaggctgagacgggtggatcactggaggtcaggggttcaagaccagcctgaccaacatggtgaaaccccgtctctactaaaaatacaaaaattagctggacatggtngcgggcgcctgtaatcccagctacttgggaggctgangcaggagaatcgcttgaacccaggaggcagaggttgcagtgagccgagatcgcaccactgcactccagcctgggcgacaagagtgaaactccatctag

SEQ ID NO: 542838 - DNA, 724 bp, Homo sapiens
tggcaaaaccccatctgtgctaaaaattcaaaaattagccgggcatggtggcgggcacctgtaatctcggcctcccaaagtactgagattacaggcgtgagccatcacacccggcctatgttatttctttgttaaaacaaaaatatcaagacccaacagtaaaatgacaaacaaggctaggcatggtggctcacacctgtaatcccagcacttagggaggctgaggagggcagatggcttgtgctcagagtttgagcatgagcctgggcaacgtggtgaaaccccatctctgcaaccaatttacacaagattagctgggtgtgatggcatgcaccttagtcccagctgcttgggaggctgaggtgggaggatcgcctgggcctgtgaggtggaggttgcattgaacagagatcttaccacggtactcgtgcctgagcaacagagtcagatcctgtctctctcactcacacacacacacacacacacacacagacacacacacacacacgacgacaacaatactcaaacacgcgtggacacagaggtactcagactagtgcactactcccgccagcacccgagaagaagtagacacgtagggcccacaaataaatgtgcgctgaaacgagaactccaacacacatctcaaacagcaacatgatgatgcatagcgacgaggatgaaaactggcaaccatctactgttgcactactgtatctaccca

SEQ ID NO: 542839 - DNA, 576 bp, Homo sapiens
  misc_feature (8)..(8): n is a, c, g, or t
  misc_feature (16)..(16): n is a, c, g, or t
  misc_feature (27)..(27): n is a, c, g, or t
  misc_feature (30)..(30): n is a, c, g, or t
  misc_feature (32)..(32): n is a, c, g, or t
  misc_feature (44)..(44): n is a, c, g, or t
  misc_feature (48)..(48): n is a, c, g, or t
  misc_feature (52)..(52): n is a, c, g, or t
  misc_feature (76)..(76): n is a, c, g, or t
  misc_feature (80)..(80): n is a, c, g, or t
  misc_feature (89)..(89): n is a, c, g, or t
  misc_feature (91)..(91): n is a, c, g, or t
  misc_feature (101)..(101): n is a, c, g, or t
  misc_feature (104)..(104): n is a, c, g, or t
  misc_feature (111)..(111): n is a, c, g, or t
  misc_feature (127)..(127): n is a, c, g, or t
  misc_feature (138)..(138): n is a, c, g, or t
  misc_feature (154)..(154): n is a, c, g, or t
  misc_feature (161)..(161): n is a, c, g, or t
  misc_feature (163)..(163): n is a, c, g, or t
  misc_feature (166)..(166): n is a, c, g, or t
  misc_feature (174)..(174): n is a, c, g, or t
  misc_feature (180)..(180): n is a, c, g, or t
  misc_feature (186)..(186): n is a, c, g, or t
  misc_feature (200)..(200): n is a, c, g, or t
  misc_feature (206)..(206): n is a, c, g, or t
  misc_feature (213)..(213): n is a, c, g, or t
  misc_feature (221)..(221): n is a, c, g, or t
  misc_feature (233)..(233): n is a, c, g, or t
  misc_feature (246)..(246): n is a, c, g, or t
  misc_feature (267)..(267): n is a, c, g, or t
  misc_feature (269)..(269): n is a, c, g, or t
  misc_feature (279)..(279): n is a, c, g, or t
  misc_feature (296)..(296): n is a, c, g, or t
  misc_feature (300)..(300): n is a, c, g, or t
  misc_feature (336)..(336): n is a, c, g, or t
  misc_feature (343)..(343): n is a, c, g, or t
  misc_feature (345)..(345): n is a, c, g, or t
  misc_feature (377)..(377): n is a, c, g, or t
  misc_feature (410)..(410): n is a, c, g, or t
  misc_feature (441)..(441): n is a, c, g, or t
  misc_feature (446)..(446): n is a, c, g, or t
  misc_feature (565)..(565): n is a, c, g, or t
tggttgancacagggnactttattganggnanaagaaaaggggnggcncccnaggcccccccccccttcaaggggnctanatggcaacngngagggggggngantcagtgnggggggggactgagtntgggagggacnccccagcagtgagggnctctctntnccncttgtgcncttgcnggggcngggggtccaggggncttacnccttggnggccatgngggccaagaggnccaccaccctgtngctgtggccaaattcgttgtnanaccaggaaangagcttgaaaaagtggncgtngagggcaatgccagccccagcgtcaaaggggggggngtgggtntngctgtggaagtaagaggagaccacctggggcncagtgtagcccaggatgcccttgagggggcccnccgacgcctgcttcaccaccttcttgatgtnatcanatttggcaggtttttctagacggcagggcaggcccaccactgaaacgttggcagtggggacacggaaggccatgccagtgagcttcccgttcagctcagggatgacctttcccacagcnttggcagccca

SEQ ID NO: 542840 - DNA, 134 bp, Homo sapiens
ctagctcggtaccccagaaatcaccggtctgggacacactttctgtcgtataaacctctttttatgacacgttcgtgcctgagctacctactggtcttcaggcaacgcgggtgccatccccgtacgttcatact

SEQ ID NO: 542841 - DNA, 211 bp, Homo sapiens
acacttagtccgatcacctccgtcgtccctggtgtgctggtcgctcgtctaggcggtttaggcgccatatggggccattcagtcgaataattcacataatatatatcgtttctttattaatggatttattttatgctaattactagcgcattcctactactcaacttaaactccaacacagacgatcgacatcttgtgcacctcagagagt

SEQ ID NO: 542842 - DNA, 468 bp, Homo sapiens
  misc_feature (171)..(171): n is a, c, g, or t
ctggttgtggaagtggcccatcccaaaataatccatgaatttggggcacaaatcctgcgccatgccaatctcttgagccttggtgtcaccatggccacacaccccgatggcttccggcttgagggacccctggttgcagcccacagccttgggccttgcattgtgctttangaaggccctgtccgtgggttttgcccctttgccccgggaaattccaaccccatggggggggttgccctggctgcccccagcttgggtttcaatggggtgattggggtgctcgtggttgataccagcctgctgccagctcccctccaggccggggatccatttttgttgagaagcctcctccctcccgagacaagatcatttgcctggcctttcaccccccccatcccacccctgccctgccccacttccccagggtttcccttttgactcagtaaagatccccgctgcctcccccca

SEQ ID NO: 542843 - DNA, 105 bp, Homo sapiens
cttttacccagtatagatgcatgtgactcaggacggcgggcaatgattgtggctttatgtgtagtctttcaactcatgaggcatcgtgctgcaatccccggtcga

SEQ ID NO: 542844 - DNA, 348 bp, Homo sapiens
gtagggactgttaaattgtaagtataagatgtagaatatgggagagtgaaaattgatgttgatggaggaaattatcccattaggaaattgaaagttgtttaagacaagacagattctaagatcttagatataaagtctaaggtcttagatttctggacttcagaagagttttagttgtttttcttacccttggtatccatttggataaaataaatctgtttcaagtcttctgagcatatttgtttttacttttctaggatcaggggggtttgggtattgctatcagcgaagaagatacactcagtggagtcatcataaaggaacacagagagggagaggtcacatctt

SEQ ID NO: 542845 - DNA, 646 bp, Homo sapiens
  misc_feature (497)..(497): n is a, c, g, or t
ggacggtgtggggcggtcccggccccgcatgatctcgttcctagactgcctgccagcgttctcggccgtgcctgaggatggacccaggagatcccgctggtgaccctgcctgctggcgagcgccagcggatgggccaggaccccctcctgctcctgcaggccctgcagaccctgtggtccacgcgggagcggaagcagagacggagtcttgttctgtcgcccaggctggagtgcagtggcgcggtctcggctcactacaacctccgcctcccgggttcgggggattctcctgcctcagcctcccaggtagctgggactacaggctccactatgctggctagtattaaagtattatagggtagagacggagtaccgcatgtgtagcacagacttgtcttgaactcctgagctcaagccatcgggctgcctcgtcttctcaaagtgctgggattccgggcgtggccactgcgccttggctgatgccgtgtacctgcatnttgcccaccgactctcgtgtgtcaggcctgtaaccacagttgcaccgctcagtcaggtcgcttgctggctcacagagtccagagtcccgagggaccagagaagctgcctttacaccctgtctggccagcttacccgaggagccaatcca

SEQ ID NO: 542846 - DNA, 302 bp, Homo sapiens
gtgctgtctgttggtcgtacttcagaggtatccccctgtccacacttgtgcttgtacctgtcatcactcttggaccagtgcagtttataagctccttcttgtgctgatgatatggacgtctatttattttccacagttaacaaatctttatctcctcttagagccggcgctcttatggtgcgccttctattacctcgaagaattggcggttttcccttgcgccacagggaaggggttccctcatgccttggccctagtctccccttgatcttccccgagagagtgcatgtgcaaaagacggg

SEQ ID NO: 542847 - DNA, 832 bp, Homo sapiens
ggttggtccttagtactgtcggtcgtgtgggtgacgttggctgccggtgagttgggtgccggtggagctcgtgttggtcctcagaatccccgacgttagccgctgcctcctcctacacctcgccgtgtgtcttacccggtctgagtacgacaggggcgtgaatactttttgctcccgaaggaagattgattgtcatggtggaatatgccattgaggctatcaagcttggtgtctacaggcgcatagggatccaggacatcagagggtgtgtgcctagcatgtggcagaagagaattacttccccactgatggagaccgagcagtacttgagaaacagtagtcagagatggatgctcacttagtggtgtgtgccatgagtgggctacttgctcgatgtctaatgactttattctgataagtgctcagagtggagatcacctgatagccactggttcacgctacaatgagacgatgacagtggacgagttgtgacccaagtctgtgtcccagtcgggctttgcagtgggcgaccaggatgcaggatccagggtgcactgtcttcgtccttcggagatagcactgattattgggaggagtcgatgagaacaggtgccccagctggttcatatgggcccatcgtgcgaccttgtacaggtgatgctcgagcagtcggtcggtccagaggggagcccagaggttcttgcacgagtttcccatcagctatgactcgaacgaaggcgcagtgttcatcctcctctcccacagttatgggggcacctgctgcccacgttggtagctcgtgcgttggcgaattcctgtccacggggacgcg

SEQ ID NO: 542848 - DNA, 207 bp, Homo sapiens
  misc_feature (32)..(32): n is a, c, g, or t
ccttgggggggggggggttttgggcccccccnaaaacaaaaaaaaagcttttccttttttttgggttaaaatttgggggggcggggccccccccccccccgggttttttttttttgccaagggggttttgggggggcccccctttttttttttttggggggcccgggggggaaattaacccccccccgggccctggggcccccggga

SEQ ID NO: 542849 - DNA, 232 bp, Homo sapiens
gcagtgtgtcttctcagtgtgatcactgttgctttgagtgccagcttgcaccttgaagccccctgctcaggactcaatcagttcccttcactgcccccagccctggagggcagctacgattctctttttttttttttttttggaaacgggttctcgctctgtcgccaggttgattgcaggggcccgatttgggctcactgcaccctccgccctccaggttcaagcgattctc

SEQ ID NO: 542850 - DNA, 662 bp, Homo sapiens
acggaatagaatggaatggaaccgaaatggaatggaatggaatggaatggaaaggaatggaatggaatagaatggaatccacccgattgcaggggaatggaatggaatggaatggaatggaatggaatggaatggattcaacccgaatggaatggaaaggaatggaataaacccgagtggattggcatggaatggaatggaatggaatggtatggaatagaatggaatggaaagaaatggaatggaatggaatggaatggaacggagtggaatggaaaggaatggaatggaatggaatggaatagaatggaatggactggaatggaatggaatggaatggaatggaatggaatcaacctgagtgcaatggaatggagtggaagggaatgtaatgaacggaaacaacacgaatggaatggaatgtaatgagtgtaagggaattgaatacaatcaatccgaatgtaatggaatggaatggaacggaatggaatggaatgcaatggaatggaatggaatgaatgaaatggaacggcagggaatggaatggaatcaacccgagtgcaatggaatggaatgaatgaatgaatgaatgaatgattcaaccgatgatgaaaggatggataaccgagtggatgcatggatgaatgatgaatagaatcaac

SEQ ID NO: 542851 - DNA, 1051 bp, Homo sapiens
tggaaacaaaatttcactctgttgtggcctaggctggagtgcaagggcttgctatcagcctcacgtgcaaccttctgtgcctttgcaggtgttgaagcggattctccgtgcctcagccctcccaagttagcgtggcatttacaggcattgcgccaacaagcccggctagtttattggtatttttatagtagaaagcgggattttctctccatgtgtgtggctcaggcgtggttctctcgaaactctccgtgtactcctcagggtgtgtactccctcccgccctctctgtgccttcccaaaagtgtgcgtgggtattatacaggggccttgtaagccatgtgtgtgcccgcgggccataaatcttgcggatattttttatagtatagaagaagacggggtgttacaatctcgcgtgtctgtggtctcagaggtgtgaatcttttgacaacttcacgcgaaccccaccgagggggcgaaaatcccaccacgcgggcctctacatttcacaacacacaaaaaatgtggtctatgaggcgaaccaataacaagcgggacatattgtaacgcccaacgacaaaagacctgcgggacacagaattatataacgccgagactttatacacaagaggagcagtgtgcccacacaaatgagacgccattgtgagtgcgcaaagtgtcccccgatcagtagtctcacaagtggagaccacaagagaacgcacccaaggagggggtagaaaaacccacagtgtgatggggctcctcaaccagacacaagaagacgaaggtgcgcaacatactaccaggaggaaacccccccaataacgacgtaggagacaacagatgtgggcacaactccaaacgaaggacatacaaccaccaggggggagagatcatccattaggtcggaacggatcagagcggaacagaacgaattcaggacaacacagcgagcagaaaaaaacccaacagccaaccatcacaacgacggcaccagcccccaatgcaagacacacccagcaccccatccgacaaatatatgggatccaca

SEQ ID NO: 542852 - DNA, 490 bp, Homo sapiens
  misc_feature (95)..(95): n is a, c, g, or t
tagccgtcatacatgtctgatgacaaggagggtcttcttagaaatcataagactgatacttctgacagggactttatacttgtacagtaaaaaantcagctggatctgtgtcctctagctgcaaattaacaataaaagctataaaagatactgaggcacagaaagtctctacacaaaagacttctgaaattacacctcagaagaaagctgttgtccaagaggaaatttcccacaaaagccctcaaggtctggacagaaattcaagatcgtcagcaggcacaaatctccaagcaaaagttcagccctctaaagcaggaagcttacaaaggttctagatttctagaagaagtcaagcaaatccagcagcaaacctcccctggcacaaaatcctattggtcctatgcaggcaaatccactcaaatacatctacagcgcatccagcaagcaagtccagcaactctattgctcgagcattcacaagccattattc

SEQ ID NO: 542853 - DNA, 591 bp, Homo sapiens
ctagaggatcccgtcaccaggaccagatcgaatgccataaggacctacatctctcctcttaattatttctgttgttgtgatttcagtttcggatgtttctatggtgatttaattcaatagtattaataaccaactgaaatactcagagactaaaaaggtacatctggtgctttcaaaaagagacacacgtggaataaacttttggaaacacctgacttaattaacaggatcactaacatctagcaggatcactgctagactgcaacaatactgagcttcttcctcgctgcaaattcctaaacgaaacaaaatgctgctgggtatagctgagctcctggtggcaatactcaatcaaaataataaaaagcctaggacagaagcagcaagcacaggcctccagaagtcttagtttaaatttttaattaaacaatcataaatatcttttaaaaaatgtagactggttcacacataagtgactcactttataatctgaaccttcccttctggcccctgggattttatagcatgtgccaaacttcaacaaagctgtatgtgaaaaaaaaattttttttaagagacaggtcgatctgt

SEQ ID NO: 542854 - DNA, 178 bp, Homo sapiens
accagcttcacaggctcctgtgtgagatgcatcagagatcatggctgttaacactagcaggatatgcacaaacagattggatccgcgtggagactgccagtactcaagagcagcatggaccatcgatggaaaaatattaaattgatcagatggagatgtttgtgctggagggctctgt

SEQ ID NO: 542855 - DNA, 261 bp, Homo sapiens
ggacaaggtttttacatgttacagaaaaatgttaggacagtaggattctcatatatcctgtaccatctcccccttttattaacatcgtgcactggtatagtatatttgttaccgttaatgaactgaagtttatacagtgtaattgactgaagtccatactttatttagacctccttaatttttaccaatgtcctttttcttttctttttctttttttttttttttttttttttagggaaaagccctgtgggcccgcggggg

SEQ ID NO: 542856 - DNA, 182 bp, Homo sapiens
tgattctagaggatccgtcatttaggtcattgtctgtatgttgtttccttgcaaaagtgaacttgttggtcatggtgtggccccggagtagtgctgggaccaagtgaagtcctgcccatcctgctgcacctccgtgacgatcttgaagttgcgggccttttcgattacatcgctggagatcc

SEQ ID NO: 542857 - DNA, 163 bp, Homo sapiens
tgacatctacggatccttatcgattggcgggcacttatgcacgcttatacatcttaacaagctttgacgtgcgagagattgaagagttcaaatctgagccaagatgttgatgttggctatgagaattctctgctccccacctctaagttgcccgccaatcgaa

SEQ ID NO: 542858 - DNA, 296 bp, Homo sapiens
  misc_feature (2)..(4): n is a, c, g, or t
  misc_feature (6)..(6): n is a, c, g, or t
  misc_feature (30)..(30): n is a, c, g, or t
  misc_feature (40)..(40): n is a, c, g, or t
  misc_feature (48)..(48): n is a, c, g, or t
  misc_feature (58)..(60): n is a, c, g, or t
  misc_feature (69)..(69): n is a, c, g, or t
  misc_feature (71)..(71): n is a, c, g, or t
  misc_feature (90)..(90): n is a, c, g, or t
  misc_feature (95)..(95): n is a, c, g, or t
  misc_feature (102)..(102): n is a, c, g, or t
  misc_feature (118)..(118): n is a, c, g, or t
  misc_feature (154)..(154): n is a, c, g, or t
  misc_feature (170)..(170): n is a, c, g, or t
  misc_feature (200)..(200): n is a, c, g, or t
  misc_feature (210)..(210): n is a, c, g, or t
  misc_feature (212)..(212): n is a, c, g, or t
  misc_feature (217)..(217): n is a, c, g, or t
  misc_feature (230)..(230): n is a, c, g, or t
  misc_feature (232)..(232): n is a, c, g, or t
  misc_feature (248)..(248): n is a, c, g, or t
gnnntnaaactataaacaagctatctgtgnagaagcttgnaatatgtncattcatctnnnagatataancntgtattttgattccctggntgggnacactcnttttgtacagtctatnaagaaacatttctgagtgcattgaggcatatgttgnaaaatcgaatatctcntgataaaaactaggcaggaggtatctgtgnaaatgctttnanatttntgggtattggccncncagagttaaactgttnaatcaaaagttttttttttttttttttcagaaacaaagcatacatcat

SEQ ID NO: 542859 - DNA, 168 bp, Homo sapiens
atgcgatgtgatctagaggatccctttcctctttctatggatgttctctgcacatccttaggtaaaactcaaaaattactatggagattttggcaggaaccaaatgagacaggaagaaatgttttaaactggcggtctaacctctaataccagggaggcccaacaggg

SEQ ID NO: 542860 - DNA, 150 bp, Homo sapiens
ttcatagtgtgcacacgatatcccagctacttggaggccaggtgggagggtcacttgaggctagaagtttgagggggcacacagtgagaccctatctctacaaaagaaaaataaggccaggcatagtggctcacacttataatcccagca

SEQ ID NO: 542861 - DNA, 950 bp, Homo sapiens
gggaaggggtacctactcattgaacctggtagtccagcccagctctgtctatggagatttgagcctgcgaggaggaggccagaaatggacagcgcagggggggatatcggactgagtctacagtgtgtcttcacagatctgcctaacttggatgccacgctggtgtggacaggactgctgaccccagtccggttgcccatcctatcgcaggtccattcccatgtgcactcgtagcaaaggacccgtggtcgccctcttattcctctaggcaagcagagagctggtcgatcatggtgagatatggtgcatgagaagctggacttagtgtgggcccctcaacagccaagtgtgaccccactgccaagtggggatggggcctccctccttgggtcattgacctctcagggcctggcaggccagtgtctgggtttttcttgtggtgtaaagctggccctgcctcctgggaagatgaggttctgagaccagtgtatcaggtcagggacttggacaggagtcagtgtctggctttttcctctgagcccagctgcctggagagggtctcgctgtcactggctggctcctaggggaacagaccagtgaccccagaaaagcataacaccaatcccagggtctggctctgcacttaagagaaaattgcactaaatgaatctcgttcccaaagaactacccccctttttcagctgagccctggggacttgttccaaacgcagtgaatgtgaaggacagtgggggtcttcgggggcgaagctccctcaagctcagaggaagtctaccctgtcctgctttggttgaagggttgggaacaaactggccttttcgtgtgttctgccctttttgtccgagtggcactacaatttccccgaggcttgggcttgcttatataaggcgtgtggggcgccctctaacacagccaagcggggagaggactg

SEQ ID NO: 542862 - DNA, 366 bp, Homo sapiens
tacccagctgtgaaaaattatgaactagtgataaatgcaaatacatgaacaaatctcaaattaatactgattgaaagaagccagagacgaaaaagtacatactgtatgattgtatttatataaaactcaagaaaatgcaaactaatctatagtgagaaaaagcagatcagtggttgcctcgtaagagaaatgggagaaagtgttgagggagaggaaggagagattacaacgggactcaaggacaagtttcatgtttgcagatgatggatatgtttactgtcttgacatgtatacatatatcaaaacttctcaaattgcatactttagatttgtgccgtttatcatctgtcttttatacttctataa

SEQ ID NO: 542863 - DNA, 801 bp, Homo sapiens
gatctcggtggtggccattgcgcagaccagacttcggtcgtactcgtgcgcctcgcttcggattgcctccgcaagcgatgtctgacaaaacaccggtatggctgagatcgagaggatgcagatacagtcgaatctgaagaggcacagagacgcaagaagagaaatccacgtgccttccaaagcaatggattgaacaggagcaagtgagcaggcgaatcgtaatgagggcgtgcgctagccatctatgcgcgtgtacattccacaagcattgccttcgtccatcttgacttcttttagctgtataactttgtgaagatgcgacagaggttgcgatcaagtgtctacaggtgactgtgctgcccctttcacatcaacagaacgtactgaacgaacgaaggcgggcctgccctttcccatcgtgtcgtatcttatctggctggcagcgccaggaaatgaacttgcaatgtcggtgaaggaagaagtggggtggaacgaagtgggggtgggactgaggtgtgaaaatcctacgagtaaaaccaaagctgggcccaaggggtgtccgtgcacggctgtaaatgcatgtttaactccagaaggtgccagtgggcggggcggcgccgtccaagagtgattttccacattgctggggagagtgcccgaccttttgggaagttcttgccttaacacaggtttgaggagcgcttccacacaaaaaaaaacgcgccgggagatgtgcgggggcgcgggggacccccaagaagggttttaagccacttgtgggccggccccaggttagggact

SEQ ID NO: 542864 - DNA, 201 bp, Homo sapiens
cgctggcccgcacttccacaagaaaatcttctggccaatcgaaccaccaggttgccattgcagtgcacagggcggtcacgggccccttgctggctcgggctcgtgaaaggacttttgaacttggtcttgggtcaagggcttggccaggctccggcaaccacctgcaatgcacatgccatgaatgcaatgatgccggcctgc

SEQ ID NO: 542865 - DNA, 127 bp, Homo sapiens
ataccgagcttagtgtgcggtgtgcatgtctggtgtagtgggtgcttgcttgtccacagtgtgtgctgcgtgttgtgtgctgtgagctgtgtcatgtatgtgctgcgcatagtgtgtgtgctgtgtg

SEQ ID NO: 542866 - DNA, 343 bp, Homo sapiens
gcaacttgagccgcaacaggtggagaagcagcatgttccaactcggaagatacattgaagggggctccggccaccggcgtaatagcagttcaaactaaatttttggtatcaagtccctgaacggaagtatgacgtcgggtccctctgaagtacaattctgagttctcattaaaagaaattggctttcatggtgtgatttcttaatggctatgcttcgagaatcaattggtgtattatgccctttcccccagcatggtagagcaagtctggcgctcacaagcccagtgtgacagtgtcatgatgtagtagtgtcttacgggctttttaataacatcctttggta

SEQ ID NO: 542867 - DNA, 419 bp, Homo sapiens
gtctggttctcctggagctggtttctcgaggctcatgacatgtatagttttacagactgaaagaggaagtaaatgagaatctagctatgttctattaagcgagacattaaaaagatttacaagaaatgcaaaaacaatgacacttttctgactacttttttgctgttgggaaatagttatttttcataaaaaatgctattattggccctgcgcggtggctcacacatgtaattccagcactttgggaggccgaggcgggtggatcacctgaggtcaggagttcaagaccagcctagccaacacggtgaaaccccatctctactaaaaatacaaaaaattagccgggcatgttggtacacgcctgtagtcccagctgctcgggaggctgaggcagaggaatcgcttggacctgggagtca

SEQ ID NO: 542868 - DNA, 128 bp, Homo sapiens
tcggcctcttatcttctaattacatatctttaatgttacggtatacttgtataccatggagaaaataagtgtgtactcccaagtgtctgaaacaaacaaatttatttcaaagtcttgctggtgggaag

SEQ ID NO: 542869 - DNA, 1586 bp, Homo sapiens
cgtctgcggtgccaaggacggctcttggctccttcgggaaatccagccccgttcaccgtggctcctgatgcggctcgcatggctgcagcgacagccgggcttcgagccccgggcaggcgcaccaggcggggggtatgcgagaaaagccgtgagggatgtccggaccgcgtggcgcgcaacgaggaagcgtgctagtccggtacggcacgagtgccagcgcgtgaggaagagggctcgagtagagaagccaagtggccggggtgcaccaggcggagtcaggaccccttggaggaaacccaaccgagtagagcccccaaggggcggggcagaaggccctttcccttttattgacggcgcgttcgacggggggggcgacaaccacggcttaagcggggacagaggttcataacccggtggttggtggcctaacgaattccgttggccacgcttccctgttggggggccactcaattgggagggggtgggcaaatatcagccgcgaggaaacgccagggtgtgtgtgtccattcctttagaacgctcgaggggaattacggcttgtaattaagccgggctggttccgtgtttaccctttcgggggacgagcaataagaggcgggccagaagaggcgcccctttggaagggggggccccaggggttccaaaacttttttgtggacccaataccgcgggggatttgcccccttttgtgggaaccacatttgggacaccttccatagtgtccttcagaaaaaagcggtcgttccaaaagggaagatttcccacctttgcaggcgggggaaaagaccattgtcccaaggattccgcccgcgggtggtaattgcaactttttggggtcttaccccaaattccccccgggggaaaggggcaggggcacgaagcatggtttgtactgtgggttgtattattcctccgcggacaaagaaaccggtttgggctggccttcctttttataggaaagggggggcacttccctgtgggcccttcttcataaacttcccccgcacggggaagggtgtaccgaaagaacccctgtgtttccccaagagaaattagaaaacggcttttttgtgggtgggcgaattacaacacgaatcttggcggagaacaccccccgtgggaattcctattccacgccgccaagaagggatatatcagggcggaaccacattcacggaggaaaaagaaggcgccagggagcaattcttttggcacagccaggagattttatttacgtcggtccaccagcgtcacaaatttatagcgggtttctcgtgtcacaaagaggcccagtaggcccttttttggaggggagaaaataccgtgggcgtgcggcagccacaccacgagaggtattttcctagcaggggtgggaagtcaaaccccctcaagagaggggcgcagcacaaacaactcttcgtgggcgcgagcgatcacaacccacctatctttggtggcctgacacatcacgcggaggacactctactagaaggagagcggcccgcccccacacacgagtcgaagcacacttagtcgttgtcaaccaggcagagagaccactctag

SEQ ID NO: 542870 - DNA, 337 bp, Homo sapiens
gagcggccgcccgggcaggtacaggggaatggaatggaatggaatgcaatggaatggaatcatccgtaatggaatggaaagaaatggaatggaatggaatggaatggaatggaatcaactcgattgcaatcgaatgaaatggaatggaattaacccgaatagaatggaatggaatggaatggaatcaactcgattgcagtcgaatgaaatggaatggaattaacccgaatagaatggaatggaatggaatggaaaggaacggaacggaacggaatggaacggaatggaatggaatggaatggaacggaatggaatggaatggaatggaatggaatca

SEQ ID NO: 542871 - DNA, 87 bp, Homo sapiens
tagaggatcccctatgaacacttttgtaatcactttagttctcatcacctctttgtatacaaaaactactttcaaagcccccccgcc

SEQ ID NO: 542872 - DNA, 264 bp, Homo sapiens
agcagtctacaggaacaggttctagtaaaagtatcactaaggttgaaggcaggagagtaagtctgggactataggttgggagactgtaaggcgtggacaaaagcaagaagagtataagcaaggtaaggaatgaggggaaagtgatgagtatgaaagaggaagtgacctgtgagaatcagacctctggactatggtgacttcgcttctctcctggactcagcacctctttgctgtggtatcccacaagttattactgcttggtgg

SEQ ID NO: 542873 - DNA, 948 bp, Homo sapiens
agtggtttccaccattttttccgggcccccttggatggctgacgctcccgtcttctcccgtcttgagggaggccctttgtctgcgccctttgctccccgggcggatagtgcccctgccgtttttctgccccagcgggtagcccctgcccctgtgtcgagaggcgtttttgtccaaccctcggccctttgtgtggtgcgtccccccgccctctttttgctgcgcgggaccctcctgttcataccacacacgggggtctatactgactccttgtcacacacggggggggttttcccctcccctgcacggggtcctccgctggccccctcctggaggactgactgcagtactttctgtccccccccccctcttcttatgcccgcttgctcgctccccccgcggccccactctactttttctggtcggtcgtgtaggcattattttcgacgacttttttgtgttgccgccgaatctgcagccgttcttccacgatccggccgttcttttttaagaagggggcgagacatatcctactcgtttcactatagggagggcgccccccccaaccaggccctgttattagaggaggggaagacagcccccccccctttctgcggcgtttttcttgtgtgtcgcttcttctctccttggcagccccccacgatgcaatgtggtgggtcccacgccacaccccgtctgtgaagccacctgggggtcacaagttgctcctgggagcacccctcccccccccgagtcagtgtgtctgggaggagaaccctcagcccctcccctgcacggcacccatcttctggtggtatgcactttcccccgcaccaccgccaggaggtgttcccccccttaggagcctttttccccaggaaccccccttttttccctttccttttttaaaccccaaattttttttttttaactttttccttttccttata

SEQ ID NO: 542874 - DNA, 446 bp, Homo sapiens
gtagcaaggaagcagtaagatagagggagggaagggcaggagatatagacaggttagaaagaatatgcgcgtggtgaatataaggaagacgaacagatagataggaaagatgatgaacacgagcagatactggtatagaggtatagaaaaagacacatgcgaagaaggaaagggcagagaggcagcagataagtagaaagagcagacggacgagagatccaggatggaaggcaggagcgaaaaggaatgagcgaagtaggatccaggcaaggtcgggcgagagggattaagcggctttagtgggacgagtaagtgagtagatggacatacacgcacgcgtaagggcggcctgtgaatgtttggcaaacaaggacactcgcgctctctctctctctctctctctctctctatctctctctctctctctcgtgccgaatcctgcagcc

SEQ ID NO: 542875 - DNA, 1250 bp, Homo sapiens
  misc_feature (1146)..(1146): n is a, c, g, or t
catcatttttggggctgcatagtaggattgcaccacctcccccggggggtgtgttgtgcctttattatctcgtcgatggttgttgctttctctccctcctttaccctgccgcccgggtcggaatcactgctcgcgtgcgtcgcgcgaagtctaagtgggtgggccggccccactcctctatttttttttattgtggccctctacctagtcgtggccgcctcctctgacgtatgtgttgtgttcctaccctccatctggcggccgctctgtcggtgtgggctgacatctacctcacccctctctttctctctctgcgagcggggggagccctcgcctctctctcactgctgtggtttccccaccactgctgtttgtgtcctccctctcccgctctctgccgccagatgcaatgatacccttcctccgtgttgccatccctgccggcgctcgcttctctatgaaaaagagagacactgtcgttccccctcctctcctctgcaggtgtgacgcaccacctccgccgcctccgcgtcacgcacttgccttttcggtggcggtcgtcccccacccccccgcggacgggagggtgctttctcgctctcctctttcccccccctctcgtcgcgctgcgagagagagtagtaagggggggcccgacccccccctctcgtgggcgaggtgacactatacgatcgatgcgcgaccccactctcgctccccctctctctttctcactcctgcgccaccgcacacgtgagggcgcctcggcgcgctctctctctattctattgtcttcgctagcgctcgatgccagcgtcctcccaccactctctgtctcaccgagagagagagagagcgccccactctctccgcctctcgcttgtcatctacccgacgcacaccacaccacccgcactcgctctctcgtgtgcgccccgccccacacacaggcgcctctctcttatccgcccacccctcgtgttgtggacggctataatcttctttggtcgctccacccacgcctgcttgcactccgcgcgagcgcgttctcttccaccaaccaccagggtcaggcaggtgtgttgtctgcccagccggtggtgtttgttcagccctccctccgcgtcggtatttgtttttttagantagcgacagttaaatccgtcgccgcctcttttttttttttttctgccccccctttttgggggcaacttcgtgggggggaaaaaaatattttttttttcccccca

SEQ ID NO: 542876 - DNA, 1808 bp, Homo sapiens
cggaacgaaggtaggcgtggtgtgctgctctccgttagtggtacctttgtctctcactgaagcagttgtcgtttctttgtgtggagcaatcggtggtgttctcttgctgctggggatcagccacccagagtgactgtagcgcctgttgctcatgcttctccctcgtctacttgagtggtgggtcgatcggccggtggtggatacacttctctctcgcccgcagataagtcgctgcttggatgtgcgtccccacacaacaccacaccatcggtctggttttttgttggtcgggagaggccccatccacacccaggttgtgtgacctcccctgctaggcacgtttggttcgcgaccacagacagacgggaatgttactccccaggaacgcgggtggtgtatttatctccttgtcgccgttgttgggggtatgtactcccgtcccgtcctccctctcctgtgtggaggtttctctactgatgaggtcactccgttgggggtcggcgctccttccctcttgtggggcggcccacacatatgttagttttctcctccgcgtgtggtgatagttgactgtcgcagcggcgatcagtccatacataataatctacgagggtgcggattacgtactgagttgtgtgtgtgccacagcccacgcgcttttgttctcccatgagacagccaaacaaaatttttgtggtgtgtagtgttcatatacgccggaccggcattcccacgcgcggggggtatgtttgtatgtgttcgacgagagttgttcttctggtggggcgcgctcgctctgtctgctgatttagttgggggccctctcctctccgccccctgaagattatgcggtgttttttatgtttagccccgcggggcatctttattgggtcagcgctttttaagtggtgtcggggtgtgttgaacacacagccgacgccggtgttgtgtgttgggtgagccatagagaactacagctgtgagtaacttttgtgtggcgcgcacacaggggggtcgtcgacccagtgaagttgtggtgggagattttttggcacacccatctagcgctcttgtatatatattggttgtgttgtagttatctgtgtaggggtgttttgtgttttgtgtggcttttttttgttgttacgcttttttttttggcgcgctcgttgaaacctctcacagcgagctgtgtttaataaaactcctgtgggaacccccgtgtaaaaaggggtgtaaccacacacacacttcgcggtttgggatacccgaggcaattctccgcccccaaaggtgtgcaccccacagggtggggccccagagggacactttttggaatgtgcacacacattgggttgtgttggttctgtaaaatatagtcacattgccccaaatattggaagaattggccgtgtgtgtaccaccggaaaagtgcccctctggccactgctctcgatataagccacccccccactttctcctttctaaagaggagaattgggcccacagtgcctgtctgtcccacaagtgccacacacaacaggggagaggtgaataaccacttgcgtcttccgtgtaaatatatagtaaagccaaatattttttaatatcttccccctaataactctttttatatttcttttaatttgaatagatagaacctcttctggccccccctctgccccctcttttttgcccccccacttgagaagtatgaaggcttttggtctccctgggaatggctggagcccacccgggcttaccgtgtaccctgaccttgagacccggttgaaaataaaggccacccc

SEQ ID NO: 542877 - DNA, 723 bp, Homo sapiens
  misc_feature (439)..(439): n is a, c, g, or t
  misc_feature (516)..(516): n is a, c, g, or t
  misc_feature (542)..(542): n is a, c, g, or t
  misc_feature (629)..(629): n is a, c, g, or t
  misc_feature (638)..(638): n is a, c, g, or t
  misc_feature (644)..(644): n is a, c, g, or t
  misc_feature (657)..(657): n is a, c, g, or t
  misc_feature (674)..(674): n is a, c, g, or t
  misc_feature (693)..(693): n is a, c, g, or t
aatccagcaaaacattactaaaacaaagtttgtagcaaggatttcccatttctgctctaaacagtacacttaaaacattctgatgtctcatgtaattctctccccctggccctttttgagtctcctccaaacagtgcaatatgaatgaaaaatcacttttctctaggaaaaactgtgtgcctctagtgaaaggcctaaaattagagcagaagagaaaactaatgcacagcaatccaaaattactgatcactgatttctacttgaaagcagtcacaagttgagcattctattccaaaatctgaaatcaaatccaaaatgctccaagctgaaactttttgagcctgacatgataacacaagtggaaaattcacacctgcgtcatgggacaaagccgaagtcaaaatgcaggccacccacacagtttatttgtgttcccaanggaaaaataaaaaataccttcaggctatatgtttaagtatagatgacacataaatgaattcatgtttagacttaggnccatccccaagatttctcattatgtntatgagaatattccaaatcaaacaaaatatttttccaaatctgaacattctgatcccttttttttggataacggatactcaccttgnttaaatcangctgcnttgcatttggaanggatatgactaaacttnaagtctaacctcattttanacctgaattttggtggaagggcttactggg

SEQ ID NO: 542878 - DNA, 103 bp, Homo sapiens
tgagctggaccgccagcactcttttcttcatcctgtccatcattgtataactatttattttgagacggagtctctctctgtcacccaggatggtgtgcagtgg

SEQ ID NO: 542879 - DNA, 375 bp, Homo sapiens
cgcgaaggctactgtgacttggtctccagctagagccgtctgatgtcacaattcccctccatttcagctgcacagaatgcgagctgaagaactcgtacttgaccctcatgttaacaatgctttaagctgagcaaactagtcgtgaagcactatgactttcacattttggaacgggcaggttctcagtaacagccacctttgggagccttcgcctttatggttcccctgccgtctcccatctttgattggcttggtatcgggagcttctgttaagcattatagagactcctaggatgtgtgttcatggcattacagcttctgaagaaaggccagtgatccagcagagggggaaaaatatgcatttcaccccacatg

SEQ ID NO: 542880 - DNA, 885 bp, Homo sapiens
  misc_feature (1)..(1): n is a, c, g, or t
ncctgtacgtgtggatgatctaagacagactcctggtgtcttagagaccggtctaacaggtgctccttttgggcggtggtcggcatagagcccttgtatgtgcctgtgcggcgtgtaggcgaatattttttgggggccctttgtgcgagcccgccccttgtttgggggaaagcaattgtggtcccacacgccgggggtgtttccaaaagggacctctttggaccgagaatgtggctttgaaagccggggtctcttttcggttatgacagcactggtggcgccaacacactgtgtttcgtaccgagaggtggttcttgttgtttattgcgcccgtgcccggccctctgtggcagaaataacggtctccgggtaaactgcccccgcgcaacgccggttctgctttcttgtgagaagtcaacacgcccgcgggttcgctgcttgtgcacaaccactcggggtcacgtgattggggcgaaaatatcgttattctgtgtggtcagaatcccccgccgtgttccccattccgggatcgcttcaacaataggttgtttcatcttagattttttcctccgataaagtattgctgttgtctcatccgtggttgatcgccccacagaaccctcctcccttgaaaccttccaatccactgtgcttcattgagtgaacatgtcaagatctccttatcctttaccccctgttgaacccccaggccctattctatacacactctcttcagctgccgcatcacataaggcgccaccagcttccaacatcaggagcgaacatatcttgcaacccccaaagagcagtccgcagaaggtgtccccctcccatccaccgattttatgtatggttaaaaaaacttttgtttcaacccccaaaaca

SEQ ID NO: 542881 - DNA, 908 bp, Homo sapiens
  misc_feature (4)..(4): n is a, c, g, or t
  misc_feature (65)..(66): n is a, c, g, or t
  misc_feature (102)..(104): n is a, c, g, or t
  misc_feature (107)..(107): n is a, c, g, or t
  misc_feature (111)..(111): n is a, c, g, or t
  misc_feature (113)..(114): n is a, c, g, or t
  misc_feature (147)..(147): n is a, c, g, or t
  misc_feature (150)..(150): n is a, c, g, or t
  misc_feature (154)..(155): n is a, c, g, or t
  misc_feature (180)..(180): n is a, c, g, or t
  misc_feature (211)..(211): n is a, c, g, or t
  misc_feature (228)..(228): n is a, c, g, or t
  misc_feature (237)..(237): n is a, c, g, or t
  misc_feature (240)..(240): n is a, c, g, or t
  misc_feature (273)..(273): n is a, c, g, or t
  misc_feature (359)..(359): n is a, c, g, or t
  misc_feature (524)..(524): n is a, c, g, or t
  misc_feature (699)..(699): n is a, c, g, or t
  misc_feature (766)..(766): n is a, c, g, or t
  misc_feature (882)..(882): n is a, c, g, or t
tggntttcctttctcatttttgagtagaattggcgctctagtagtcaaaacgcccctcaagttannagcctcccttaattgttcaggatccgctggtggggnnnggngggngnnggcgcacatggtctttcctctggtatttgtttnggncggnnaccttcttgttgggccattgtctgngcaggttttgatggcatgagggatacaatangttggccattgtatganaggggggcngcngggcctgagcttgtgcccttgtcactttctgtntgaggccaggggggtggggcttgatgacatctcctaacaatacccacatgcacatctctgtcatccttaaatcactgagtcttggncttcaggttctccttgtgccggtccacaagggaaccaacccactccaccgttttctgcttggcttcctcccagctgtagagtggcttatacgccaaatctcgctgggccttcttataagagaaggtgaatacgctatttgacaatgtgactatgtggcggttgangggcggtcgataggtgtgaattggcctgagtaggaagctcactatttccagcaggaagccaatccaatacatcagggataaaggaaagctccatctggaatcaaggcggaggccgaactctttgctcagggtgtaattaaggttatcatagctttggtgaggcgtgtcatctganaaatagtagaactgtcctcggatgcttggagccttcttggggtcctgcagggccctcaaggccagantgtgggcccaggccacattgccaacatagactgggttaacagtggagaactttccaacacttgacaggatcccattgttgttcagggcctcgtttatactagcagaaaggaatcgncttccttccccatagatatacatggg

SEQ ID NO: 542882 - DNA, 412 bp, Homo sapiens
gcccataacagagaaataagtaacacctaagtatcagatataaataagcttcagtgtacaggcaataaatatacagaaagctctagtcatagagaaggctctaaggagagagatagataatagtaagggataaaaagaaaggtacgtatcatggagagatcataataaatacttagaataaaaagtaggtaagctttcagtcagggagacaaataagatagtacaataattcctctataatttcctatcagtaatacatccaaataatagtaaaaaccccacagacccctaaacattattactactaatacacttctcaaaacatttacataagtaactcaagcctctaagaggataactccaaaatataacttcatccactagctctagatacgtaaaaccaataaaatcg

SEQ ID NO: 542883 - DNA, 365 bp, Homo sapiens
  misc_feature (4)..(4): n is a, c, g, or t
  misc_feature (9)..(9): n is a, c, g, or t
  misc_feature (50)..(50): n is a, c, g, or t
  misc_feature (99)..(99): n is a, c, g, or t
tggnccccnaaaaaaccatcctagatttttaaagagttcgaaaaaaggantggggcttggtccaaaaagggaaatagggattggggtgcagtggctcanaccctgttaaccccagcacttcggggaggctgaggtggggcagatcacttgagccccaggagttcaaaaccagccctgggcaacacagtaagaccctatcccctacaattaattagttaataagccaggcgtggtgtcatgtgcctgtatgtaatcccagctactcagaaggctgaggtgggaggttcacttgagcctggatatttgaggctgcagtgagctatgatcactccattgcatttcagcctgctcagtagagtgagacc

SEQ ID NO: 542884 - DNA, 170 bp, Homo sapiens
ctgtattaaaaactcacaaatgaggcaagaagacaccttcatgccctttccccaaagccaccctagcattgtgtaataagtcctgtgttagattgggttcccttgataccgactctgagacaggcaggtgcaagaccaggtgtactggggctgctctggggaggaactct

SEQ ID NO: 542885 - DNA, 577 bp, Homo sapiens
  misc_feature (5)..(5): n is a, c, g, or t
  misc_feature (24)..(24): n is a, c, g, or t
  misc_feature (90)..(91): n is a, c, g, or t
  misc_feature (146)..(146): n is a, c, g, or t
  misc_feature (222)..(222): n is a, c, g, or t
tcccnttattacccaaggattganaacccaatatttgggttggttcccaagcctcccaggatattccaagtttttccatggaaatttttnncctactttccccccttatgccccccatttggacttcttgggtttttaatggtagncaggtaagagtagtaagtttctaatcccagaatagttttgaaatatattattgttattatcatcatcatgtagagncagcatctcattctgtcacgtgggctgaagtgcagtggtgtaatcatagcttgcactgcagccttgaactcctaggctcaagggtttcttaagccttagtcttaatatacagctttataagtgtgcattactgttcacagctaactttaaaattgttttttgtaaagacaggatcttactatgttgatcagactggccttgaacccctgggttcaagggatcctcctgccttggtctcccagctactcaggaggcggaggcaggagaatggcgcgaacccgggaggcggagcttgcagtgagccgagatggctccactgcactccagcctgggcgacacagcgagactccgtctc

SEQ ID NO: 542886 - DNA, 243 bp, Homo sapiens
  misc_feature (55)..(55): n is a, c, g, or t
  misc_feature (184)..(184): n is a, c, g, or t
  misc_feature (216)..(216): n is a, c, g, or t
aaaaatcattgaggtcatcagtaaagcaccgtttatccagataacgggcctgggngatcggcgctggtggggcgcgatctgtcgttcaaactgatgaaaattggctatcgcgtggcctgcgaagcgacacgcacgtacaagccaccgtttctcaggcgttgaaaaaaggcgatgtacaaatcgntatctcttacagcggcagtaaaaaagagattntcttgtgcgcagaagcggcacgaaagc

SEQ ID NO: 542887 - DNA, 221 bp, Homo sapiens
cgtttattttactggctgatgctaccgcttctgctccctgcctgtaaaacccttctttcccactgttgctgctcttcttttaagagcacttagcagatgaaataaaccttgggtagctagtctggaaactacttccctcacttttgactactctttttttggggacgacacaaactttcaaacacgaacgacaacagctaccaacaccactttacgacgtc

SEQ ID NO: 542888 - DNA, 237 bp, Homo sapiens
  misc_feature (154)..(154): n is a, c, g, or t
tcacacccatcccctggtgggctcctggacggcctgcacaaatggaccacaaaagggcagaccggaactgcacactctccccacaaaggtatctctgtgtcttactatgaacaaaaacccggcaaaacccagtgccctggtttttccccacccnaaatgaaggatacgctgtattttttgactaatgtccctgccactaggttcataatgaattaaaggttcatgaacgctgcgaga

SEQ ID NO: 542889 - DNA, 241 bp, Homo sapiens
  misc_feature (2)..(2): n is a, c, g, or t
gntctgggttgttgttggattttttttgtttgtttgatttggtttttgtttttcttgccgtgttgcaaaactgtagaaagttgcttattcactggccatgggtccattgaagtctgtgtctcgagtgtccgtttccttctcagaaccatctgcattcttaataactctacgtcctccagaccttctagaaggaacgaaagagttcttcttttcccttcctgagctttgctcttgagtgcgt

SEQ ID NO: 542890 - DNA, 968 bp, Homo sapiens
  misc_feature (36)..(36): n is a, c, g, or t
  misc_feature (65)..(65): n is a, c, g, or t
  misc_feature (69)..(69): n is a, c, g, or t
  misc_feature (91)..(91): n is a, c, g, or t
  misc_feature (110)..(110): n is a, c, g, or t
  misc_feature (120)..(120): n is a, c, g, or t
  misc_feature (124)..(124): n is a, c, g, or t
  misc_feature (159)..(159): n is a, c, g, or t
  misc_feature (162)..(162): n is a, c, g, or t
  misc_feature (177)..(177): n is a, c, g, or t
  misc_feature (181)..(181): n is a, c, g, or t
  misc_feature (190)..(190): n is a, c, g, or t
  misc_feature (194)..(194): n is a, c, g, or t
  misc_feature (213)..(213): n is a, c, g, or t
  misc_feature (222)..(223): n is a, c, g, or t
  misc_feature (234)..(234): n is a, c, g, or t
  misc_feature (249)..(249): n is a, c, g, or t
  misc_feature (269)..(269): n is a, c, g, or t
  misc_feature (286)..(286): n is a, c, g, or t
  misc_feature (314)..(314): n is a, c, g, or t
  misc_feature (340)..(340): n is a, c, g, or t
  misc_feature (393)..(393): n is a, c, g, or t
  misc_feature (410)..(410): n is a, c, g, or t
  misc_feature (412)..(412): n is a, c, g, or t
  misc_feature (436)..(436): n is a, c, g, or t
  misc_feature (469)..(469): n is a, c, g, or t
  misc_feature (563)..(563): n is a, c, g, or t
  misc_feature (603)..(603): n is a, c, g, or t
  misc_feature (623)..(623): n is a, c, g, or t
  misc_feature (669)..(669): n is a, c, g, or t
  misc_feature (681)..(681): n is a, c, g, or t
  misc_feature (761)..(761): n is a, c, g, or t
  misc_feature (810)..(810): n is a, c, g, or t
  misc_feature (892)..(892): n is a, c, g, or t
  misc_feature (897)..(897): n is a, c, g, or t
  misc_feature (951)..(951): n is a, c, g, or t
gcgtgaacattgattgccctggaaaatatatcagtnaggctttcctaccacttctgatgactgcnagancatgaaaatctataatgttttnctcaacaaaaatcacagcnaatgaataanagcnatggccatgaagattaactttttaattagcaaatnatntttctttgttgatgngttnctaagcagncatnatcacttccctctggattnctttggtgnnagtcatgggtngccacatacagctgngttccatgaaggcaggttgntatttatttgcttcttnttccagttttcagatatatctctcttcnatttttgattcctgcagctggcttcnctcctactcctctctctgctcgcagcacgtcgtgccgccagccctttgatgtnttcccaggcccgctgcncntgggcagattccaccgtgcgtgancagatggcaaagcgcaggacaaacttgtccctnaggtgacatggaaccaagtggattttttggcactgtttattctttgcagaagagcttcattcactttgttggaaccctttagccgaaagcaganaagccccagaatgacttccacacagatttcaaagcggggntcctggcgctccagttactnaaactcatgggtacagctggactatgcttgcggatataagcctgcngtcctttgactncatacatcctaaatacaaaccacattttcaaagagcgaaatcttctgcccagtggtatctgccaatgccggtagtcagtnataagccctgaatcctgatggctgtgcttcaggtaagtggggtccagtntaaaggctcccgttaagtctgttctctttttcacccacatggcagaacagtcaaaattcaccaatagccatttgtggggatnaagtngaatgaaatctgcaaactccactccattcagaaggtgccggactcagggcagangaatgcactgcctgcgt

SEQ ID NO: 542891 - DNA, 840 bp, Homo sapiens
  misc_feature (55)..(55): n is a, c, g, or t
  misc_feature (64)..(64): n is a, c, g, or t
  misc_feature (68)..(68): n is a, c, g, or t
  misc_feature (88)..(88): n is a, c, g, or t
  misc_feature (90)..(90): n is a, c, g, or t
  misc_feature (92)..(92): n is a, c, g, or t
  misc_feature (121)..(121): n is a, c, g, or t
  misc_feature (178)..(178): n is a, c, g, or t
  misc_feature (214)..(214): n is a, c, g, or t
  misc_feature (217)..(217): n is a, c, g, or t
  misc_feature (306)..(306): n is a, c, g, or t
  misc_feature (402)..(402): n is a, c, g, or t
  misc_feature (428)..(428): n is a, c, g, or t
  misc_feature (435)..(435): n is a, c, g, or t
  misc_feature (438)..(438): n is a, c, g, or t
  misc_feature (445)..(445): n is a, c, g, or t
  misc_feature (450)..(450): n is a, c, g, or t
  misc_feature (460)..(460): n is a, c, g, or t
  misc_feature (492)..(492): n is a, c, g, or t
  misc_feature (502)..(502): n is a, c, g, or t
  misc_feature (616)..(616): n is a, c, g, or t
  misc_feature (637)..(637): n is a, c, g, or t
  misc_feature (834)..(834): n is a, c, g, or t
ggcaatttggaggcacaggctacttcggagtccatgatatgagatggcgttttanatacatgtnttancttcaagggtttcagctctntncnctgggccatctggatataagtggatagcngtcacaggtatgacgtccactttatccaactgaagaattcctttgtattcagaaacngggaaaaacacctttaagatggttattaccacagcngcncctgtaattccaaccaccatgatgttcaaaaactgaaagaatactgggaaaacgttgctccagaacctacacagatcttttctaaactnttccatccactgacacattaccttatatgaagatggcggctctgctctgagaggagtttcaggtaacttgccaggtaaaacatcttcatctacagnggtttccacattcctgataagatacnggcgagnggnttgcagngaacnaacactttcnttttgggagaggttaggaaggggaaataaaanggcacggtcncgagaaatagagtagagcatgcgttcgtccaaagggaggggataggtggaatggcggaggactccccgggtccgaacgaaaatatcaatttcagggacatccttttgcggaacntgttttccaccaatcgcgacnaccgcgcgcttgaatgacaattagttgcaaactggaaccagatgtcataggccactcatgaactaaaatccttacactgacaattccaaaatattctttttcctccaaattttcaagattttcattcttcactatcaaagtctgacagcttattcgggttacaccactatttacaggtaagtcatttacatacaccngtccac

SEQ ID NO: 542892 - DNA, 236 bp, Homo sapiens
gagaaacgggactagaatctagcctctaaccttttgattagaaaaggttttccttgcttcctatctcaggaatggacgctatcttggacttgttctggctcattggcaagtccaataccaagtttttaatccattgattgccacagagggccaacaagaaccatgactcacccttcacacgcccctggaggcgagtcgttcgtggaggggttcaacggaaggagagcaaatgaacg

SEQ ID NO: 542893 - DNA, 149 bp, Homo sapiens
ggatgagtaagtactgggatgaggaacgtcactgggatgaggaacgtcactgggatgaggaacgtcactgggatgaggaacgtcactgggatgaggaacgtcactgggatgaggaacgtcactgggatgaggattaattatgggaattg

SEQ ID NO: 542894 - DNA, 174 bp, Homo sapiens
  misc_feature (40)..(40): n is a, c, g, or t
atcgtcgtgactgggacgacctgtgcggaggggtcacagnagatgtctcgtggcacctaagaagccacagcatgctctccacagagctgtccactgcaccatgcgcagtacgtgtctcgaccttgtccatgctccttgcctgcaaggcagtaaagtcgagcccagtatcttcta

SEQ ID NO: 542895 - DNA, 276 bp, Homo sapiens
cagcctcagactctgagtagttgggatgcaggtgcctgacaccatgcccggctaagttttctatttttagtagagatggtgtctccctgtgttggccaggctggtcgggggatccctgagctcaagtgatctgccctcttcagcttcccaaagtgctgggattacaggcaagagccaccgcacctggcccagagtttttataaattgatatataatagttgtacatattttttgcatacatgtcatatttagatacctgtatacaatgtatacgat

SEQ ID NO: 542896 - DNA, 272 bp, Homo sapiens
gtatgtgttgtgcatgtcccattataagaagcaatcaatgtcatctatcaactatgatcttctacaattttatttccgtcaactacttctgtggccttgcagctattttcgaaaaggctcaactagtaaggcctcttagccacgagggatcacactatttggggtcacctagccattgaaagcagaaagcaagtagtgacacagctttcccttcaaagagccattgagaaaaattgctccaacaggccctccttctcatactaatgtggaca

SEQ ID NO: 542897 - DNA, 378 bp, Homo sapiens
  misc_feature (7)..(7): n is a, c, g, or t
  misc_feature (38)..(39): n is a, c, g, or t
agggggnggggggggggccggccccttatttccccatnngcccccattttggggcccctttccccttttggggggggggggcccccccgggcccccttttaaaggggggtttttttccccccctggggggggcccccgggggggggggggggaccccccttttttttttgggggcccccccccccctttgggcccaaagcccccggttttttgacccccccgggccggggtcccccccccccggttttttttttggggggggccccccctttttggtttccgggggccctggggggggggggggggggggggttcccccccttcccccccctttttttttttttttgtttctttaaaaaaagggtgccccgggggtga

SEQ ID NO: 542898 - DNA, 520 bp, Homo sapiens
  misc_feature (104)..(105): n is a, c, g, or t
  misc_feature (112)..(112): n is a, c, g, or t
  misc_feature (119)..(119): n is a, c, g, or t
  misc_feature (125)..(125): n is a, c, g, or t
  misc_feature (133)..(133): n is a, c, g, or t
  misc_feature (141)..(141): n is a, c, g, or t
  misc_feature (143)..(143): n is a, c, g, or t
  misc_feature (146)..(146): n is a, c, g, or t
  misc_feature (159)..(159): n is a, c, g, or t
  misc_feature (161)..(161): n is a, c, g, or t
  misc_feature (164)..(164): n is a, c, g, or t
gggagcaccatggatcagacagcatgcccctcgcacaagtggtaaatacacacatgtgcatacacagtgaaatacaccatacacagacacaacaggtctctggnncatgcangccgtcntcctgnactatgcngagccccngnccntggcagtcagcananacnctgtccaggctgaaggccagcacagcatctcctttactgtcctgtgccacctctgccctctctgatcttacccaaaggccaagtacacacagagtcaccagcaataggatacacagaaacagaaaagggcacggcacaatgacaacttcgcggtcataactcccaggaaaaggaaatgctccttgaacccccagccactgaaatccccagtaaggaaacaggacccgcggcacctcacgggccagtgcaaacatccaggcataactgtgccctgacttgtgctttggcccaggtaacccatgagagcactacgtcagcaaatggggggagcagtatactcttggtctaagaatgac

SEQ ID NO: 542899 - DNA, 315 bp, Homo sapiens
cgttctagaggatcaccgaaggccatttcttaccaaaaatcaaaattagctaggcgtggtggctcacgcctgtaatcccagcactttgggaggccgagatgggcagatcacaaggtcaggagattgagaccatccggaaaccctgtttctactaaaaatacaagaattagttgggcgtggtggcatgtgcctgtaatcccagctactggggaggctgaggcaggagaatggcttgaactagggagtcggaggttgcagtgagccaagatcgtgccactgcactccagcctgggcgacagagtgagactccatctc

SEQ ID NO: 542900 - DNA, 432 bp, Homo sapiens
tcacgtccaaacagtcatatcattcttagtttttagtgtgacagtcagaatcattactttgccattagctacctctgcgaaatgagtgattcagaatatttgcgcaggatgcgtgggactactgttctagtagttcgcacatgtctactctggcacttgcaaagtaagtttctgcactgttgttttcttgttcaacaggtgcatgattaccctgaaattcattcacatattgtgccatcacaaactcatgtctttcacttgataaaggttctgctagaacatcaggcaaagttttatgaaccaggcttttcttctgtgaagcagtcccattgaggtgacaatcaaaacctatgttcccaggaagctggaacctctgatcttgaggtccaaagggtcccatagtttcatcaggccacactgttcgagagcata

SEQ ID NO: 542901 - DNA, 349 bp, Homo sapiens
tgcagtccatattcatcttccttcgcaggaaggaggcgagtgataagtccccagagaagtgacgagtctggacttccttcctaggactcagttctgtttcttcatcggtctcaatcactggcagcaggctgcttcactgaccagttacgggctccatcatgaggacattccataggcccacttgatttgaaattatcaatgattattttaacttttatccaaacctttcccagtcattccagtctgaaaggcttaattctctggtattttcacatctttaatgctttgggttaaaaaactataacagtgacatgtgacattttagaattattaatatttccattctaat

SEQ ID NO: 542902 - DNA, 98 bp, Homo sapiens
acccccccccctccccctgggccccccccaacacggtgtcctgccccccagggcctgggtccaggaaaacacgcttgccttccttcccggcagcttca

SEQ ID NO: 542903 - DNA, 1025 bp, Homo sapiens
ctctcgtcgactcggaagattcggagcagtatgggtattaccacacattcattatatgaaagccttccagaatgaatagtgtgtgctgtatccaataacagctggagtcctgagcgatccagcccatgtctgataggtggagatctcagatgcgcatgtccgacaaaaccggggaagagtagtcattcctctgagcgcatgacaaagtcagtcgaatggctcaaacatggtgaccccacaggaatctgaatctgaaggctggagcgtaatgagtggacttgagattctgtgatatacctacaccactcacgttgaaaggtcgaaagcaggagttagtcatgatctagaatggtcatgatctacatggtagtcgcgtgctgtcttgacatcttcctacctccctgctcatcaatgcatgtatgaattaagagcgcttggcatggctgaattccagtttcatcctgtttctatggtttggctcggatatgtcgggtgtagttgctgaagccgatgtttatcgtccgctacaggtagtctatggatttgagctctggtgttgcattcggtctttccgcgttcatcttcttgctcctgtattttctgctgtaattatgtgatcttctgccttccccctgttgcgttcagttgcttccggtgggtttgctgttgacagtttgcagggtagttattaggctggagatgtgtatcttgtctttgtgacacttccggtgtgtccctttccagtcggccgatgttccccactgctcggaaagggcatcgccttggggcgatgctatggggttgccccgggtccctggcctgcgtgcatctccctttggtgccatctggtcctttggccgggactcgagacgggagccctgggcaggtaagccggagtatgcccagattgttgaggtttattccagttcccacaccatcgttcgctccgggacctaaagccgggaggacttaggtttacactctctggtgggagagaaggcgcaatataggtaggggcagcaggg

SEQ ID NO: 542904 - DNA, 467 bp, Homo sapiens
  misc_feature (113)..(113): n is a, c, g, or t
  misc_feature (147)..(147): n is a, c, g, or t
ctggcgcaaaagaagaggttttcccttttttaatgagggggccccactgggggggtgacattttttaaccctataatctggccaatctttgtcactatccagatttcaatttncgggtttgcattgaagtaagaagctgggatgagnaaaatagaccttttttcttaaagccattcgaattcattatttttcccctaatctttcttatgtgaagcagctctccactgccaagtatttgttttgtcatttaaaaaggatttagtgaaattcaagcctgggcaacatggcagaacccattctctggtaaaaatacaaaaattagccaggcgtagcatgtgtaccctctagttctagccacttgtgagactgaggtgaggggatcgcctgagtctgggaagttgaggctccagtgagccgtgtttgtgtcactgcacttcagcctgggtgacaaaatgagaccctgtcta

SEQ ID NO: 542905 - DNA, 2030 bp, Homo sapiens
cccacgcgtccggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccgggcccggttgctgtggctctagacactaaaaggacctgagatccgaactgggctcatcaagggcagcggcactgcagaggtggagctgaaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgctggcgcccattaccagcgaccccacagaagccaccgacgtgggtgccgtggaggctccttcaagtgctgcagtggggccataatcgtcctcaccaagtctggcaggtctgctcaccaggtggccagataccgaccaagtgcccccatcattgctgtgaccctgggaatccccagacagcatccggtcatgtggcccacctgtacctgttggcatcttccctgtgcttggtgcacatggacccatgtccaggatgtgcctgtggcttgaggacgtggacctccgggtgaacttttgccatgaatgtttggcaatgcctgaggcttcttcaagcaagggagatgtgcgtcatatgtgcttgacctggatgtgtgccctggggtcccggatttcaccaagcagccatgcggtgtacgttccttgtgcctgtaattggacccccaagatgtctcctccatcatatgacctagaaccagaacaaacattaacaggacacaaccctcagggcgcgacgaacgacgggagcaagccgggcgggcgcagaaccgaggcgcaggaaagcaaggcaagacggagaagacgacgcgaccgcacagcacaggacagaaagacgagaagagagaaccaggagcgacaccacgggcaggcgagacaagaagagagcgagtacgatcacaatcgacgtcgatcggagtgcacagagcaaagtgaaaga

SEQ ID NO: 542906 - DNA, 162 bp, Homo sapiens
cttctcgttgtggtgtgtgtctgctggaaggtgaaactttcgctatggaggtctagggagggataacatgtttgtggaccagagttttagtaccgaatggggtgggccctggtcggaccggccggcacggccatttcaccgaccttcttccgtgcccgggtt

SEQ ID NO: 542907 - DNA, 1562 bp, Homo sapiens
agggaatatttcctgaagtaagagatttcctcactgggttttaaaggacgcataggagtttgcctggtcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgctggcgcccattaccagcgaccccacagaagccaccgacgtgggtgccgtggaggctccttcaagtgctgcagtggggccataatcgtcctcaccaagtctggcaggtctgctcaccaggtggccagataccgaccaagtgcccccatcattgctgtgaccctgggaatccccagacagcatccggtcatgtggcccacctgtacctgttggcatcttccctgtgcttggtgcacatggacccatgtccaggatgtgcctgtggcttgaggacgtggacctccgggtgaacttttgccatgaatgtttggcaatgcctgaggcttcttcaagcaagggagatgtgcgtcatatgtgcttgacctggatgtgtgccctggggtcccggatttcaccaagcagccatgcggtgtacgttccttgtgcctgtaattggacccccaagatgtctcctccatcatatgacctagaaccagaacaaacattaacaggacacaaccctcagggcgcgacgaacgacgggagcaagccgggcgggcgcagaaccgaggcgcaggaaagcaaggcaagacggagaagacgacgcgaccgcacagcacaggacagaaagacgagaagagagaaccaggagcgacaccacgggcaggcgagacaagaagagagcgagtacgatcacaatcgacgtcgatcggagtgcacagagcaaagtgaaaga

SEQ ID NO: 542908 - DNA, 257 bp, Homo sapiens
ttttttaacggacagaagtccttgcagctgtcattgctggtggggttattggctttctctttgcaaattttcttatcctgctgttggtgtatcgcctgggaaagaagggtgaaggaagctttgaccttggggaacgcaaaccctccagtggtgcttttccgaaggcacctactaaggggttttttgcgtaaaaccccaacttagtgtctctatttttgggatcactgaacttttcaaaataaagcttttgccttgga

SEQ ID NO: 542909 - DNA, 2226 bp, Homo sapiens
tgtgcacgatcggctgttttgttgctgttccctgagtctggtcagcgccggaggtgatgctggtgcaggatgtgctacgccatcagtccccaccaaggtgccatgtctgcccggctagtgcggaatccctgtgcgctgccgtgccgtgccccggtgcacgcaggcagggctggcgcaggatccatgggcgtctgggatgcagtggatgctcagtggagatggagaacggctacctcactgcctggggcctgctcttcagaagtccccagcgcctgttccttccagatcagggcgtggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccgggcccggttgctgtggctctagacactaaaaggacctgagatccgaactgggctcatcaagggcagcggcactgcagaggtggagctgaaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgctggcgcccattaccagcgaccccacagaagccaccgacgtgggtgccgtggaggctccttcaagtgctgcagtggggccataatcgtcctcaccaagtctggcaggtctgctcaccaggtggccagataccgaccaagtgcccccatcattgctgtgaccctgggaatccccagacagcatccggtcatgtggcccacctgtacctgttggcatcttccctgtgcttggtgcacatggacccatgtccaggatgtgcctgtggcttgaggacgtggacctccgggtgaacttttgccatgaatgtttggcaatgcctgaggcttcttcaagcaagggagatgtgcgtcatatgtgcttgacctggatgtgtgccctggggtcccggatttcaccaagcagccatgcggtgtacgttccttgtgcctgtaattggacccccaagatgtctcctccatcatatgacctagaaccagaacaaacattaacaggacacaaccctcagggcgcgacgaacgacgggagcaagccgggcgggcgcagaaccgaggcgcaggaaagcaaggcaagacggagaagacgacgcgaccgcacagcacaggacagaaagacgagaagagagaaccaggagcgacaccacgggcaggcgagacaagaagagagcgagtacgatcacaatcgacgtcgatcggagtgcacagagcaaagtgaaaga

SEQ ID NO: 542910 - DNA, 263 bp, Homo sapiens
tcatgaagggagtcctggggaattcctgaaaattttcttccttctgcagaaagttggatgagtcccttagagaaggcatccagagacataaataaactgaatatcatccaatattgattttaggaattgactctaaaactgtgtgcagaatcttgtggggggactgtatattgacactcctgttgtgctatttttcttaattggagtgtatgctgccttttaggtacaatttttgtgtaataaaagccagtgcattgagttta

SEQ ID NO: 542911 - DNA, 312 bp, Homo sapiens
cataaatcaaagagagaaggccaaagcaatgtttgctctctgttaagatatatgttgaaatgaggtagagcatggtaccaagtgcgatagttatctgtgctagatgaagagaacagaagggaaaaagctattataaaatgcagcatagttcggactgcggaaagcatattataaaagaaattttaaaacaatttacaaatgaaggttcatgtgcactaacttgcacacgatcatcataaggcatttctgcagttgctttatcaagacaagcctccccagtcctttacacacgtgctcagggcacaaccacat

SEQ ID NO: 542912 - DNA, 586 bp, Homo sapiens
  misc_feature (16)..(16): n is a, c, g, or t
gcaggctgagtaccgnctcctcggaggtgtatatggagtatcagtcgagacccacggctgctcctgcctactggtctcccgtctcaatgccgagccaaagctggactatactgctgccatctcggctcactgcaacctccctgcctgattctcctgcctcagcctgcggagtgcctgcaattgcaggcgcgcgccgccacgcctgactggttttcgtatttttgtggtggagacggggtttcgcgtgtgttggccgggctggtctccagctcctaaccgcgagtgatccgccagcctcggcctcccgaggtgccgggattgcagagcggagtcgtggttcagctcaggtttgctcagattggctgccccatggcttggacgttggcagtggccgttgaatcttctcggggctccgccgttacaaaaccctgtccacaaaggctccccagtcctgccttgcctttgtggcccgttccgcaatatgtgccggagatttgcgaggccccttcccttgtggcccctggctcgatcacccccggtctggggaacgtgagtgaggccgggttcatttccttgggccccatgg

SEQ ID NO: 542913 - DNA, 1243 bp, Homo sapiens
gagagagagagagagagagagagagagagagagagagagagagggcgtgtgagaccctgtacatatatcctgaaaagtggagggccttcaaggctctcatcggtgctcaatacagcgggggctcagtgtcgcgctgtgctctcgcgcaacacccacactttccattgtgggcacaaacacaagcgcaccctctgaatttctccgctaaatttccgtgccggaaaggtcccagctatgagagggtgatgatggattcgtgtgtgtgctagagagcaacgccgattgcctatcatatgtgacgcaagatgagggagcgtgcgggggaatagctactccaagagagcaggagcccaagattcggtagcacggtgcgcgatgacgcgtgtggcgtgatctccagatagtaagtgccccacaagacatagtactcgtggtgatgcttcccctatctttgaggctaatcagtgcaaccactaaacagacacgagggaccatgatggacgatagctgcatcaaggaagcgacatgctgaaggacagaaacttcgtggcggtcatgcctgagagctgcatctacatctgacaagaccgaacgagcactttcctccttgggtcggcgaagacagccgactgatgacccaatgtggcgtgacctacatcaagaacgatgtcggtcgctagccaaaccccgtagaggtagttgggaccgtcattaataagacagccaagcatgtttacagtaaacgaaacgcacactcttacattagtctccacagcacacaaacgggcaccatctatcacaccataataacaacacaacacccggcactatgagctttcaccaatccagctggcatagactattatcaaagcagccagaagaccacacacgatgtatctagccacggggagccgctacgatcccgtacggcagacgcgacaaacacaggctcggaaaccacggtcggtccgttcgaaaacgacaaaagcaacttcagcgccacccgaacgcacggagaggaagtccagctgacaaacaagcactcggtcgtcaggcaaagcaaacaacccccaaacaccacataaaaaagcacagaggaacacaccccacccacaccaggagacacagcgaagccacagcgcggtcaccacagggggcaaaacgaaagaaccagcgcagacacacacactcacccacgacacgggcgaccgcacccccgccacacaaagccagccgccccaca

SEQ ID NO: 542914 - DNA, 1059 bp, Homo sapiens
tgccaaaccccactctgcatcaactgaacgcaaatcagccacattaaagtgaagctaaggcctcactagagcaatgggacattaaacaccacagaacacttagttaacagctaagcgaccctaatcaacatggcttcaaatctacattctccacgccgaccgtgagaaaaaaggcgggcagaagccccggcaggtgtgacaagctgcttcgttcgaatttgcaattctagatatgaaaatcatcttcggagctggtaaaaagaggtctaacccctgtactttagatttagcacgtccaatgcttcacgtacacccatattacctcaccccacactgatgttcgccgaccgtctgagctattctctacaaaccacaaagaccattggcaacactatagctattattcggcgcatgacctggcagtcctaggcacagctctcaagcctccttcattcgagccgagctgggccagccaggccaaccttctaggtaacgaccacatctacaacgttatcgtcacagcccatgcatttgtaataatcttcttcatagtaatacccatcataatcggaggcttggcaactgactagttcccctagtatcggtgcccccgatatggcgtttacccgcataaacaacataagcttctgactcttactccctcatactctaactctgctcgattgctatagtggaggcgaacacaacacacggtcgaacagcaaacctcccttagcgggacacaaccaacctgtagactccggaaagacacgaaaaaacctaaaacaaaagagaacacaacaaaaggcgacaaagtcacacacccataataacccccgcacacacaaacaaggcaacaagatgcgcacacaagcacataagtaaattgcgacacagagagaacaatcaagcagccgcctataccctaaaccggagggaaagacacaccaccatgggcgatcagagagcggactttccgcgacacaataatagagcaaaaaaagaagaaacacctcacgcattctcactctcgcgccacgtcaaaggcgagggggggat

SEQ ID NO: 542915 - DNA, 1006 bp, Homo sapiens
aacacgaagcaatgtggggcaaagccctagtaacatatgacctcgaaacagcaatcccctcatcaacacgccaggcaggacatcattcaggccttgcagacattgggactctgccatattctttccgtctatttaaccaggattggattatgacactacagcactggtgtcctgaactagaagaacttcattaccaagcagcatggaggaatatgcagtgggaccatagcacttccgtccagcaaagcaagtagacaggaaccagttaccatgaatcattgtacaaatgctctacaatctctaacgagacagagaattctctacatttcatgacaagtctcaaatatgccagagtcaccacgcaacgtggcaagagatgtgtaagcgcagccttgagtctgtgtattcgctctatcccacaacttagccaggttgcaggccatctggagagctggaacaagcactggggacgctttactcacagatcagtcacacataagacaactctctgaagtatatatcacgtggcagcacaacactgcccagacttctccaaggacacgcgatatcagcttctccaggagcctaatcatggcgtcaaaggcaccagacactacgcgagcatacctgactggcaacacggcactgggagcagctcaaaaacgacgctcgtattaacggaccatcctcaccccaaaccacctcaggcacaccgtcactaatactgggccagcaactccacagaaagccacaccaaagccaccccccggaaacgaggcgcaacaccatcaacacaaccgaacacgcagggaacaccaatacaaacgcacacaccaggcaagcagcacaacacgcagagcgacagcccggccacaaaacaaccacagacaaccctgacggccaacaaacacaagaccaccgagacagcacacagggcagcggaacaaaccacgactcacacgcaccacagagtacccaacagacaagagacgcacagaggcaaagc

SEQ ID NO: 542916 - DNA, 442 bp, Homo sapiens
tgcactatctgggactgccctctggttcttacccgctgggataaagtactttgaggcgaaatctgcgtcgtacatagtcgcccaggctgaaacatgcagtggcacaatctcggttactgcaatctttgcctctcaggttcaagtgactctcccacctcagcctcccgagtagctgggattacaggtgcctattactgcgccagctaattatagtattataagtagagacaggggttcaccctcttggccaggctggtcttgaacttgtgacctcatgatccacccgcctcggcctccgaaagtgctaggattacaggcgtgagccaccatgcccggccaaaacaaagttttgactgtgacctgtcacatgacatcagatgtggaattttccacttgttggtgtcatgtcagcactcaaaaagtctctgattttggctgttca

SEQ ID NO: 542917 - DNA, 196 bp, Homo sapiens
  misc_feature (60)..(60): n is a, c, g, or t
  misc_feature (124)..(124): n is a, c, g, or t
  misc_feature (138)..(138): n is a, c, g, or t
agagatcgaagcctcctatctccacatctcttaagaagttgaggggtgggggagagaatnacttctgccttcatctgcagtaacggggggacctatactgacctttccccagccatttagaacnagttctagggtggntggaaaatctccagcagccctgccattatcttccacctcagcaaccacgacctccagt

SEQ ID NO: 542918 - DNA, 376 bp, Homo sapiens
atcgccaacttgtcctttgacatcactggccgctttttggcctcctgtggggaccgggcggtgcggttgtttcacaacactcctggcccccgagccatggtggaggaaatgcagggccccctgaagggggcctccaacgagagcacccgccaaaggttgcagcagcagttgacccaggcccaaaagaccctgaagagcctgggtgccctaaaaaagtgactttgggagggcccggcgcaaaggattgaggaggagggatttggcctcctcatggggctgctgccatttttcctcccaggtggaagcctttcaaaaggagtttcctggtttttttactgggggcccggctttttcccattgaaactacttttgttta

SEQ ID NO: 542919 - DNA, 369 bp, Homo sapiens
tctgagaatcgtgtggaaaaaaacggcctgattttttcaaaccgggggcctgggaccagcttcgagtttgcgcttgcaattgtttaaacccttaatggcaaggaggtggcggctcaagttaaggctccccttgtttttaaaaactagagcagcgaacttcgccgatcccttaaaaaaacaggccgttaggaatcccttttccctgtgttccctttaaacaaaacagtggtaggttaatgtgttcagaagtccctgtcctttctactttttcggaagtatggaagtcccaactacccaaaaattttcagcctcccaattgtgtttatacatttttaagccttgttttcaaaataaacagggcctttagca

SEQ ID NO: 542920 - DNA, 933 bp, Homo sapiens
  misc_feature (145)..(145): n is a, c, g, or t
agcggagggtgcgaacgaccgaggggaggaggcaagaaacgcaggcgcgagcactagctgggtgggcaccatggatggtattaacaccatcgagggggtgaatggcaagcatcctaagtttctgactagccaggaaggcgtcagnatgtatgcactatcgtagcggaactgatgcgcgcttgcgagacaagatcaagttagtacggtgatgataccagagtctgggtccccagggattacacgtgtctgaagcggactgagagtgaggcctctattgtaacgcggtgacgacttccagactgaatctaggaaagaaggagcctgggactccggagcatcgaagtagcagccaatgtttccatctgatcctggcggaaacatgtggggaatcgaagcatagagagatatatgcatggctagtatgggagtaagtgatgatgagtgatatctggaaagcgtctagttggaaaaccttggggacttgttgtagtatagtatgacacagatggcgaatttccatgtaaattcccatatgtacagaagaacaggcgttagacgagcagttcgtgagaaagaagcgatggattcgaggaaagatactgtaggtagagttgggctacgcgtaatgcttggatgaatctgttgacacggcatcaagtagtgatatacggcgaagagctatgcaaactgaaacggggaggcctgtgacgaggaaattcattacctgtgaattcctggaaagacgtggggagcgagaggaggcgttgaaggaaattgattctgaccaaaaaaaaatgcttcaatatgatcttacttttgggaagggagatccagggtggcgaaggaaaagataccattcttgaacaaaaattaacgcattaccattggtgaagggcaagaataattcaaatgagtttctttaatgggatacca

SEQ ID NO: 542921 - DNA, 286 bp, Homo sapiens
  misc_feature (83)..(83): n is a, c, g, or t
aaagcccagctagaatcagagaaaaataggctgtgtaaactggaggatgagaacaatacctaccaggttgaattggaaaaccntaaaagatgaatatgtaagaacacttgaagagacgaggaagaaagacattgttgaatagtcagttagaaatggaaagaatgaaagttgacagaaggagaagcattttactcagaacataaagaaaggacgcagcatttctgttctagcactcacatgtcacgctcaagttcatagtgtgttggatatgcaggactacgacatc

SEQ ID NO: 542922 - DNA, 844 bp, Homo sapiens
ttcgtgccctcgcgtggtgttcgctcctcctctctccgtgtgcttggttgtggtttgctccctgattgtgtttgggacatggaagagaattagtggatgtatcagtctacgacgtgtgctcccgaccctgtgtgtttgatcgttgtgcttcatccaattggggcggggttattccttgtggggtgctcgccgttatatatttcctgccgttgtgatcctctgtgtgtccgcttgctgttgtttgtgggtcgcttttgtgtagttgcgtcctttattgtgtgcttcgcttccgttttctccctcttgtttcgtgcgcgacgctgtcactagtgatcatgatccagtgctagcggccgcaggtggagaccgcgcgcaagatgggcccggtgctgagggcgagatcttccgcgcatggttgtggtggtggcaagtgcttggcagattgcgtgcctgccaggttgtggattagtgcctttccgccacccgccttgtacgagctatcagtgtccccacgcaggcccactgctccaaccccctctttgaggtaaaagtgcctttattgggagacttttgtctgtgacagcctgtccacatcaaacacctcctgggtgtggccccacatatgtgtgtgcctaggtcctccttgttgcacgatcccataggagacacccgttctgactgaaccatgccgcccaccttagtccccaaatgagggaatggggattagatttcagatccaggccctaggttgggacccactcccaatatctcctcggtgtgggtggtggttctatagagggataatgaataataaacattgtttaaatatacgaaaaaaaaaaaa

SEQ ID NO: 542923 - DNA, 745 bp, Homo sapiens
tggtgcacaccgtgtgccctgcacgagtatccacgtcatcaactctctgcacccagggcttcctggcgctcttcttcaggtgacacatggggagtatcaagtcagaagtccgtgagcaagatcaatgccaaggcgcgttgactcgcgtcgaggaggtgcaaggcgtagatcatcctggatctgctgttcatcgacgacggtccacatgctggacatcgagagcttctccttcctcaacccggtccctggagagttacatggcgcctgtcctgatcatggccacctatctcgtggcatcacgcgtaatccggggcaccagctaccagagcctctcactggcaatccccatagacctgctggaccggctgcttatcgtctccacctaccccctactagcgagaaagacaacgaagcagatcctccgcaatccggtgcgaggaagtaagattttgagatgagtgaggacgcctacacggtgctgacccgcattagggctggtagacgtcaattgcgctacgccatcctagctcatcacagctgccagcttggtgtgccggaaacgcaagggtactagaagtgcagtgtgcgatcgacatcaagcgggtctactcactcttcctggatcgagtcccgctccacgcaagtacatgaaggagtaccaggacgccttcctcttcaacgaactcaaaggcgagaaccatgacacctcctgagttggatgtataacccgacgcacctgttgtct

SEQ ID NO: 542924 - DNA, 358 bp, Homo sapiens
  misc_feature (45)..(45): n is a, c, g, or t
  misc_feature (72)..(72): n is a, c, g, or t
  misc_feature (81)..(81): n is a, c, g, or t
  misc_feature (204)..(204): n is a, c, g, or t
  misc_feature (263)..(263): n is a, c, g, or t
gccttctccctccatgaatagggtataaggccccttataaaagancccttcatgccccaggtacgggtggcntgcgcttanaatccccagctacctcagagggctgaggcggaagaatcacttgaggcccaggagtttgagaccagccctggaaaacatagtaagaatccacttctaaaaacttaaaaaaaataaataaattancccggcatggtggcatgtgcctgtagtcccggctactcaggaggctgaggcgggatgancctttgagttaaggagttcgtggcttcattgagctatgatcacatcactgcaccttagcctggatgacacagcaagacctcatttgtaaaatgaa

SEQ ID NO: 542925 - DNA, 189 bp, Homo sapiens
atctgttgttccagatgctcttgaagaggttcagagcctcctgcaggcgcgtgagctggttgtcctcccggatgaccatgtttgagctgctgctggccaccacgaagatgatggcatgcacatcgttgaagcactggattcactttgcgggttcatcgcgctggccacccatacaaactgcgggggtgg

SEQ ID NO: 542926 - DNA, 896 bp, Homo sapiens
gggtctgagctcacctgcccggaagataataagattaaggaactaacacttgaaattgagagactgaagaaacgtctccaacaattggaagtggtcgaaggggatttgatgaagacacggaagatgagtatgatcaggctggaacagacaatttagaactgagcaggataaggctaacttcctctctcaacaactagaggagatcaagcaccaaatgccaagaataaccgccattagagaagggtgaggttgtgagcccaggaacgctgaatctggagacacaagatttcgggtgtggaacggaagctaaacacgtcggagactttaaaagcccgaagtacaaagctcttaaacagagacagattcacgaaacttaattgaaccaacagcaagatccagctttctcaagctcccaggtacgacttatcttgtacttccaaccaaagattagtggaaaagaagaacaataagaaccaacaacaccatggggcgcagggaggtcctcaagtcctgacccaaaagagttgggagctttccaaggggctaacagcagaaggctcttagggccccaatgtgttgactgggacggacagcaatggtggatgttccctggtgacgtcaaacgtgaagtccacaacttgatgcaagacaggcggtgaaggaaggcaagaggggaagaacacggccaggcggtcatcatacgcgaaatcctttccagggacgcaaccagccgtattatggagtaatctcgggcaggggggattggagaacacccggtgaaagaatctactggctagaaaggaatcctcacagagcaaaatgaggccactatgggaacaggcttggcatcacgggagggcacgacggaaaacgggaccccaacagtcaggaaaagc
